United States Patent 11,981,905 (POLYNUCLEOTIDE SEQUENCES AND PROTEINS ENCODED THEREBY USEFUL FOR MODIFYING PLANT CHARACTERISTICS) - sequence listing, part 5

SEQ ID NO: 10788 - protein, 272 aa, Panicum virgatum
  misc_feature: Ceres CLONE 1725463
  misc_feature (173)..(252): Pfam Name: ABA_WDS Pfam Description: ABA/WDS induced protein
MADEYGRSGYGRSGAGDDYESGYNKSGTDDYGRGEGGYNKSGTDGGYGGRFNKSGGDEYGRSGGDGYNRPGTDEYGRSGGDRSGTDDYGSGYKKSGTDDYDRSGGYNKSATDDYNSGGGGAYNKSSGGDDEYTTGGGRYKKTSGDDEYTGGGGYDSKSGGGVDEYGSSRNDSEKYRKEEKEHKHKEHLGEMGALAAGAFAMYERHEAKKDPEHAQRHKIEEGVAAVAAVGSGGFAFHEHHGKKEAKDAAEDAEEEEEEAARGEGKKKHHFFG

SEQ ID NO: 10789 - DNA, 651 bp, Panicum virgatum
  misc_feature: Ceres CLONE 1725468
  misc_feature: Encodes the peptide sequence at SEQ ID NO. 10790
accggacagagcggaaccgagccatggagctggaggccgccaccgcggatctcgcggaggagggcaccaagggcgacgacgcggcgggcaggctcacctacgagattttctccctcctcgaggccaagttcctcttcggccccccgcgagcggcggcggcgggcaaggtgtgcgtcctctccatcgacggcggcgcgcgcgcgtccgacgggctcctcgccggcgccgcgctcgtgcggctcgaggccgcgctgcggcggcgcgcggggagccccgccgcgcggctgcccgacttcttcgacgtcgcggcggggtccggcgcggggggcgtcctcgcggccctgctgttcgcgcgcggcccgcgcgggaggcccttgtacaccgccgaggacgcgctcgcgttcctgctccgccgcgtccggcgcgggggcgggggcgggggctggcccgcgcgccgcgcttgcgggctcctcctcctcccccgccgccgcggcgccggcgcggggtccgccttcgggcgggcgctcggggagctcacgctccgggacacgctgcggccggtgctggtcccgtgctacgacctcgcgacgcgggcgccgttcctcttctcccgcgccgccgccgcggagtcgcccgcgcacgacttccggc

SEQ ID NO: 10790 - protein, 209 aa, Panicum virgatum
  misc_feature: Ceres CLONE 1725468
  misc_feature (52)..(209): Pfam Name: Patatin Pfam Description: Patatin-like phospholipase
MELEAATADLAEEGTKGDDAAGRLTYEIFSLLEAKFLFGPPRAAAAGKVCVLSIDGGARASDGLLAGAALVRLEAALRRRAGSPAARLPDFFDVAAGSGAGGVLAALLFARGPRGRPLYTAEDALAFLLRRVRRGGGGGGWPARRACGLLLLPRRRGAGAGSAFGRALGELTLRDTLRPVLVPCYDLATRAPFLFSRAAAAESPAHDFR

SEQ ID NO: 10791 - DNA, 767 bp, Panicum virgatum
  misc_feature: Ceres CLONE 1725473
  misc_feature: Encodes the peptide sequence at SEQ ID NO. 10792
aggtcgtcttccacatccttctcattcatctctccccactcctagcttctgcagctctcaagctagctgctagctagggtttacgccggtcgggatccgcggagctgacggccgggggagggcagtcgagttcggcggcggcgagatctgcttgctggacgtcgccggcacagaggaaattcagttgatttagagggattattattgcagcccatttcttgagatcctgggcgtccgatccggtgccgcgacgatgacgacgacgagcgccgccgcgcaaagatgatacacagcagcaacctgcagcaggcggcggcggcggcggacgaggagctcgcccggaagaacgccgccgtggcgacgtcgcggcaatggtcggcgcagacggagtcgcgcatcgtgcgcgtctcccgcgtcttcggcggcaaggaccggcacagcaaggtgaagaccgtcaaggggctgcgcgaccggcgggtgcgcctctccgtgccgacggcgatccagctctacgacctgcaggaccgcctcggccttaaccagcccagcaaggtcgtcgactggctcctcaacgccgcgcgccacgagatcgacaagctgccgccgctccagttcccgccgcaggacctcatggtaggccacctggcgccccccatgccgctggcgcacgaggagaagttcgcccacatcgccgcggccgcggcgctcacgagcgacggcgccaagcccggccagcagggcgacgtcgacatggacgggagcggagc

SEQ ID NO: 10792 - protein, 161 aa, Panicum virgatum
  misc_feature: Ceres CLONE 1725473
  misc_feature (32)..(161): Pfam Name: TCP Pfam Description: TCP family transcription factor
  misc_feature: The sequence is a functional homolog of SEQ ID NO 1202 in the 10/666,642 US patent application
MIHSSNLQQAAAAADEELARKNAAVATSRQWSAQTESRIVRVSRVFGGKDRHSKVKTVKGLRDRRVRLSVPTAIQLYDLQDRLGLNQPSKVVDWLLNAARHEIDKLPPLQFPPQDLMVGHLAPPMPLAHEEKFAHIAAAAALTSDGAKPGQQGDVDMDGSG

SEQ ID NO: 10793 - DNA, 321 bp, Panicum virgatum
  misc_feature: Ceres CLONE 1725473-R
  misc_feature: Encodes the peptide sequence at SEQ ID NO. 10794
attctactcctcggaagctgatcagcagttccaggtggataaccttggctcgcaaagcctgtccctgagctcggcaagggcttaccatgatcaggctagctagactaccgacgaagcttcgatcaagattaaggtaggaagaatgctctctgatcccagtccccaatcaattacaataatctagctgccggtagggtacaagtgtgacatgggtttctaagtgcctttggagccacaataattaagctggtaaggatttggtaattagtaggaggttggacactaaacataataaaattaaatcgggggggctggcggggc

SEQ ID NO: 10794 - protein, 33 aa, Panicum virgatum
  misc_feature: Ceres CLONE 1725473-R
  misc_feature: The sequence is a functional homolog of SEQ ID NO 1202 in the 10/666,642 US patent application
FYSSEADQQFQVDNLGSQSLSLSSARAYHDQAS

SEQ ID NO: 10795 - DNA, 757 bp, Panicum virgatum
  misc_feature: Ceres CLONE 1725478
  misc_feature: Encodes the peptide sequence at SEQ ID NO. 10796
gctctcacgcgcttcgtgctcgccgcctcccccacttccgcatcgcgccccccatggcctccatcgccggatccgccctcttcttcgccgggcccgtcaaggccgtcaacactagctcgctctctttctctgctgcgaggaagggcaatgcattcctccgcctgcagccagtgcagaagagattcgctgtttgctatgctgccaaaaaggatacagtgaacaaggtttgtgaaattgtgaagaagcagcttgctgttccagagggcactgatgtttgtggtgcctcgaagttctctgatcttggtgcagattcacttgatacggttgagattgtgatgggccttgaggaggagtttcagatcagcgtcgaggaatcaagcgctcagtcaattgcgacagttgaggatgctgctgagctcatcgacaagcttgttgctgagaaatcgtcctaaagtcacaaggcgtgatggatctaccttgttcgtgtcctgcccactcaccccatatctaggtttctatgctctgtaggcttggcgattttctcagcattgttgtccactgtgtctgtaataataccgaaatgattttctcagcattgttgtccactgtgtctgtaataataccgaaatgagtttaagctgttgaaccttacggtggtgcgtattctgtcagttcattgttgtatgagtgattcttcctggaagaaatgaatgattcttcctggaagaaatgaatgattcttcctggaagaaaatgg

SEQ ID NO: 10796 - protein, 132 aa, Panicum virgatum
  misc_feature: Ceres CLONE 1725478
  misc_feature (56)..(123): Pfam Name: PP-binding Pfam Description: Phosphopantetheine attachment site
MASIAGSALFFAGPVKAVNTSSLSFSAARKGNAFLRLQPVQKRFAVCYAAKKDTVNKVCEIVKKQLAVPEGTDVCGASKFSDLGADSLDTVEIVMGLEEEFQISVEESSAQSIATVEDAAELIDKLVAEKSS

SEQ ID NO: 10797 - DNA, 1006 bp, Panicum virgatum
  misc_feature: Ceres CLONE 1725480
  misc_feature: Encodes the peptide sequence at SEQ ID NO. 10798
agaagcccccggcaaagaggaagagagcctctgctgattcagtagcaattctctggttggttctctgctgctgctgtgtgtgtgtctgcgaagaacccccgagagggacagatgggttgccctgccccgtacctgctctcggccagcagctgcatcttcctggggagcagcacgcctcaggcgagccttgtccgaggcgccgtcatcggcggcgttacgcagcaccaggcagttcctgctcacctgcagcgcctcgtcgtctccgtctccttcctcgccggcgccggcgcaggaggactcccgactgccaccaggaggagtgcgccccggagaacgaggtcgggagcctgagcgcccagtggctggcggaggagcggacccgggtcgccggaaccttcccgcccacgacgagagggtggaccggcctcgtcgagaaggacaccgccggccagaccaacatctactccgtcsagcsgacggtgtacatggcggagagcgccgtcagctccsgcacsgcgggcacgtcggcggagggggccgagaacacggccgccatcgcggcggggctggtcctcatcaccgtcgccgcggcctcgtccatcctcatccaggtgagcaagaagcagccgcaggtgcccgaggccgcctacagcggcccgccgctcagctactacgtcgccaagttccagcccgcggcggaggcgccggcgccggcggagcccctcgaggcccccgcccccgcggaggcggcggtcgtcgcccaggacagccccgccgtcgaggcagccgccccggaggcgctggaagcagagcagctgtcctcgtgagctgatgttgtagtcaagattcagctttgtggctgcttacagatgagcttgtagtgcacgatggtgggagataatacacatggtaatcgtgagcatttgctaattgtaaaagttgcgtgtgtatatacaatgcattcagcatgcctatatgcttatatgaaagcccacgacactcgcac

SEQ ID NO: 10798 - protein, 274 aa, Panicum virgatum
  misc_feature: Ceres CLONE 1725480
  misc_feature: Useful for making plants with modulated flowering time
  misc_feature (157)..(157): Xaa is any aa, unknown, or other
  misc_feature (158)..(158): Xaa is any aa, unknown, or other
  misc_feature (170)..(170): Xaa is any aa, unknown, or other
KPPAKRKRASADSVAILWLVLCCCCVCVCEEPPRGTDGLPCPVPALGQQLHLPGEQHASGEPCPRRRHRRRYAAPGSSCSPAAPRRLRLLPRRRRRRRTPDCHQEECAPENEVGSLSAQWLAEERTRVAGTFPPTTRGWTGLVEKDTAGQTNIYSVXXTVYMAESAVSSXTAGTSAEGAENTAAIAAGLVLITVAAASSILIQVSKKQPQVPEAAYSGPPLSYYVAKFQPAAEAPAPAEPLEAPAPAEAAVVAQDSPAVEAAAPEALEAEQLSS

SEQ ID NO: 10799 - DNA, 692 bp, Panicum virgatum
  misc_feature: Ceres CLONE 1725482-R
  misc_feature: Encodes the peptide sequence at SEQ ID NO. 10800
gctgctgatcccgtccaaggggaaccccagcaaggagcgcgagttccccggccaggtgctccgctacgaggacaacttggacgccaacagcaacgtctccgtcatcgtccagcccaccaccaagaagaccatcaccgactacggctcgcccgaggagttcctcgcccaggtcgactacctcctcggcaagcaggcctacgccggcaagacggactccgagggcgggttcgagaccgacgcggtggccacggccaacatcctggagagctcggcgccagtggtggacgggaagcagtactacagcgtgtccgtgctgaccaggacggcggacggcgatgagggcggcaagcaccagctcatcacggccaccgtctcggacggcaagctctacatctgcaaggcgcaggccggcgacaagaggtggttcaagggcgccaggaagggcgtcgagaaggcagccagctccttcagcgtcgcataagcagtgcacgcatcatctgtgtgccggaatttgtttcttttggttcagggatgcttacgtagatacagaggttgagcatgcgtgtgcgctccggcctttgattgtacatgagaacaaagaccaaggagagctccatttcgtccctgcaaggattgatttctgctctcacgatgtttaagaactcctagtactaataatgcttcgtttttgt

SEQ ID NO: 10800 - protein, 159 aa, Panicum virgatum
  misc_feature: Ceres CLONE 1725482-R
  misc_feature (1)..(159): Pfam Name: PsbP Pfam Description: PsbP
  misc_feature: Useful for making plants with altered lignin content
  misc_feature: Useful for making plants with modulated nitrogen use efficiency
LLIPSKGNPSKEREFPGQVLRYEDNLDANSNVSVIVQPTTKKTITDYGSPEEFLAQVDYLLGKQAYAGKTDSEGGFETDAVATANILESSAPVVDGKQYYSVSVLTRTADGDEGGKHQLITATVSDGKLYICKAQAGDKRWFKGARKGVEKAASSFSVA

SEQ ID NO: 10801 - DNA, 2163 bp, Panicum virgatum
  misc_feature: Ceres CLONE 1725871
  misc_feature: Encodes the peptide sequence at SEQ ID NO. 10802
aaatctcgcttccaacttctccggcccgtcgtgctctctctgcagtctcctccttcccccaccaccaccggagaccgcgccgcggcccgcggggctcaggtagctcgggatggcctccggagcctcggctgggcgcgacccgtacgacgaggaggccgccgcacgccggcccctcgagttcgacggccgtgacgccgccttgtcctccgaccaccggcctgggaatgtcatgccgagatatcaagtgggctccacgaagggtgatacaagtagtaggtacgctgaggggtcacgtttacaaagtaccgatgacgtgcgcaagagcaagcccggttcgagatactatacagcatttggggtggatctgtcccccgataatatggcagttgccattgtatatttcgtgcaaggggtgttaggtctcgcacgacttgctgtgagcttttacttgaaagatgatcttcatctcgatccagctgagactgcagttgtatctggcttctcatcgttgccatggttggtcaagcccctctatggctttatcagtgattccattccactctttggatatcgaagaaggtcatacctttttctgtcagggctacttggagcattttcatggagtttgatggccacagtagtgagcagtaaatatagtgcagcattctctattcttcttgggtcactttctgttgccttctcagatgttgtagttgattctatggttgtggagagagcccgtggagaatcacagagtacatctggatctctccagtcgctctgttggggatcttctgcctttggaggaattgtgagtgcctactttagcggttcatttgtggatacttatggagtaagatttgtctttggtgttacagcgtttttacccctgatgacatctgctgttgcagttcttgtaaatgaacatcgcatacctcctggagaatgtactatcttactctctggttcaggatttgttgagagctctaagcagcatgtcaggcagctttggacttcagtcaaacaacctaacattttcttgccgaccttgtttatattcctttggcaagcaacaccacagtcagattctgctatgtttttcttcatcacaaataagcttggattcactccagagtttctaggccgtgtgaagcttgttacctctatcgcatccctgcttggtgttgggttgtacaactactttctgaaggaaatttctctaagaaaaatctttctagtgacgaccgtcatagggtcagctcttgggatgacgcaggtgcttctcgtgactgggcttaatcggcagtttggtatcagtgatgagtggttctctattggcgattcattaatcatcactgtccttggtcaggcttcatttatgccggtcttggttttagctgcaaaattgtgccctccaggaatggaggccactttatttgcaactttgatgtccatttctaatgctgggagtgttactggcggtctggttggtgctggtctaactcgggtttttggagtcacaagggactcctttggaaatctacctctcttgattgtcgtctgcaatcttagttcgctgcttcccttgcctcttttaggtctcctgcctgaggaatcaggtggcacagataatggagaaatgaaacacaactgacttactgatagttttgtctccatgtgttccggatctcaagtatggcgcaccactgtgtccagctccaactcggatatggcccattaagttggagttcagaaagccagtatcgaaatatgaaagtgacgtcggatataatttcagtcagtcgccgctttcctcggtcaggttaatctactgtgactgtttacctgtgtgatggaagtgatttatgaatgtccgaaaatgatctctggtactacaacacacaggtacttgacacttttttatagtttctaagtttaccttgtatactaagacaaggtaagttttctttttctcaacactctttgtcagttaatgcaaccccatgaaaataagtctagggattgaagattagtagtggattcccttacagagctgaatgtattgtgccaacaaaaagggggtatttatactttatttgaatcctgaagtatgggcatgtaaggactaaagaataaatacttgcacacagttcaatgtgtgat

SEQ ID NO: 10802 - protein, 514 aa, Panicum virgatum
  misc_feature: Ceres CLONE 1725871
  misc_feature (100)..(511): Pfam Name: BT1 Pfam Description: BT1 family
MASGASAGRDPYDEEAAARRPLEFDGRDAALSSDHRPGNVMPRYQVGSTKGDTSSRYAEGSRLQSTDDVRKSKPGSRYYTAFGVDLSPDNMAVAIVYFVQGVLGLARLAVSFYLKDDLHLDPAETAVVSGFSSLPWLVKPLYGFISDSIPLFGYRRRSYLFLSGLLGAFSWSLMATVVSSKYSAAFSILLGSLSVAFSDVVVDSMVVERARGESQSTSGSLQSLCWGSSAFGGIVSAYFSGSFVDTYGVRFVFGVTAFLPLMTSAVAVLVNEHRIPPGECTILLSGSGFVESSKQHVRQLWTSVKQPNIFLPTLFIFLWQATPQSDSAMFFFITNKLGFTPEFLGRVKLVTSIASLLGVGLYNYFLKEISLRKIFLVTTVIGSALGMTQVLLVTGLNRQFGISDEWFSIGDSLIITVLGQASFMPVLVLAAKLCPPGMEATLFATLMSISNAGSVTGGLVGAGLTRVFGVTRDSFGNLPLLIVVCNLSSLLPLPLLGLLPEESGGTDNGEMKHN

SEQ ID NO: 10803 - DNA, 826 bp, Panicum virgatum
  misc_feature: Ceres CLONE 1725875
  misc_feature: Encodes the peptide sequence at SEQ ID NO. 10804
acattcaacttgtcttcttctctgcagcatgggcgctgcttctgtgggcacaatgtgtgagcaccctgcggttcacaaggggtgatttcccggatggctttgcgtttggagctgcaacttcagcctatcagtatgagggtgcagcagctgagggcgggaggagtccaagcatctgggacaccttcacccattcagagagaaatacggatgggggaaccggtgatatcgcttctgacggctaccacaagtacaagcaagatgtcaaactaatgagtgatataggcctggaggcttaccggtttactatttcttggtcaagacttattcctggtgggagaggagcagtgaatcctaaagggctgcagttttacaacaatttgatggatgatctggtaaaagaagggattaagataaatgctgttctttaccatatggaccttcctcagatcctcgaagatgagtacggtgggtggattagccccaaaattatagaggatttcacggcctatgccaatgtgtgtttccatgagtttggcgacagagttgctcattggacaactatgctccagccaaatgccttggctcaaggtgcttatgacattggagaactacccccaaaccattgctcctatccgtttggcagcaattgtgcagttggaaactccacaactgagccatacttgtttatacaccacagcctactggctcatgcgtcaactgtttacctatacaggcggaagtacaaagctgcacagaagggcattattggactgaatttgtacaccatgtggttctatccattcacagattccaaaatagacattgc

SEQ ID NO: 10804 - protein, 274 aa, Panicum virgatum
  misc_feature: Ceres CLONE 1725875
  misc_feature (25)..(274): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered carbohydrate content
  misc_feature: Useful for making plants with altered cell wall content and/or composition
IQLVFFSAAWALLLWAQCVSTLRFTRGDFPDGFAFGAATSAYQYEGAAAEGGRSPSIWDTFTHSERNTDGGTGDIASDGYHKYKQDVKLMSDIGLEAYRFTISWSRLIPGGRGAVNPKGLQFYNNLMDDLVKEGIKINAVLYHMDLPQILEDEYGGWISPKIIEDFTAYANVCFHEFGDRVAHWTTMLQPNALAQGAYDIGELPPNHCSYPFGSNCAVGNSTTEPYLFIHHSLLAHASTVYLYRRKYKAAQKGIIGLNLYTMWFYPFTDSKIDI

SEQ ID NO: 10805 - DNA, 468 bp, Panicum virgatum
  misc_feature: Ceres CLONE 1725875-R
  misc_feature: Encodes the peptide sequence at SEQ ID NO. 10806
gaggattggctacttgcaaaaatacatagctggccccctgaaagccatcagaaagggagctgacgtgcgggggtacaatggggggtcattatttgacctgtatgagttattcggtgggttcaagtcgcattatggccttgttgctgtggatttcgacactgacgagcgaagaaggcagccaagacattctgctcactggtactcagacttccggaagaacaatgctgcgattgaactggaatatgattttacgactaaaatctctcatgctcaaatttgaccactggtgccctcaaaatagtcttctcaagaatagcagttctggtccttctgtatgtgcagcgaccagtgagcggtctctgttaagttcagacattgtcatcttgtatattttgtatactcttgttaggctgttacctcctaaaaagcaagagcttaaataaatatcgttaaattttaaaaagatag

SEQ ID NO: 10806 - protein, 92 aa, Panicum virgatum
  misc_feature: Ceres CLONE 1725875-R
  misc_feature: SWISSPROT Homolog: EC 3.2.1.85 6-phospho-beta-galactosidase
  misc_feature: Useful for making plants with altered cell wall content and/or composition
RIGYLQKYIAGPLKAIRKGADVRGYNGGSLFDLYELFGGFKSHYGLVAVDFDTDERRRQPRHSAHWYSDFRKNNAAIELEYDFTTKISHAQI

SEQ ID NO: 10807 - DNA, 1948 bp, Panicum virgatum
  misc_feature: Ceres CLONE 1725876
  misc_feature: Encodes the peptide sequence at SEQ ID NO. 10808
acgggacaccacgcctgtcgctcgcagctcgctcgacgcgacatggcggcctcggcgctgcagcacgagcgccacctcctcctccttgccggcagcggcggccgccgccaccggcccctcctcagcatgctcccgccacgcgcgcccttcccgcaccggcgccgccgggggccgctggccgtgagggtgtcctccggcgacggcgggggcgcgggaggggtcgcgagcgccgtggagaagcgctcggttccgggggcggtcggggaggatgagggagcgaggggagtggaggagttggagggggaaatggccggcgcttgggagctgaggtggccgccgtgggaggggttgcccgagcggtacaagctcattggcgccacctccctcgccttcgtcatctgcaacatggacaaggttaacctgagtgtcgcgattattccaatgtcacatcagtatggttggaactcatcaactgctggattagttcagtcctcattcttttggggttatgcgttgagtcaactaccaggaggatcgctggcaaaattgtttggcggaaggaaagttcttgagatcggtgttgtgacatggtctttggccactgctctaattcctgttgtagcagggttcatgccaggacttgtgctgtcaaggattctggtaggcattggagaaggtgtctccccatcagctgctacagatttaattgctaggtccattcccttgcaagaacgatcaagagcagttgctgttgtttttggtggtttgagcttcggaagtgtcttaggacttctgtttgcccctcccatcattcagaaccttggctgggagtccgtattttacatatttggacttcttgggattatttggtgcatagggtttgaatctcttaaagggaaacagttgggtaacaagaaaggcctaaatttgggacaaagttctactggatccaatggctttgtctcatcagctgtgtcttcagaatcatcagattcgtcattggaagatttgcagaattcactaaaggatgttccttgaggagcatttttcaaaagcaaggcagtgtgggcaatgatatatgcgcacttttgcggaagttgggggcattatacttgcttgtcttggctaccaacattctttagtgaggagctgaacctgaacttaacagaagcagcatgggtgtcagtccttcctcctttgggttcaattgtcattacatctattgcagcaccttttgcagataacctgatagcaaatggagttgacaccacgaaggtacgaaaaatatgccaaacaattgcctttgtttcacctgcgattttcatgatgctgtcctctgtggatcttggactgcctccctgggaaatcgttgcttttcttacaagtggtctagcactctccagcttcgcattttcagggctttattgtacgcatcaagatatctctcgtgaatatgcaagcattctcctgggaatcacaaacactgtgggtgctgtgcctggaattgttggtgtcgcactgacaggctatcttcttgattcaactcattcttggagtatatcactcttcgcgccatctgtcttcttttacttaactggtactgctctatggttagcatttgccagcagtgagccccaggatttttcgaagtcaggatcaaagtcgtgacctatggttcccctgtgcacagaaggggttatttcagagggaaatttcatctttagtctaggcaaaattatggagcccttgggcagcgaatgggttttatgttccttttcagtcagttggagataagaggaagccaatggcagaggactacctgtaaatgcatgtggccattggctggcatgcatatatgctgtagaagtgatagaattggtgtaattgatggattgtattagcttgaggcctcggccggtatatataagagtacaagacttgagttgcg

SEQ ID NO: 10808 - protein, 331 aa, Panicum virgatum
  misc_feature: Ceres CLONE 1725876
  misc_feature (113)..(313): Pfam Name: MFS_1 Pfam Description: Major Facilitator Superfamily
MAASALQHERHLLLLAGSGGRRHRPLLSMLPPRAPFPHRRRRGPLAVRVSSGDGGGAGGVASAVEKRSVPGAVGEDEGARGVEELEGEMAGAWELRWPPWEGLPERYKLIGATSLAFVICNMDKVNLSVAIIPMSHQYGWNSSTAGLVQSSFFWGYALSQLPGGSLAKLFGGRKVLEIGVVTWSLATALIPVVAGFMPGLVLSRILVGIGEGVSPSAATDLIARSIPLQERSRAVAVVFGGLSFGSVLGLLFAPPIIQNLGWESVFYIFGLLGIIWCIGFESLKGKQLGNKKGLNLGQSSTGSNGFVSSAVSSESSDSSLEDLQNSLKDVP

SEQ ID NO: 10809 - DNA, 843 bp, Panicum virgatum
  misc_feature: Ceres CLONE 1725877
  misc_feature: Encodes the peptide sequence at SEQ ID NO. 10810
agcacgccaggcacccgaccggagcccgtccgtgcgccgctctccccccgcctccgaccccagccgctccggcgagcccccagcgaaggcggcgtcagccatgagggagatcctgcacatccagggcgggcagtgcgggaaccagatcggcgccaagttctgggaggtgatctgcgacgagcacggcatcgacgccacgggccgctacgcgggggactcggacctccagctcgagcgcatcaacgtctactacaacgaggccagcgggggccggttcgtgccgcgcgccgtgctcatggacctcgagcccgggaccatggactccctgcgctcgggccccttcggccagatcttccgccccgacaacttcgtcttcggccagtccggcgccggcaacaactgggccaagggacactacaccgagggcgccgagctcatcgactccgtcctcgacgtcgtccgcaaggaggccgagaactgcgactgcctccagggtttccaagtctgccattccttgggaggtggcactggatctggcatgggcacccttcttatttctaagattagggaggagtaccctgatagaatgatgttgaccttctctgtattcccatcaccaaaggtttcagatactgttgtggagccatacaatgctacactttcagttcaccaacttgttgagaatgctgatgaatgtatggtgcttgacaatgaagctctgtatgacatatgcttccgcacgctaaagctcgccacacctacctttggtgacctgaaccatcttatctctgctaccatgagtggcgtcacatgctgcctgaggttccctggtcagctcaactc

SEQ ID NO: 10810 - protein, 247 aa, Panicum virgatum
  misc_feature: Ceres CLONE 1725877
  misc_feature (45)..(244): Pfam Name: Tubulin Pfam Description: Tubulin/FtsZ family, GTPase domain
  misc_feature: Useful for making plants with modulated flowering time
MREILHIQGGQCGNQIGAKFWEVICDEHGIDATGRYAGDSDLQLERINVYYNEASGGRFVPRAVLMDLEPGTMDSLRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLN

SEQ ID NO: 10811 - DNA, 416 bp, Panicum virgatum
  misc_feature: Ceres CLONE 1725877-R
tcaccgaggccgagagcaacatgaacgacctggtcgcaggagtatcagcagtaccaggacgccaccgctgacgaggagtacgaggacgaggaggaagaggaggctggccgaatagcgatggctccggtgcccttcccaaggccgccgtctgcccaggttgtgtccctgtgaatgggtttgtcttctgtgcttctcgtggctttgcatgatcacgtacgttgtcgtcgttgaggtcgcgtctgtgctccggctgcggttgcagtaatgtacgtactgtgttgtactaggtcgccgtcggtttctgttccgcatactttgtcaagtagcttacggctttgcactgctagtgctcaccttgagctgatcgcctgtaatttctgacgagtattggtagtgagtgatttcttctcgtatct

SEQ ID NO: 10812 - DNA, 828 bp, Panicum virgatum
  misc_feature: Ceres CLONE 1725884
  misc_feature: Encodes the peptide sequence at SEQ ID NO. 10813
tgaatccgccagccgaaaggcctgggattccagaagtctctgcttgactcaccggcggcggcggcgcggcaatctccggcgaaaaccctaccctgctccgcgccgcggtcgaaggtaggtaggagtgtgccgagaggggaagccgtggtcggagcagcggaggtgtcgggatggtcttcgggcaggtggtgatcggcccgccgggctccggcaagaccacctactgcaacggcatgtcgcagttcctctccctccttggcaggaaagtcgcagttgtgaatcttgaccctgccaatgatgcattgccatatgaatgtgctataaacatcgaggacctcattaaactcagtgatgtcatggctgagcattcacttggcccaaatggagggcttgtttattgcatggattacttggagaagaatattgattggcttgagggaaaattgaagcctcttattgaagatcactatctgttatttgattttccgggacaagttgaacttttcttccttcactcaaatgcaagaagtgttattaataaactcatcaaaaagctaaacttgaggctgactgctgtgcacctcattgatgctcatttatgctgtgatcctgggaagtatgtgagtgctttgcttctttctctgtcaacgatgctacatttggaattgccacatatcaatgtcttgtcaaagattgacctcattgagaactatggaaatttagcattcaaccttgacttctacactgatgttcaagatctttcttacctgcaacatcatcttgagcaggatcctcgttctgccaagtacaggaaactaactaaggagc

SEQ ID NO: 10813 - protein, 219 aa, Panicum virgatum
  misc_feature: Ceres CLONE 1725884
  misc_feature (7)..(219): Pfam Name: ATP_bind_1 Pfam Description: Conserved hypothetical ATP binding protein
MVFGQVVIGPPGSGKTTYCNGMSQFLSLLGRKVAVVNLDPANDALPYECAINIEDLIKLSDVMAEHSLGPNGGLVYCMDYLEKNIDWLEGKLKPLIEDHYLLFDFPGQVELFFLHSNARSVINKLIKKLNLRLTAVHLIDAHLCCDPGKYVSALLLSLSTMLHLELPHINVLSKIDLIENYGNLAFNLDFYTDVQDLSYLQHHLEQDPRSAKYRKLTKE

SEQ ID NO: 10814 - DNA, 3560 bp, Panicum virgatum
  misc_feature: Ceres CLONE 1725887
  misc_feature: Encodes the peptide sequence at SEQ ID NO. 10815
attattatcctcttcctctcccattctctcttcctcgatttctccctccggttcccctcccaccctcggccctcgcctctctcccgcgcggccgccgcccgctccctcctaccgcttctgagctggggcggcggagcgcgacgccgctccggtctcctccgcacccaaccaagcaaaaccaaaccacggcacttggcggcaggttttgaacccctgcccccgcttccatgccgacgcctccgctctccaccatttccacccaccaccgcgccccgccaccatggccgcctcccaagaccgccaccaacccacgagtgagaacccggtgcggcgtgctcgcgccgccggccggtcaagcactgcagacggccgccgctgctccaggtccgaggagcaccgactacccgcccaaccgggccccgagctccgacgtgaacctgcaaattcagcgcctctgtcggacgggcgacctcgcggaggccgtgaggctgctgggctctgacggcgttgatgtgcgcagctactgcgcggtcatccagctctgcggggaggagaggtcgctggaggccgggaggagagcgcatgccctgttgcgcgcgtccggcgatggaacgggtgggattgggagcgttcttgggaagaggctagtgctaatgtacctcaaatgcggcgatctgggcagtgcgagaggggtgtttgatgaaatgccacctcaggtcgccgacgtccgtgtctggacttcgctgatgagtgcgtatgccaaggctggtgattttggagaaggtgttctgctgtttaggcagatgcactgctgtggggttagtccggatgcacatgccgtttcctgtgttctgaagtgcattgccagtttgggcagcatcatggacggcgaggtggttcatggattgcttgaaaagttgggtcttggagcagaatgtgcggttgctaatgctctcatcgcgttgtactcaaggtgtggcttgatggagggtgcgatgcaggtatttgagactatgcatccccgggatgccatttcttggaattctatgattagcggttgcttttccaatggatggcatggaagggctgttgatcttttcggcaaaatgtggtctgagggtttggagatcagttcggtgacgatggtcagtgttttgcctgcttgtgcggagttaggttatgaccttgttgggaaagtcgtgcatggatactctgtgaaatctggattactttgggatcttgaatcattagagagaggaatagatgatgttcttggatcaaaactggtattcttatatgtgaaatgtggtgatatggcctctgcaagaagggtgtttgatgtgatgtcatcaaaaagtaacttgcatgtgaggaatctgttaatcggtggctatgcaaaggctggtgaatttcaagaaagcctcttaatttttgagcaaatgcatgggcttggcattaccccagatgaacacaccatttcatgccttctgaagtgcatcactagtttgtctcgtgtcagtgatggcttggtggttcatgggtatctcgtaaagttgggttttggggcacagtgtgcagtttgcaacgcactgatatcgttctatgcaaaatcaaacaggattgaggatgcactcgaggtgtttgatggaatgcttcatcaggacatcatttcttggaattcaataattagcggatgcacttccaatggcttaaagagcgaagctgttcagctgttcataacaatgtggatacaagggcaggagctggactcagctacgttgctaggtgttttgccagcttgttctcagtcatgctattggtttttaggaagggggcttcatggctattcagtgaaaactggattgattggggaaacacctcttgctaatgcacttcttgatatgtactcaaattgctcagattggcatagcacgaatcagatattcagaagtatggatcagaaaaatgtggtgtcatggacagcaatgatcacaagttatactagggcagggctgtttgacaaagtggctggattactccaagagatggtattggatggtatcaggccagacgtctttgcagtcaccagtgccctacatgcatttgctggtgatgaatccttgaaacaaggcaaatccgtccatggatatgtcatcagaaatggaatggagaaacttcttcctgttaccaatgcacttatggaaatgtatgtgagatgtgggaatattgaagaagcacggttgatttttgatcgtgtgacaaacaaggatataatctcatggaatacactgataggaggttactccagaaataatcttgccaatgaatccttccttttgttcagtgaaatgttgcttcaattcaaacctaatgcagtgaccatgacctgcatacttcctgctgctgcaagcctttcatccttggagcgaggcagggagatacatgcttatgcactacgaagaggatatctggaagacaattatacatccaatgcactggtggacatgtatgttaagtgtggtgcgttactgctagctcgacttttgtttgaccgattgactaagaagaacctcatatcttggaccatcatgatcgctggatatggcatgcatggttgtggaagagatgccattgccctctttgaagagatgagaagcagtggtgttgagccagattcagcctctttcagtgccatactgtatgcttgctgccattcaggtcttagaaatgaggcatggagattcttcaatgctatgcgaaatgaacacaaaatagaacctaaattgaagcactatgcatgcatcgttgacctgcttagccatactggaaatctgaaggaggcttttgagttcattgagtcaatgcctattgaacctgattcaagcatctgggtgtcattgctgcatggatgtagaattcacagggatgtcaagcttgcagagaaggtggcagacagggtattcaagctggaaccagagaacactggatactatgttcttcttgccaacatctacactgaggctgagagatgggaggctgtcaagaagcttaaaagcaagattggtggtcgagggctccgtgagaactctggctgcagttggattgaggttggaggcaaggttcatgtctttgacgcggataaccggaatcacccacagggaagcaggattgcagggttcctggataatgttaccacaaggatgaaagaagaaggccatgatcctaagaaaaagtatgctctgatgggtgccaacaatgctgtgcatgatgaggcactttgtgggcacagctcgaagctcgccatcgcattcggcgtgctgaatttgtcagaaggtcggccaatccgcgtgacgaagaactcacgggtttgtagccactgccatgaggctgccaagttcatatccaagatgtgcaacagagaaatcattttgagagattcaaacaggtttcatcgttttgaaggaggcaggtgttcttgcagagggtactgctgaatgaaacaccaatcatgtaactaaaattttgtctgttgatagcagagagtacatatttttgctact

SEQ ID NO: 10815 - protein, 1088 aa, Panicum virgatum
  misc_feature: Ceres CLONE 1725887
  misc_feature (783)..(817): Pfam Name: PPR Pfam Description: PPR repeat
  misc_feature (582)..(616): Pfam Name: PPR Pfam Description: PPR repeat
  misc_feature (168)..(202): Pfam Name: PPR Pfam Description: PPR repeat
  misc_feature (269)..(303): Pfam Name: PPR Pfam Description: PPR repeat
  misc_feature (380)..(414): Pfam Name: PPR Pfam Description: PPR repeat
  misc_feature (481)..(515): Pfam Name: PPR Pfam Description: PPR repeat
  misc_feature (683)..(716): Pfam Name: PPR Pfam Description: PPR repeat
MPTPPLSTISTHHRAPPPWPPPKTATNPRVRTRCGVLAPPAGQALQTAAAAPGPRSTDYPPNRAPSSDVNLQIQRLCRTGDLAEAVRLLGSDGVDVRSYCAVIQLCGEERSLEAGRRAHALLRASGDGTGGIGSVLGKRLVLMYLKCGDLGSARGVFDEMPPQVADVRVWTSLMSAYAKAGDFGEGVLLFRQMHCCGVSPDAHAVSCVLKCIASLGSIMDGEVVHGLLEKLGLGAECAVANALIALYSRCGLMEGAMQVFETMHPRDAISWNSMISGCFSNGWHGRAVDLFGKMWSEGLEISSVTMVSVLPACAELGYDLVGKVVHGYSVKSGLLWDLESLERGIDDVLGSKLVFLYVKCGDMASARRVFDVMSSKSNLHVRNLLIGGYAKAGEFQESLLIFEQMHGLGITPDEHTISCLLKCITSLSRVSDGLVVHGYLVKLGFGAQCAVCNALISFYAKSNRIEDALEVFDGMLHQDIISWNSIISGCTSNGLKSEAVQLFITMWIQGQELDSATLLGVLPACSQSCYWFLGRGLHGYSVKTGLIGETPLANALLDMYSNCSDWHSTNQIFRSMDQKNVVSWTAMITSYTRAGLFDKVAGLLQEMVLDGIRPDVFAVTSALHAFAGDESLKQGKSVHGYVIRNGMEKLLPVTNALMEMYVRCGNIEEARLIFDRVTNKDIISWNTLIGGYSRNNLANESFLLFSEMLLQFKPNAVTMTCILPAAASLSSLERGREIHAYALRRGYLEDNYTSNALVDMYVKCGALLLARLLFDRLTKKNLISWTIMIAGYGMHGCGRDAIALFEEMRSSGVEPDSASFSAILYACCHSGLRNEAWRFFNAMRNEHKIEPKLKHYACIVDLLSHTGNLKEAFEFIESMPIEPDSSIWVSLLHGCRIHRDVKLAEKVADRVFKLEPENTGYYVLLANIYTEAERWEAVKKLKSKIGGRGLRENSGCSWIEVGGKVHVFDADNRNHPQGSRIAGFLDNVTTRMKEEGHDPKKKYALMGANNAVHDEALCGHSSKLAIAFGVLNLSEGRPIRVTKNSRVCSHCHEAAKFISKMCNREIILRDSNRFHRFEGGRCSCRGYC

SEQ ID NO: 10816 - DNA, 1147 bp, Panicum virgatum
  misc_feature: Ceres CLONE 1725889
  misc_feature: Encodes the peptide sequence at SEQ ID NO. 10817
gtagctcctgctcttgcacctactccgctactcgcctcgctctccccgtctctcgcgcctcccccgagcggtcggtgatggcactggcagccgcggcgtggctgtgtggactcgtctcgcttctggcggtagccgccgcggcggcggatggggattgggagccgctgatacggatgccgacggaggaggggggtgacgctgctgctgctccggcggcggaggatgaggtggggacgaggtgggccgtgctcgtggcgggatcctccggctacggcaactaccggcaccaggccgatgtatgccatgcatatcagattctgcggaagggaggagtgaaggaggagaatattgtggtgttcatgtacgatgatattgcccataacattctgaatccaagtcctgggattatcattaaccatcctaaaggtgaaaatgtatatactggtgttccaaaggactatacaggcgatcaggtcactactgaaaatttctttgctgtgctcttgggcaataaaagtgcaattactggagggagtaagaaggttatagacagtaaaccaaatgaccacatatttatctattactcagatcacgggggtcctggagttcttggtatgccgaacttgccatatctctatgctggcgacttcatcaaggttttaaaaaataagcatgcttccaatagctacaagaaaatggtaatatatgttgaagcatgtgaaagtggcagtatctttgagggattaatgccgcaagacctaaatatttatgtcacaactgcagcaaatccagttgaaaatagttggggaacatactgccctgggatggacccatcaccccctcctgagtacattacctgtttaggtgatctgtacagtgtttcttggatggaagatagtcaaacccacaatctaatgaaggaaaccatcaaggatcagtatgaagtggtgaaaacaagaacctctaactcgaataagtacaaggagggttctcatgtcatggagtatggtgacaagaccttcaaggatgagaagcttttcctttatcaaggttttgatcctgctaatgccaacgttgcaaacacgctgctttggccaggcccaaagggtgcagtcaatcagagagatgctgatcttctcttcatgtg

SEQ ID NO: 10817 - protein, 356 aa, Panicum virgatum
  misc_feature: Ceres CLONE 1725889
  misc_feature (54)..(326): Pfam Name: Peptidase_C13 Pfam Description: Peptidase C13 family
  misc_feature: SWISSPROT Homolog: EC 3.4.22.34 Legumain
MALAAAAWLCGLVSLLAVAAAAADGDWEPLIRMPTEEGGDAAAAPAAEDEVGTRWAVLVAGSSGYGNYRHQADVCHAYQILRKGGVKEENIVVFMYDDIAHNILNPSPGIIINHPKGENVYTGVPKDYTGDQVTTENFFAVLLGNKSAITGGSKKVIDSKPNDHIFIYYSDHGGPGVLGMPNLPYLYAGDFIKVLKNKHASNSYKKMVIYVEACESGSIFEGLMPQDLNIYVTTAANPVENSWGTYCPGMDPSPPPEYITCLGDLYSVSWMEDSQTHNLMKETIKDQYEVVKTRTSNSNKYKEGSHVMEYGDKTFKDEKLFLYQGFDPANANVANTLLWPGPKGAVNQRDADLLFM

SEQ ID NO: 10818 - DNA, 572 bp, Panicum virgatum
  misc_feature: Ceres CLONE 1725889-R
  misc_feature: Encodes the peptide sequence at SEQ ID NO. 10819
aggagttaaatgggggatctgaagagaagctgaggactctcagagagattaaagaaactgttcagcacaggaagcatctcgacagcagcatcgatttcattgggagacttgtctttggatttgagaatgggcctaaaatgcttgaggccgttagagcctctggtgaaccattagttgatgactgggattgtttgaagaggatggtgaggattttcgaatcccagtgcgggtcgctcactcagtacggcatgaagtacatgagggcgtttgcgaacatttgcaacagcggtatatccgagacaaagatgagggagtcgagcatcagcgcttgcggcggttacaacccagcgaggtggagcccgttggctcagggacacagcgcctgatgaggtgcagcctgtagcaaaggtccccgaggtctctatcctgtgcgctgcgaactcctgtaacctggggactgtaaagcgagaaccactcatastgtgcgttgggtagtcasctgtatatatcatgtaccgtgcgttygtacctgygtgmactaataccaagtytggtctgcagccaactgcctg

SEQ ID NO: 10819 - protein, 127 aa, Panicum virgatum
  misc_feature: Ceres CLONE 1725889-R
  misc_feature: SWISSPROT Homolog: EC 3.4.22.34 Legumain
ELNGGSEEKLRTLREIKETVQHRKHLDSSIDFIGRLVFGFENGPKMLEAVRASGEPLVDDWDCLKRMVRIFESQCGSLTQYGMKYMRAFANICNSGISETKMRESSISACGGYNPARWSPLAQGHSA

SEQ ID NO: 10820 - DNA, 809 bp, Panicum virgatum
  misc_feature: Ceres CLONE 1725891
  misc_feature: Encodes the peptide sequence at SEQ ID NO. 10821
gtaggtgtggggggtataaaagaccggccggagcagagtgacacaaacgcatgcggttttttgtttattttgttaatctcctcatcagttcgtggggaagtctctggggatagccgccatgaaggacttcgcggggctagggcacctgttcgtggtgtccttcctcttctacttctcctccttcatggtgatcccggcgatcaccgacgtcaccatggaggccgtctgccccggccgcgacgagtgctccgtcgccatctacctcagcggcttccagaacgctgtcaccgggctgggggcgctcgtggtgacccccgtcgtcggcaacctgtcggacaggtacgggaggaaggcgctgctgacgctgccggtgaccgtggccatcttgccgctgtttattttggcgtgcaaccgctccgacttgtacttctacgggtattacgtggcaaacatcgtggccgggatcttctgcgggggcaacatgcattgcctctgccttgcctacgtggcggaccacgtggggcccaggcgtcgcgcggcggcgttcggtctcctctccggcgtgtcggcggccgggttcgtttcggggaccctgaccgcgcgcttcctcgccacctcttccaccttccaggtcgccgccgccgtcgctatagtggccgcgctttacctcagggttttcctacccgactccggcggcgtctcctgcagtgacgaagcctgcgatccgctcctccaggcttcatcctgcacctcctccacttcgtcttccgcttcatcttccgaacccgatggagacctctcgccgaggc

SEQ ID NO: 10821 - protein, 230 aa, Panicum virgatum
  misc_feature: Ceres CLONE 1725891
  misc_feature: Useful for making plants with modulated cold sensitivity
  misc_feature: Useful for making plants with modulated salt sensitivity
MKDFAGLGHLFVVSFLFYFSSFMVIPAITDVTMEAVCPGRDECSVAIYLSGFQNAVTGLGALVVTPVVGNLSDRYGRKALLTLPVTVAILPLFILACNRSDLYFYGYYVANIVAGIFCGGNMHCLCLAYVADHVGPRRRAAAFGLLSGVSAAGFVSGTLTARFLATSSTFQVAAAVAIVAALYLRVFLPDSGGVSCSDEACDPLLQASSCTSSTSSSASSSEPDGDLSPR

SEQ ID NO: 10822 - DNA, 277 bp, Panicum virgatum
  misc_feature: Ceres CLONE 1725891-R
atgacatagtatagtgtcgtctactaggtttttattccgtccatgtacatagatacaaaaggacaggatgaaagaagcgtaaccttgaagcaaaaaaagggctaggtatagtgacagaaactgctaggaaaacatggttccaggagaaggaatttatcatcccttgcaacaaggcactttatccttcattgaaaccgttgcatattgcaagctacaactgccacgccctcgagcaagttttgctgctggtagcacgaaactggaccacggcatcttt

SEQ ID NO: 10823 - DNA, 1836 bp, Panicum virgatum
  misc_feature: Ceres CLONE 1725896
  misc_feature: Encodes the peptide sequence at SEQ ID NO. 10824
atccagctgtccgcagtccaacgctacacatgccggcaagaaaccaaaatatcgagccaaggccgtcgtcatgtctccactcgccggcggcggcgccgatgacacggaggcgccgctcctcccctctccggcggccgggagggtgccatcatcaggtggcgccgcgccgcgccggaactggttcgcgttcctctgcgccgcgctcgcctccatgaccaccatgctccatggctacaatcagacgctgatgagcggcgcgcagctgtccatgcgggaggacgtgggcctcagcgacggtgaggtcgaggtgctggcggggtctatgaacgtgttcatgctcccgtccattctcgccgccgggtgggtcgccgaccggctgggccgccggcgcaccctcgtgctcgccaacgccttcctcatggccggctcgctctccatgtcgctcggcagcacctaccccgcgctcatggcggcgcgcttcgtcaccagcctcggcgctgggttcgcccgcgtcgtcgctccggtctacaacgccgagatctcgccggcgtccacgcgcggcgtcctctcgtcgctggtcgacattttcatcaacgtcggcatgctgctcagctacgtgtcgaactacgccttcgccggcctgccggtgcacctcgggtggcgcgtcatgttcgcgatgggcgtggtcccgccggtgttcatcgccgccggcgtgttcttcatgccggagtcgccgcggtggctggcgatgcgggggcgccacagcgacgcgcgcgcggtgctcgtgcgcacctcggacaccccggccgaggcggacctccggctcgcagagatcaagcaagccgtcgctgacgctgagacgactcagcagcagcaggctgccagccacggcggcggcggcagcgtctggacggagctcctccggccgtcgccgcgtgtgcggcggatcctcacgtgcgccatcgggctgcagttcttcgtgcaggcgtccggtgtcgacgccatcctcctctacagcccgctggtgttcaaggcggtcggcgtggcgtcggacagtgccgccatcggcggcaccgtggccatcggggcggtcaagacgtgcttcatcctggtgggcatgctcctcaccgaccgtgtcggccggcgcccgctcctcctcgccagcaccgctggcgtcgcggcgaccacggcctccctcgccctgacgctccgcctagcctccggcggcggtgcggccccggcagcggtggcggcgtgcctcgcgtcggtgctggccgtcgtggccacatactcggttgggtacgggtcagtggtgaacacgtacagcgccgagatcctgccgctgcggctgcgcgcgcagggctcgggcctcggcgtggccgtgaaccggctcacctgcgggctggtgggcatgacattcatctcgctcgccggcgggatcaccatggccgggtgcttcttcttgtacgccggggtcacggcggcggctttcgtgttcgtctacgcgctgctgccggagacgagggggcggaccctggaggacatgggcgtgctcttcgacaagtgaagtgagagggcacacgcgcacatacatacttaattatcatcaatttgcctgctagattgttcgataataatgagtgattacatgttcccctttctttctaataaaatttactgtaaagctcttgccacccttctacacgatcgaagtacacagtaaatcatttttgtagttggggtgttaaagaaacagggacagcaatcactgggcctctgtttctaaactagcttttgcatgttgaggagagaagcccaaacatggaatggttcttc

SEQ ID NO: 10824 - protein, 498 aa, Panicum virgatum
  misc_feature: Ceres CLONE 1725896
  misc_feature (42)..(496): Pfam Name: Sugar_tr Pfam Description: Sugar (and other) transporter
MSPLAGGGADDTEAPLLPSPAAGRVPSSGGAAPRRNWFAFLCAALASMTTMLHGYNQTLMSGAQLSMREDVGLSDGEVEVLAGSMNVFMLPSILAAGWVADRLGRRRTLVLANAFLMAGSLSMSLGSTYPALMAARFVTSLGAGFARVVAPVYNAEISPASTRGVLSSLVDIFINVGMLLSYVSNYAFAGLPVHLGWRVMFAMGVVPPVFIAAGVFFMPESPRWLAMRGRHSDARAVLVRTSDTPAEADLRLAEIKQAVADAETTQQQQAASHGGGGSVWTELLRPSPRVRRILTCAIGLQFFVQASGVDAILLYSPLVFKAVGVASDSAAIGGTVAIGAVKTCFILVGMLLTDRVGRRPLLLASTAGVAATTASLALTLRLASGGGAAPAAVAACLASVLAVVATYSVGYGSVVNTYSAEILPLRLRAQGSGLGVAVNRLTCGLVGMTFISLAGGITMAGCFFLYAGVTAAAFVFVYALLPETRGRTLEDMGVLFDK

SEQ ID NO: 10825 - DNA, 770 bp, Panicum virgatum
  misc_feature: Ceres CLONE 1725898
  misc_feature: Encodes the peptide sequence at SEQ ID NO. 10826
agctgctccaggagctgaaaatgaaaaggctagcattgtaaatcaacagaagttagaaaagaaatttggccagtcttcagtttttgttgcttcgacacttcttgagtatggtggtatcctgaagagtgccagtccagcttctcttctaaaagaagctatacatgtcatcggttgtggctatgaggataagacagactgggggaaagatattggttggatttatggatcagtcacagaagatattcttactgggtttaaaatgcactgccatggttggcggtcaatttactgcatacctaaacgggctgccttcaaaggttccgcacctctcaatctttctgatcgtcttcaccaggttcttcggtgggctcttggttcgattgaaattttcttcagcaaccattgccctctttggtatggatatggcggtggactaaaatttctggaaaggttttcctacattaactccatcgtatacccttggacgtccatcccgctcttggcctattgcacattgcctgctatctgcttgctgacagggaaatttattacgccagagcttggcaatgttgccagcctctggttcatgtcactttttatctgcatttttgctacgggtatcctggaaatgagatggagtggtgtaggcatcgatgattggtggagaaatgagcagttttgagttattggaggtgtgtcttcacatctctttgccgtgttccaaggacttctcaaggtcatagctggtatagatacgagcttcactgtga

SEQ ID NO: 10826 - protein, 226 aa, Panicum virgatum
  misc_feature: Ceres CLONE 1725898
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Useful for making plants with modulated biomass
  misc_feature: Useful for making plants with altered cell wall content and/or composition
  misc_feature: The sequence is a functional homolog of SEQ ID NO 6 in US patent 7285702
  misc_feature: Useful for making plants with altered carbohydrate content
  misc_feature: The sequence is a functional homolog of SEQ ID NO 2 in US patent 7049481
  misc_feature: Useful for making plants with modulated plant growth and development
AAPGAENEKASIVNQQKLEKKFGQSSVFVASTLLEYGGILKSASPASLLKEAIHVIGCGYEDKTDWGKDIGWIYGSVTEDILTGFKMHCHGWRSIYCIPKRAAFKGSAPLNLSDRLHQVLRWALGSIEIFFSNHCPLWYGYGGGLKFLERFSYINSIVYPWTSIPLLAYCTLPAICLLTGKFITPELGNVASLWFMSLFICIFATGILEMRWSGVGIDDWWRNEQF

SEQ ID NO: 10827 - DNA, 517 bp, Panicum virgatum
  misc_feature: Ceres CLONE 1725898-R
ctctgtagatagaaacacggaaaaaaagtctttgcattccttttgttctatggtggtagctcagcctcatgactgcaatattgggcaaacgggaggctgcgacaaccttgtgcagttcggccacgaatatagagagaccaaatgcctgagtttgattgttcagcattctttattagttttggtggatacttatcggtgagccgaacagaaagttgtttgagtatgaactgctctacatctgcaaagttgtttctcaataaggcaggaatagatctgccgtctggaatagaggaagatgcacattatttatgtagtgatgagtatacctttgcctgcccatttgaagggcctgtgcataccttcctccccctctctggtgcaattctccttgctaggacagaaactttgattagtgtctagtaatgtagcgcgtccagtgatgtaatctgtaaatgtgccattttgtcggtcaactgcgtaaagaatcaatcgttgctattgacttggttttttgttc

SEQ ID NO: 10828 - DNA, 1945 bp, Panicum virgatum
  misc_feature: Ceres CLONE 1725904
  misc_feature: Encodes the peptide sequence at SEQ ID NO. 10829
atcgcgcgcgtcgccacaggagggagagagcaacagcgacaggggagccagcgagccgcgggggcgcagcggaccgggtaaaagcgccgggcctcggccgcctgctccgccttctcttcccttcccttcccttccccccctctccacccagtcggcctgtcctcagccaggcggcgtcggcgcgccgacggtgacagggcggagcgctggggcgccaccgcgggggaggagcagaaaaagaggagacaaggagcccagagcttcggctgtccgcgcttttgctgcctgcggggccgacggctccccgcctctccgtccaccagcctgtggcgaccgaataggcggacgtcgtcctcgtcctctctccgcaacaaggagtataaattggaactggtttcggatacacgtctggaggaagcgttggaatttcgaccatggggagttcggtcggctgcttggaaggtggctccaagtctaggcaagatcagaatggtcaggccgccgcatctaggtctcctcgttcaggtcgtgtattatcaagagctggaaataatgtacaagtcttctctctaaacgcgttgaagactgccacacgaaactttcacatgctgaattgcgttggccgtggaggttttggagcagtgtataagggaaacctgaaagatggcactcaagtcgcaataaaaaagctttcagctgagtcaaaacaaggaattagcgaattcttgacagagattaatgtcatatcaaatgtcaggcacccaaaccttgtcaagctacttggttgctgtgttgaaggaaaaaacagattgttggtgtatgagtatgcggagaataacagtttggcaaatgctttgcttggacgaaagaataaatgtattccattggactggcagaaaagggctgctatctgtattggaactgctgctggtcttgcatttcttcatgaggaagcgcaaccacgcattgtccaccgtgatatcaaggctagcaacattttacttgataaaaagcttctgcctaaaattggagattttggactggccaagctttttcctgatactatcactcacattagcacgcgtgttgcaggaacaatgggctatttagcacctgagtatgccttattgggacaattaaccaagaaagcggacatatatagttttggggtgcttcttcttgaagttataagcagtcaaagcagcagcaagtcaacttgggggcctgatatgcatgtccttgtggaatggacatggaaactgcgggaagaagaaaggctcttggaaattgttgatccagatctggacaagtacccagaggagcaaatgctccgtttcatcaaggttgcactgctgtgtacacaagccacgtctcagcaaaggccatccatgaagcaggttgtcaatatgttatctaaccaaatggagatcaatctgcaaaatttggttccaccaggtgtgctgaaagaaccacgcccgcgtaccggaggctttgggagtttggcagtagacacatcctcaagccaaagcaccaaatgcaatccagctgaatcttacagtacacagacgaacatcaatagtggtcagtttagcacaactgaggtatcaccaaggtgatgtaatggactgtcaaccagcaagtttgtatagcattttcagaggtttgaaccatcaatgaggttttactgtgctgaaaggcctgatccatttttatcctgatttagaactacgtaggatgcgagggccgttgtgaattgctgatgtacaggaactgtagtttttccccccctttttgcggaggaattgtagttcaatttaacaattgcattctgtttcattaaagccccgttgtagggatacaatgcaaagagtgcgagaggagtgcattgtagactgcaaaaattgcactcagcaagaaagttgtgaagaagagttactctttttcg

SEQ ID NO: 10829 - protein, 393 aa, Panicum virgatum
  misc_feature: Ceres CLONE 1725904
  misc_feature (56)..(326): Pfam Name: Pkinase Pfam Description: Protein kinase domain
  misc_feature: SWISSPROT Homolog: EC 2.7.11.1 Non-specific serine/threonine protein kinase
MGSSVGCLEGGSKSRQDQNGQAAASRSPRSGRVLSRAGNNVQVFSLNALKTATRNFHMLNCVGRGGFGAVYKGNLKDGTQVAIKKLSAESKQGISEFLTEINVISNVRHPNLVKLLGCCVEGKNRLLVYEYAENNSLANALLGRKNKCIPLDWQKRAAICIGTAAGLAFLHEEAQPRIVHRDIKASNILLDKKLLPKIGDFGLAKLFPDTITHISTRVAGTMGYLAPEYALLGQLTKKADIYSFGVLLLEVISSQSSSKSTWGPDMHVLVEWTWKLREEERLLEIVDPDLDKYPEEQMLRFIKVALLCTQATSQQRPSMKQVVNMLSNQMEINLQNLVPPGVLKEPRPRTGGFGSLAVDTSSSQSTKCNPAESYSTQTNINSGQFSTTEVSPR

SEQ ID NO: 10830 - DNA, 944 bp, Panicum virgatum
  misc_feature: Ceres CLONE 1725907
  misc_feature: Encodes the peptide sequence at SEQ ID NO. 10831
acaggtgcgcaactgctgtgctgtggtgtggtggcctcctctgcatcggcggcgcgattcacaccggcgatccttccccatccccagcggcgcaggccaaacgaggcggccaggagatggcgctcacaagaattggtcttgctggccttgctgtcatggggcagaaccttgccctcaacatcgcagagaaaggattccccatctccgtctacaacaggacgacctccaaggttgatgagactgtgcaacgtgccaaggcagaaggaaaccttcccctttatggtttccatgaccctgcatcttttgtgaactccattcagaagccacgcgttgtcatcatgcttgtcaaggctggtgcaccagttgaccagaccattgcaacactcgctgctcacttggagcagggtgactgtatcattgatggaggaaacgagtggtatgagaacacagagaggagggagaaggccatggcggagcgtggcctcctctatcttggcatgggtgtatctggaggagaggagggtgcccgcaacggcccgtccttgatgcctggaggctcatttgaggcgtacaagtacattgaggatattcttctcaaggtggctgctcaggtccctgacagtggcccgtgtgtcacatatattggcaaaggtggatctggcaactttgtcaagatggttcacaatgggatcgaatatggtgatatgcagctgattgctgaggcatacgatgtcctcaagtcagtcggcaagctcactaacagtgagctgcaccaggtgttctctgaatggaaacagggagagctccctcagttcttgatcgagatcactgcggacatatttggcatcaaggatgaccagggtgatggctacttggtcgacaaagtcctggacaagactgggatgaaagaacccgggaaatggacagtgcagcaggctgctgaa

SEQ ID NO: 10831 - protein, 275 aa, Panicum virgatum
  misc_feature: Ceres CLONE 1725907
  misc_feature (3)..(178): Pfam Name: NAD_binding_2 Pfam Description: NAD binding domain of 6-phosphogluconate dehydrogenase
  misc_feature (182)..(275): Pfam Name: 6PGD Pfam Description: 6-phosphogluconate dehydrogenase, C-terminal domain
  misc_feature: SWISSPROT Homolog: EC 1.1.1.44 Phosphogluconate dehydrogenase (decarboxylating)
MALTRIGLAGLAVMGQNLALNIAEKGFPISVYNRTTSKVDETVQRAKAEGNLPLYGFHDPASFVNSIQKPRVVIMLVKAGAPVDQTIATLAAHLEQGDCIIDGGNEWYENTERREKAMAERGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLTNSELHQVFSEWKQGELPQFLIEITADIFGIKDDQGDGYLVDKVLDKTGMKEPGKWTVQQAA

SEQ ID NO: 10832 - DNA, 385 bp, Panicum virgatum
  misc_feature: Ceres CLONE 1725907-R
attacttcggagctcacaccctcccagaggggtcgatacgccaggttctttccacaccgagtggttcaagatcgcgcgcagcaactcccagaactgagctgctccagaggtggcatgccatggcacgatattgacatggttgtcatatttttcattatcgttaatcgctgtgcggccgttgagtaatcggtaatgtaggggagctgctgtggttaaatttgatttttcaggcacggtgcttaatttaagtcaggaagttgctgttgttgtcttcaatcctttccgtgtataagcggtctgggatggagaacaatggtgtacttcttggaacttccatgttgatgtttgtaagtttgatctatgaataaataagagcatttttgtc

SEQ ID NO: 10833 - DNA, 546 bp, Panicum virgatum
  misc_feature: Ceres CLONE 1725916-R
  misc_feature: Encodes the peptide sequence at SEQ ID NO. 10834
cccgtgggcgcggcggccgcggggacgtcggagctgatccggcgcaacctggcggagcacatggcgatgacgctgacgagggaccccagcttcaaggcggccctcgtcagcgcgctgtccggccggatcctcgagctctcgcccaccaaggaataacaaccggggaaaagggaaacgtatcccaataccatcacacgagcttcttcttggttgctcagatttcctcgcagccatggccaaccgggcttggccttcctctgctcactgttctagcaaaacagcaagatcactggtggacgtgaggatctgcagttcggcatcagtatcaaaacgactgaagagtctgcgccgcgcatccggacatggcgcggaccgaagatcaccacggcgggtgatctgacctgaacctgattgaccggcgatggtcgagtttattagcagatcgaaaatagcacaggaaacaacatcaaactgtacaatccttgtaggcaaattattgttcgcccatttttccttgataaaatgaaatcgttatatttttctccg

SEQ ID NO: 10834 - protein, 51 aa, Panicum virgatum
  misc_feature: Ceres CLONE 1725916-R
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
  misc_feature: The sequence is a functional homolog of SEQ ID NO 1388 in the 11/479,226 US patent application
  misc_feature: The sequence is a functional homolog of SEQ ID NO 1824 in the 10/412,699 US patent application
  misc_feature: The sequence is a functional homolog of SEQ ID NO 2068 in the 10/374,780 US patent application
  misc_feature: The sequence is a functional homolog of SEQ ID NO 652 in the 10/412,699 US patent application
  misc_feature: The sequence is a functional homolog of SEQ ID NO 942 in the 10/225,066 US patent application
PVGAAAAGTSELIRRNLAEHMAMTLTRDPSFKAALVSALSGRILELSPTKE

SEQ ID NO: 10835 - DNA, 518 bp, Panicum virgatum
  misc_feature: Ceres CLONE 1725916
tcgaggaggacgacacagcagcgtccgtggcgacacccaggtccatcctgtacaacgcctggattccctcctgctccgagcgtgtccgcatccctgtcaaccacaaaggtaaattactacgacctctatactacttcggagtctggctgagtacttacggcctagccgaccatcttatccactaataattctcagtagcatcatgcgcaacaaggggaatctacgtcaaactactcttatccttcagtacaagctggactcccaagctttgcaataagcaggttcacagttacctctgttccgtcaaatccagaaccttcttcagaaaggggcgactgcacatgctagcagtcatgtgttctcttgatctagatcaatttcaaaaattgcgaataggtgaataaatttggcacgcccagtgattttttgtgatgatatccttgggcagtactgtttactgacgggatcagaccggcttactgcatttttacagttgctcaagtgctcccactatgcac

SEQ ID NO: 10836 - DNA, 485 bp, Panicum virgatum
  misc_feature: Ceres CLONE 1725933-R
  misc_feature: Encodes the peptide sequence at SEQ ID NO. 10837
caggatccagtgaccaatgtgtctatatttatgatgtggcgacaggtaaggttgttgaaaaactgagatggcacgggtcgatcatcagagactgctcatggcacccgtacctccccacacttgtcagctcttcttgggacggctatttggtccggtgggaggcaacagaggatggcagagacccctccatgctcaagacatggaagcagaggatgcatccagaaggatacacagtgtcgtttgtcctttagaagtgaagctctcaagggtctcatgtgggcatgtggctccacttgatccccttgcaggcttcccaagcctctggctcgaaaaagtccttttactatttaaaatttcgtgctgtatataagtgatcgagagtgaattgttgaggcggttcgcaggtcgagtgaattgttgaggcggtacatagactcgcaaaattgtaatgcaaaagtttatctatctatactatatcttatctt

SEQ ID NO: 10837 - protein, 82 aa, Panicum virgatum
  misc_feature: Ceres CLONE 1725933-R
  misc_feature (15)..(53): Pfam Name: WD40 Pfam Description: WD domain, G-beta repeat
GSSDQCVYIYDVATGKVVEKLRWHGSIIRDCSWHPYLPTLVSSSWDGYLVRWEATEDGRDPSMLKTWKQRMHPEGYTVSFVL

SEQ ID NO: 10838 - DNA, 608 bp, Panicum virgatum
  misc_feature: Ceres CLONE 1725933
attgacgcctccgccgagctttcgtaaccacttcctcctcgtcctcctctgctcttgttcatcgtcgtcgttcttactattccccaccccttgcctcgcggcgcggttgtggggttcgattttgggaagggaaggaaacggggcgggcgcgggagtcagttctcttccagcgacgttttcatcgcggttaattaaggggatgactgacagtagaagggtccaagcctcaggctatcaattgtactgtcctggttggaattgcctggacagctggattgcaagtctgtgtccacgttaaagtcttcttgtggaggataccatactgctatatcgaccgaattgttccttgaagcttaggtaatataaggcaatgggatgttcaatggttattctgagaaatgaccaatggtttactaactagtgttcattaattgagtggccaaacatgcggtggaaacgaaagatacatcatggaggaccatctgaacaacaacaggtcagtccacttgtggatgaagtatgtgccattgacgaggaggtttcccatctttgtagaattaaatctgaaccaagtcagagaactcgtgcatccatttatgctggccaga

SEQ ID NO: 10839 - DNA, 1882 bp, Panicum virgatum
  misc_feature: Ceres CLONE 1725934
  misc_feature: Encodes the peptide sequence at SEQ ID NO. 10840
accggttaaccggagtagcagcacatcaccgcgcccgatccaaccgcgtgcccgtccgcccgtatcaatctcgcccaaatctttcatttcacggctcgacgcctcccatcccatcccatccatgttcgcctgcaggtctctgctcgcaagggctagtcagcttactcggcctctaattccatgcgccgccggtccgccgcttcgttacttccaccagggatcagtaggtcaaaataagttggcctcatttgtgatggaaggggcacatggaggatcaggtaatctggcaaaacacaagaaaagaaagtcaccggtgcagaaatggagaccaatctcaactgaagcagttccccagaaagatgatgttaatgagacatcaagttctggaagcagacaagttgtagaagattgcataacttctagtgataatttggtgttggacggagctaataatgttgttattgaagttaccaccaacaatgcatcattgtcaaaaaataatttaagtttggactccagttcaactaaagtagttatagaagacaatttggaggtatcaggctttaataaggatcttgatgggtccaatttctctgagacatattcctcctctattcaggtagatgttcctttgatgcactttgtgaagggaaaaggtgggtctatgcagaagaagattgaagaggatactggagtgaaaattatcttcccatcatcaagggatgagacttctgttgtcctcgaaggtacaagttctgaaagtattagaaaagcatcgcagatgattgcaaatgttcttgaagaggctgtccaaagtcggatgctggactactcccatttcatatcacttccattggctatccaccccgatcttattgacaagctcaactacttccagagctcaatacttgggtcttctgcttctaatgaagaaagtgataaagataagagccgaagtgaaggttctattgatgaaatggatcatgaccacaagcaaggagatagctcaagtgtttccatcaatcttcaagttcaagaaaagtctgttgaagtgaacattcatagtaaaggctcccgatcagattttggcattgacaagtcaatatttatcaaacccaaaacatttcaccttactgttgttatgttgaagttgtggaacaaggatcgcatagctaaggcttcggatgtgctccagtcgatatctatccaagtaaatgaagctttggaaaaccgacctatctccatacagcttagaggtctgacatgcatgaaaggctctccagctaaggcccgggttgtatatgctccagtgttggaagttggtggggaaggacgcctagcacgtgcttgcaaagtcataattgatgcttttgtcaagtcaggtctagttctcgaaagggatgcgagacaagaattgaagttgcacgcaaccataatgaacgtgcggcacagaaagagcaagaaacggaaccagtggaacgattcttttgacgcccgggatatattcaggaaatacgggaaagaggagtggggcgaataccgcattcctgaggtccacctttcacaaagattcaaatttgacgaaagcgggtactaccattgctgctcgtcaatccccttgcctgcggagatgcgggcagagtgaggcctgcagttcagcctgttgttgtaaaagtacacactaaattgtaggaatccctgataaggtcctctttttttttttactttgttataaggcaatggccatgtaggaccttagttttggtggatttactgttttgaatcctggcatggtagtgggggtcgctcctacctgtagagggaggtggtggatctgtcatctgttgggtgtttgttgacattgtttttgatgtggcccatc

SEQ ID NO: 10840 - protein, 507 aa, Panicum virgatum
  misc_feature: Ceres CLONE 1725934
  misc_feature (162)..(222): Pfam Name: KH_1 Pfam Description: KH domain
MFACRSLLARASQLTRPLIPCAAGPPLRYFHQGSVGQNKLASFVMEGAHGGSGNLAKHKKRKSPVQKWRPISTEAVPQKDDVNETSSSGSRQVVEDCITSSDNLVLDGANNVVIEVTTNNASLSKNNLSLDSSSTKVVIEDNLEVSGFNKDLDGSNFSETYSSSIQVDVPLMHFVKGKGGSMQKKIEEDTGVKIIFPSSRDETSVVLEGTSSESIRKASQMIANVLEEAVQSRMLDYSHFISLPLAIHPDLIDKLNYFQSSILGSSASNEESDKDKSRSEGSIDEMDHDHKQGDSSSVSINLQVQEKSVEVNIHSKGSRSDFGIDKSIFIKPKTFHLTVVMLKLWNKDRIAKASDVLQSISIQVNEALENRPISIQLRGLTCMKGSPAKARVVYAPVLEVGGEGRLARACKVIIDAFVKSGLVLERDARQELKLHATIMNVRHRKSKKRNQWNDSFDARDIFRKYGKEEWGEYRIPEVHLSQRFKFDESGYYHCCSSIPLPAEMRAE

SEQ ID NO: 10841 - DNA, 748 bp, Panicum virgatum
  misc_feature: Ceres CLONE 1725939
  misc_feature: Encodes the peptide sequence at SEQ ID NO. 10842
acccagcagttcctccaccaccaggcaccagcccacctcctccccgcgtccgctcgccgcccttgctcctcctcttcgcgtccgcgtcgtcgtcgtgctcgcccgccgccgccgcgtcggcctccgggcccagaggttgtagtgctgtcaggatggacagcggtgcagtggaatccactggggcagtatggtcaacaccttcggcagaaccgagaaacatttctatcgggaaggagatattctgcaataggtcactcaacatgaggaacatcacagcagtaggatttgatatggactacactcttgcacagtacaagcccgagaccttcgaggcccttgcttactatggtacaatcgagaagcttgtgaaggatctgcactaccctgaagagctgctgacttgggagtttgattggaaatacatggtcagaggattagttcttgataagaagagaggaaatattttgaagatggaccgacacaagtatgtaaaagttgcataccatggttttagggaattgtcgaaagaagaaaaagttgctgcttatgggagtacattgataagagactcatttgatgaacctgattatgcccttatagatacgcttttctcattgggtgaagcttatctatttgctcagcttgttgatttcatggacagtaatcctggaaaagtacctgcaggcacagactatccgcttatgtataaagatgtgaggtctgcagttgacttgtgtcatcgtgatgg

SEQ ID NO: 10842 - protein, 248 aa, Panicum virgatum
  misc_feature: Ceres CLONE 1725939
  misc_feature: SWISSPROT Homolog: EC 3.1.3.5 5'-nucleotidase
PAVPPPPGTSPPPPRVRSPPLLLLFASASSSCSPAAAASASGPRGCSAVRMDSGAVESTGAVWSTPSAEPRNISIGKEIFCNRSLNMRNITAVGFDMDYTLAQYKPETFEALAYYGTIEKLVKDLHYPEELLTWEFDWKYMVRGLVLDKKRGNILKMDRHKYVKVAYHGFRELSKEEKVAAYGSTLIRDSFDEPDYALIDTLFSLGEAYLFAQLVDFMDSNPGKVPAGTDYPLMYKDVRSAVDLCHRD

SEQ ID NO: 10843 - DNA, 312 bp, Panicum virgatum
  misc_feature: Ceres CLONE 1725939-R
taggtttgtattcccccaacaagtactattgcccgagtgaagattacatgccccatgagttagatgtccttgagctgtaggagcactccctagttcaaagctccccgttgtaattgaaccacagcagtgtaggagggtgattttagctgtggcattgattaacatgtgtagttgccgtatttatcgaggcgaaagattccactcattggacatgttataaccgagtattatgggtcaggtatagtaactatagtttcagatagagcaatacatttaccggtatattttttgtacataacaagttctaagcag

SEQ ID NO: 10844 - DNA, 456 bp, Panicum virgatum
  misc_feature: Ceres CLONE 1725941
  misc_feature: Encodes the peptide sequence at SEQ ID NO. 10845
agagatcgatacctcctctcctcgagcgcacccaccaccccctttccataacgcgcggaggatggagaggtttcaaaacgatcagacacgctgctcctctggttgcttcttcccccaagctcaaatgcgatcctgccttgcctctagcgggcgggtgggcaggctaggcacgcatcccgatgctacagctactccgcttcctgctcaccgcctccgccgcctctggcccggcagcggcacagggccgccctccgctccccataggcgtgaaccactgacccaacgccgacgaacacccgtccccggccgccgtggccacattccacgacaccaagagacccgtcaaccgcgtccgactcttcgacgccaacccggccttcctacaccccctcgccgccaacacccccgccaactgcatcgccgagtccatcaccaactccgctctcccggccttcg

SEQ ID NO: 10845 - protein, 32 aa, Panicum virgatum
  misc_feature: Ceres CLONE 1725941
  misc_feature: Useful for making plants with altered carbohydrate content
MLQLLRFLLTASAASGPAAAQGRPPLPIGVNH

SEQ ID NO: 10846 - DNA, 608 bp, Panicum virgatum
  misc_feature: Ceres CLONE 1725941-R
acgcacgagtcctcggcgcgaccgtgaactcgagacggaggccaagagcagcgcctcttcgaggagccgctcggcgatctgctccgactccgacaacgatggtgtcaacgacgacggagggacggacagcgacaacgacgggaaccaaggcaacgacaacgaagacgaggaggaggacgagcgcgacgctgagagtaacgggcagagcccgcctcacggcggcgtgtcggcccgcgagctggagcggaggctgcacgagctcctgcagtcgcggcacgaggcgcggatcgcggagctggagtcggcgctggagcgcgcgcggcggaagctccgggagacggagcgcgaggcgtgccggtggcgcgacaccgccaagctcgccacccgcttcacggacgaggcgcggctcagatagaagaatggcaggaagaacctgccccccatcgcgcacggatgcatctgctaattttgcggtcctcaacctcaccgatccgatcccatgatgtcgcttctctcgttgcctgtaccagttcacaacgcatctcgcgagaaactcactatcgatctgatcacgcatgagcatgaaccgagatgaaacttccttcacc

SEQ ID NO: 10847 - DNA, 876 bp, Panicum virgatum
  misc_feature: Ceres CLONE 1725950
  misc_feature: Encodes the peptide sequence at SEQ ID NO. 10848
gaaaccctccctcgccgtcctcccttccttgcctaggcggcaacgccccccgtgctttataacggagcggcccctcccgcgtgaggcaccgaggcgcgagaccggcagaggcagaggcaggcaggcaggggggagcagcagcccgtccgagccccttcctcctccgggttcgcgtgaggccgcgtgccaccgccgccgggaggagggcgaggcgagatggaggcggagaagaagccgccggcggtgtccgacgttggcgcctgggcgatgaacgttgtcagctccgtcggcatcatcatggccaacaagcagctcatgtcctcgtccggctacgccttcgccttcgccaccacgctgaccgggttccacttcaccgtcacggcgctcgtcgggtggatctccaacgccacgggctactccgtctccaagcacgtcccgctctgggagctcgtctggttctcgctcgtcgccaacacctccatcaccgggatgaacctcagcctcatgctcaactccgtcggcttctaccagatctccaaactgagcatgattccggtggtctgcctcatggaatgggtgctgaacagcaagcactacaccaccaaggttatttccgcggtggtcgttgtggcggccggcgtcgggatttgcacggtcacggatgtcgaggtcaatgccaagggattcccttgcgcgtgtgtggctgttgtctgcacgtcgctgcagcagattaccattggctcctttcagaagaagtacaacattgggtcatttgagctgctgagcaaaactgcaccaattcaagcaatttcacttattatactgggcccctttgtgggatactacctcaatgggcgatcattgtttgaactacat

SEQ ID NO: 10848 - protein, 219 aa, Panicum virgatum
  misc_feature: Ceres CLONE 1725950
  misc_feature: Useful for making plants with altered cell wall content and/or composition
MEAEKKPPAVSDVGAWAMNVVSSVGIIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFPCACVAVVCTSLQQITIGSFQKKYNIGSFELLSKTAPIQAISLIILGPFVGYYLNGRSLFEL

SEQ ID NO: 10849 - DNA, 194 bp, Panicum virgatum
  misc_feature: Ceres CLONE 1725950-R
aattgcccaccccccaccccccggtttcgacgtagatgatgatgagaacaacactatggcagacagtttgtttagggattgtcaggcgaggggtggtggtgtggtggagccattgtcaatcccgtggtggcgttcgtgttgttatagatgaagacaaagactcgtataatggaatacaggtgtttctccgtggt

SEQ ID NO: 10850 - DNA, 883 bp, Panicum virgatum
  misc_feature: Ceres CLONE 1725951
  misc_feature: Encodes the peptide sequence at SEQ ID NO. 10851
ttacgtcatccaacaaaagttcacgaaaagaatgtggttaagtgtcaaccatgacttcaatgagacagagttattgaggagagccatcactgaagctggggcagaccatgcaacaggagatgcaaagacaacacttgaacggatcctcaaggaagctgtgaatggacacaaaaccttgctggtcatggatgatgtttgggaccaccatgcttgggaggatgtgctcaaaactccattgttcaacgtcctagatcgaggcagccgtgttctcgtaactacaagacatgaaacagtcgctcgaggaatgaaggctgtggagccctaccaccgtgtcgacaaattagagcgggaagatgcctggtctttgctcaagaagcaggtagttggagatgaaaatgatgaacataagattgatatgctgaaggacattggaatgggaattatagacaaatgtgatggtttaccgcttgctgtcaaagtaatgggaggactcctgtgtcaaaaaagggcaagacgaagtgattgggaaaatgttctgaatgattctgtatggtcagtatctcaaatgccagaagagctgaacagtgcaatataccttagctaccaacatttgcaacctagcttgaaggcttgctttctgcactactccctcctcccaaagggcacggtgttattcgttcatgacattgttggcatgtggattggtgaaggatttgttcatggaaactcacgtgaattggaagtaacaggaaaagagtactatgatgagttaatactgaggaaccttatagagcctgatataaattatgttgatcagctggcttgcaatatgcatgatgttgtccgctcatttgctcaatatgtggccagatatgaaacatta

SEQ ID NO: 10851 - protein, 293 aa, Panicum virgatum
  misc_feature: Ceres CLONE 1725951
  misc_feature (1)..(244): Pfam Name: NB-ARC Pfam Description: NB-ARC domain
YVIQQKFTKRMWLSVNHDFNETELLRRAITEAGADHATGDAKTTLERILKEAVNGHKTLLVMDDVWDHHAWEDVLKTPLFNVLDRGSRVLVTTRHETVARGMKAVEPYHRVDKLEREDAWSLLKKQVVGDENDEHKIDMLKDIGMGIIDKCDGLPLAVKVMGGLLCQKRARRSDWENVLNDSVWSVSQMPEELNSAIYLSYQHLQPSLKACFLHYSLLPKGTVLFVHDIVGMWIGEGFVHGNSRELEVTGKEYYDELILRNLIEPDINYVDQLACNMHDVVRSFAQYVARYET

SEQ ID NO: 10852 - DNA, 371 bp, Panicum virgatum
  misc_feature: Ceres CLONE 1725951-R
cccgatttccttcccgcgtaacatgtcccgttgaagatgagtgtccattggaggacatgcatctggggacaaacgtcagccctctgcctaaggttcaggcgcagtgcctacggctgctttgttctcttgttgcgtcgagggtgcttgcactgaaaggaagccaaccacatcacctcctcgttagatcaattcatccaaggaagggacccgtgtgttcagcgtgtaaaataattttttcaggggcagatacaggaggcagcagcaaccaaacggaacatcaaggggtgtagtgtcatagtggattagggcctttgggatgaactgcatttgtgctgccattaactttatgaaatctctattcctttcactcc

SEQ ID NO: 10853 - DNA, 833 bp, Panicum virgatum
  misc_feature: Ceres CLONE 1725952
  misc_feature: Encodes the peptide sequence at SEQ ID NO. 10854
gcatgaggattgtacttaatcctattagttcccttgtagatctccccttaaagaacttctacagatttgttcttccatcaatggatgattttagcaatacagattattctgtacatgggcctaaagctttcttcgcaaatatgccactttcaaaaactcttacaatgaacatagatgttccagaaccatggcttgttgaaccagttgttgccatccatgatttagacaacattcttctagagaatctcggtgatgttagaactttgcaggcagtatttgaacttgaagctctcctcttgacaggccactgcatggaaaaagaccgagaccctccccgtggtctgcagtttatccttggtacaaaacaaagaccacacatggtagacacacttgtcatggccaacttgggttactggcagatgaaagtctcccctggtgtgtggtacctacaattggctcctggccgtagtgccgatctatatgagctacctccaaaactcattgccattgatagcttgagaggcaaactaatgcacattgaagtgcaaaagaagaaaggcaaggagcgtgaggagttactaaatgctgcggatgactaccactttcaggaaaacatggctaacaaaggctggaataacaatattctgaaatgggcttctagtctcattagtggtgatacatcatcaaaaaataaagctgataaaatcaccgaccgaaaggatggaagacacggggagactataaacattttctctgttgcttctgggcatctgtatgagcgtttcctcaaaatatgattttgagtgttctgaagaagacgcagaggcctgtga

SEQ ID NO: 10854 - protein, 264 aa, Panicum virgatum
  misc_feature: Ceres CLONE 1725952
  misc_feature (1)..(134): Pfam Name: UDP-g_GGTase Pfam Description: UDP-glucose:Glycoprotein Glucosyltransferase
MRIVLNPISSLVDLPLKNFYRFVLPSMDDFSNTDYSVHGPKAFFANMPLSKTLTMNIDVPEPWLVEPVVAIHDLDNILLENLGDVRTLQAVFELEALLLTGHCMEKDRDPPRGLQFILGTKQRPHMVDTLVMANLGYWQMKVSPGVWYLQLAPGRSADLYELPPKLIAIDSLRGKLMHIEVQKKKGKEREELLNAADDYHFQENMANKGWNNNILKWASSLISGDTSSKNKADKITDRKDGRHGETINIFSVASGHLYERFLKI

SEQ ID NO: 10855 - DNA, 809 bp, Panicum virgatum
  misc_feature: Ceres CLONE 1725953
  misc_feature: Encodes the peptide sequence at SEQ ID NO. 10856
atctcctctcctctccctctccctctcccctccctccctctccgtgcgctcgagcgcattcccgttctccgcggtagaggaaccctaacgctccccggatcccgcggcggagtgcaatggccgcgccggcgttcctgcccgagctggccacgcaggtggtggtgcccgtcgcggccgtggtgggcatcgccttcgcggtgctgcagtgggtgctggtctccaaggtgaagctctcccccgacccgcggcgcggggacgggtcctccccgaagagcggcgccggcgccagcgagtacctcatcgaggaggaggaggggctcaacgagcacaacgtcgttgtcaagtgcgccgagatccagaacgccatctccgaaggagcaacttctttccttttcactgaatataagtatgttggactattcatgggtatttttgctgtcctgatcttcctcttccttggctctgttgaggggttcagtaccaagagtcagccttgccactacagcaagggcaagacgtgcaagcctgcccttgccaatgctcttttcagcaccattgcctttgttcttggtgcagtcacctcacttgtttctgggtttcttggaatgaagattgcgacatatgcaaatgccaggacgactcttgaggcaaggaagggtgtcggaaaggcattcattactgctttccgctctggtgctgtgatgggcttcctgcttgctgccagtggcctttttgttctttatattgcaatcaacttgttcggaatttattatggtgatgactgggagggcctttatgaggctatcact

SEQ ID NO: 10856 - protein, 230 aa, Panicum virgatum
  misc_feature: Ceres CLONE 1725953
  misc_feature (9)..(230): Pfam Name: H_PPase Pfam Description: Inorganic H+ pyrophosphatase
  misc_feature: SWISSPROT Homolog: EC 3.6.1.1 Inorganic diphosphatase
  misc_feature: Useful for making plants with modulated water use efficiency
MAAPAFLPELATQVVVPVAAVVGIAFAVLQWVLVSKVKLSPDPRRGDGSSPKSGAGASEYLIEEEEGLNEHNVVVKCAEIQNAISEGATSFLFTEYKYVGLFMGIFAVLIFLFLGSVEGFSTKSQPCHYSKGKTCKPALANALFSTIAFVLGAVTSLVSGFLGMKIATYANARTTLEARKGVGKAFITAFRSGAVMGFLLAASGLFVLYIAINLFGIYYGDDWEGLYEAI

SEQ ID NO: 10857 - DNA, 1617 bp, Panicum virgatum
  misc_feature: Ceres CLONE 1725964
  misc_feature: Encodes the peptide sequence at SEQ ID NO. 10858
atcgcctattctattcgtcgccccctctcgcccctcacctcacacgcacgctcgctcccaccccccatcgccgccgccgccgccgccgccgccgccaccaaaaccccaatccgtgccgagcccgtctcggccaccatctcctccccatcctcctcctcctcctcggtggcgcggcgagccgcgggcgatccggccggtgaggggggcgcgcgcggggcgggggcggagatggcatcggaggacgtggtggggaagagcaggggcgacacggccgtcaccaccatcgtcaacctggcggaggaggccaagctcgcgcgcgagggggtcaaggggccggggcaccaggtcctcaccatctgcaagtcgctcgtcgccggcggcgtcacggggggagtgtcacgcactgctgttgctccgcttgaacgattgaaaatcttgctccaggttcaaaatccacacagtatcaagtacaatggtacaattcaaggtctcaagtatatatggagaactgagggcctccgtggacttttcaagggcaatggtaccaattgtgcaaggattgttccaaattctgctgtgaagttttttagctacgagcaggcatcaaagggaattttgtgggcttaccgccaacagactggggatgaggatgctcagctttctccactattacgccttggagctggagcctgtgctggtatcatagccatgtctgctacttacccgatggatatggttaggggtagaatcaccgttcagacagacaagtctccctaccagtaccgtggtatgtttcatgcactgggcacagtttaccgcgaggaaggctttcgtgctttgtacagagggtggcttccatctgtaatcggagttgttccgtatgttggcctcaactttgctgtttacgagtctctcaaggactggctgctccagacaaatccttttgggcttgcaaatgataacgagctgcatgtagttacaaggcttgggtgtagagctgtggctggaactattggccagactgttgcgtaccctcttgatgtcatcagaagaagaatgcagatggtcggctggagccatgctgactctattgttactggacaaagcaaagaagcactccagtacaatggtatgattgatgcatttaggaaaactgttcgtcatgaaggtgtaggtgctctgtacaagggtcttgtgccaaattcagtgaaggtggtgccctcgattgccattgcatttgtcacttacgaggttgtgaaggatgtgctaggagtagagatgaggatatcagactgaggggattggattagcgctgggtgttatcgactgctatttttgtaggtgttggagttctgtttttgtaggcagggcgggtagaaggatatgactgcggctccattcagcatcaggccctctcagcccatgttgatatatcctgctactggcttcaggtcctaaattgttgctagatcgtggaaaattaataagttggctgtaaagctttgaagcatttgcctaactcataaaaagtttattccttgttgatgtatcgagattgaacttaaaagcggtattgcttgctgctaatagttgattctaatgattttcctttgcctc

SEQ ID NO: 10858 - protein, 355 aa, Panicum virgatum
  misc_feature: Ceres CLONE 1725964
  misc_feature (145)..(237): Pfam Name: Mito_carr Pfam Description: Mitochondrial carrier protein
  misc_feature (42)..(133): Pfam Name: Mito_carr Pfam Description: Mitochondrial carrier protein
  misc_feature (248)..(351): Pfam Name: Mito_carr Pfam Description: Mitochondrial carrier protein
MASEDVVGKSRGDTAVTTIVNLAEEAKLAREGVKGPGHQVLTICKSLVAGGVTGGVSRTAVAPLERLKILLQVQNPHSIKYNGTIQGLKYIWRTEGLRGLFKGNGTNCARIVPNSAVKFFSYEQASKGILWAYRQQTGDEDAQLSPLLRLGAGACAGIIAMSATYPMDMVRGRITVQTDKSPYQYRGMFHALGTVYREEGFRALYRGWLPSVIGVVPYVGLNFAVYESLKDWLLQTNPFGLANDNELHVVTRLGCRAVAGTIGQTVAYPLDVIRRRMQMVGWSHADSIVTGQSKEALQYNGMIDAFRKTVRHEGVGALYKGLVPNSVKVVPSIAIAFVTYEVVKDVLGVEMRISD

SEQ ID NO: 10859 - DNA, 1094 bp, Panicum virgatum
  misc_feature: Ceres CLONE 1725965
  misc_feature: Encodes the peptide sequence at SEQ ID NO. 10860
ggcaccaagggagcagcacccgcgcatgtttacctgcttcgccgggcgcgcctcctccaccgcatcgagcatcgtcgccagcagcctcgccgcccccgcccccgcccccgcccccgcgccgtcgcccaagccccgcagccccgcctccgccgcccgccgcaggctcatcatgagcaagcccgtcttcgccgcccacagcgccgtcgcgggcatggacgccgtcgagcgcttgaagagcgggttcgagcagttcaagacccaggtctatgacaagaagccggagctgttcgagccgctcaaggccggccaatcccccaggtacatggttttcgcctgcgccgactcccgctgctgcccgtcggtgaccctgggcctgcagcccggcgaggccttcaccatgcgcaacatcgccgccatggtcccgccctacgacaagaacaagtacgccggcatcggggccgccatcgagtacgccgtctgcgcgctcaaggtggaggtcctcaccgtcattggccacagccgctgcggtggcatcaaggcgctcctctccctccaggacggcgcagccgacaccttccacttcgtcgaggactgggtcaggatcggcttccaggccaagaagaaggtgctgaaagagcacccccatgctccgttcgatgaccagtgctccatcttggagaaggaggccgtgaacgtgtccctctacaacctcttgacctacccctgggtcaaggaaggtgtggagaacgggaccctcaagctggtcggcgcacgctacgacttcgtgaacggtgtgttcgacacatgggtgaaataagccaccaactcctacatcatcaaatacatacatagtacttgcataccgatatgcacctcatcgatgtgaatccgtggagtacttactgcctatttcgaccgcttcgaaccggatcgtcctatgctgtaataagcaatagcattttctactgctttacttcctaaggtggagcttatatatatgtaatatatggtgcgtaatttgaccgcttttgtggtcaagagacatcagctgtataagcctttttcataatattatcatgcagtatctttttact

SEQ ID NO: 10860 - protein, 215 aa, Panicum virgatum
  misc_feature: Ceres CLONE 1725965
  misc_feature (44)..(214): Pfam Name: Pro_CA Pfam Description: Carbonic anhydrase
  misc_feature: SWISSPROT Homolog: EC 4.2.1.1 Carbonate dehydratase
MSKPVFAAHSAVAGMDAVERLKSGFEQFKTQVYDKKPELFEPLKAGQSPRYMVFACADSRCCPSVTLGLQPGEAFTMRNIAAMVPPYDKNKYAGIGAAIEYAVCALKVEVLTVIGHSRCGGIKALLSLQDGAADTFHFVEDWVRIGFQAKKKVLKEHPHAPFDDQCSILEKEAVNVSLYNLLTYPWVKEGVENGTLKLVGARYDFVNGVFDTWVK

SEQ ID NO: 10861 - DNA, 2280 bp, Panicum virgatum
  misc_feature: Ceres CLONE 1725971
  misc_feature: Encodes the peptide sequence at SEQ ID NO. 10862
ctcgacgacttcctccttcccttcccctcctccccgatccacggccacccatggcgacgccgacgacccgcccggcgctggcgctcctcctagtcgcggccgccgtgctcgccagcgccggcgccgcgcgcgggttctacctccccggcgtcgcccccgccgacttccgcaagaaggacccgctcgccgtgaaggtgaaccagctgagctccatcaagacgcagctgccctactcctactactccctacccttctgcaggccgggcaccatcgtcgacagcgccgagaacctcggcgaggtcctccgcggcgaccgcatcgagaattcgctatacgtgttcgagatgatggagcctaagctgtgccagatcgtgtgcaagattgctccgaaccaagacgaggccagggatctgaaggagaaaatcgacgacgagtaccgcataaacatgattcttgacaaccttcctttggtcgtacctattaagaggttggatcaagaggcactgacggtctatcagcaaggcgtgcatgtcggcgtcaagggacagtatgcagggagcaaggaggagaagcatttcatccacaaccacttcacatttctggtgaagtatcacaaggatgcagacacagatattgctaggattgtggcctttgaggttaaaccatacagcattaagcatgaatatgatggtgactggaaggggaatgctacaccccttaaaacctgtgatccacactcgagacgtctagtcgtagactcggattcacctcaagaagtagaggccagtaaagagatcattttcacctatgatgttaactttgaggaaagtcctatcaagtgggcatcacgctgggacacctaccttctgatggcagatgaccaaatccattggtcctcaattgtcaattctctgatgatggtcctcttcctctctgggatggttgccatgatcatgctccggacactgtaccgtgacatctccaagtacaaccagttagaagaccaggaggacgccctggaggagacaggatggaagcttgtccatggcgatgtgttcaggcctcctgtcaaagctgacctgctgtgcgtatatgttgggacaggcgttcagttttttgggatgctgcttgtcaccttgctgtttgccatccttgggctactctcaccatcaaaccggggaggccttatgacagcaatgctcctcctctgggtcttcatgggcctctctgcagggtactcctcctcgcgcttttacaagatgttcaagggttcagaatggaagaatgtcacaatcaagacggccttgatgttccctggcatcgtgtttgcgatattcttcgtcctgaatgctctcatctggggtgagaaatcctctggtgctgtgccattcaccaccatgtttgcacttgttcttctctggttcgggatctctgtgccgcttgtcttcatcggcagctaccttgggttcaagaagcctgccttggaggaccctgtgaggacaaacaagataccacgggcaataccagagcagccatggtacatgaacccagtcgtctcagtactgatcggtggcatcctgcccttcggcgctgtgttcatcgagctcttcttcatcctgacatcaatctggctgcaccagttctactacatctttggtttccttttcctggtgttcgtcatcctgatcctgacctgcgctgagatcaccattgtgctctgctacttccagctctgcggtgaggactatcagtggtggtggaggtcctacctgacggctggctcgtcagcactgtacctcttcctgtacgccacattctatttcttcatcaagctggagatcacgaagactgtatctggcgtgctttacttcgggtacatgctcatcgcctcgtatgccttcttcgtgctcaccggcaccattggcttctatgcctgcttctggttcaccaggctcatctactcttcggtcaagatcgactagaaatccggagactaaaattgtaactgttttgtcggtttcccgtatcagaggttaaaagactgtaggaaaggaatcatcagaagttcagaatgtagtataagctgaaacgtagtctgcttgttcaggtgttttagggtattcacagtttgattctgtaacactacattagtgtatttttttatgccagtaattcggtgcgggtgtgtatccttacagaaaagattccgatggtacaatcaaactatttaacattgtaaccataccttttgttggtgaaatgctggataatgtttacttc

SEQ ID NO: 10862 - protein, 643 aa, Panicum virgatum
  misc_feature: Ceres CLONE 1725971
  misc_feature (59)..(601): Pfam Name: EMP70 Pfam Description: Endomembrane protein 70
MATPTTRPALALLLVAAAVLASAGAARGFYLPGVAPADFRKKDPLAVKVNQLSSIKTQLPYSYYSLPFCRPGTIVDSAENLGEVLRGDRIENSLYVFEMMEPKLCQIVCKIAPNQDEARDLKEKIDDEYRINMILDNLPLVVPIKRLDQEALTVYQQGVHVGVKGQYAGSKEEKHFIHNHFTFLVKYHKDADTDIARIVAFEVKPYSIKHEYDGDWKGNATPLKTCDPHSRRLVVDSDSPQEVEASKEIIFTYDVNFEESPIKWASRWDTYLLMADDQIHWSSIVNSLMMVLFLSGMVAMIMLRTLYRDISKYNQLEDQEDALEETGWKLVHGDVFRPPVKADLLCVYVGTGVQFFGMLLVTLLFAILGLLSPSNRGGLMTAMLLLWVFMGLSAGYSSSRFYKMFKGSEWKNVTIKTALMFPGIVFAIFFVLNALIWGEKSSGAVPFTTMFALVLLWFGISVPLVFIGSYLGFKKPALEDPVRTNKIPRAIPEQPWYMNPVVSVLIGGILPFGAVFIELFFILTSIWLHQFYYIFGFLFLVFVILILTCAEITIVLCYFQLCGEDYQWWWRSYLTAGSSALYLFLYATFYFFIKLEITKTVSGVLYFGYMLIASYAFFVLTGTIGFYACFWFTRLIYSSVKID

SEQ ID NO: 10863 - DNA, 1572 bp, Panicum virgatum
  misc_feature: Ceres CLONE 1725972
  misc_feature: Encodes the peptide sequence at SEQ ID NO. 10864
ctatccgcctaggctatctttataaacagctgcagcggaagaggtcaggaccaaagctggaacctccgaaatcccaaccaaaccgccgaggcgagccgcgggacggcggatggcgccgtcgttggtcgtctcggcgagacatacccacgccgtgacccaccagagaagccgcaggcggcgtatggtggtcgccagttccggcggcgccccgccaccgaagctggtgactttcctcggcaagggcggctctggcaagaccaccgcggccgcggccgctgctcagtattatgcaagcgaaggcttcaagacatgcctggttacacagtcccaggatcctaccgcagagcaattgatgggctgtaagattgggaactcactgactgagtgcgcggtcaatctctcaaccataaagctagagactagtaagatgctgcttgaaccccttgaccggttgaagaaggtagatgcccaggtcaattttactcaaggagtccttgaagggattgtaggagaggagcttggagttttacctggaatggattcgatctgttcagtcttagctcttcagaagctccttaacttcttttcagctggaaggagtggctcacaaccagaatttgatgtggtagtatatgattgcaacaatacagaggaaattctacagcttatagacaggtcttacttgaggtatgtgagggacctagctgagaagactgacatgggaagactggcttctccttcattactaaaactaatatatgatgctgcaaggccaaatggtaagactagtgaggggagactgagtacagaaatatggaatgaaatcgaacaacttcttgagagagtctcggtttggtttgccaatccttcaaaccttgcgtgcttccttatcatagatcctaggagatcaatatctgtatcctctgcattaagatattggggttgtaccactcaagctggtggtcaaatatgtggggcatttggttatactgaagacccttctgaaatgcaccaagaagttgcacaaaagttcatgccattgcctttctcgcttctgccatttctctcaaatgattcttctgcagattggagcagagcactaagcttattgagccaaaacacaaaggaacaattgaggaatacgtccatccatgtatatccttcagttagttttgattctgttcagaaatcggtaacccttttcatgccaggctttgataagtctgaaatcaagctatatcaatatagaggcggatcggagctgttgatcgaagctggagaccagaggcgcgtcataaaattgccactggcgatgcaggggaaggtcggaggcgccaagtttgttgacgggaacctcattgtcagcatccggtagaagactcaccggcaccggctgggatttgtgtcccccacttcagatcggcagttaccgtgagaagtagatcggatttgcgtgttggttctagtctgaatttcgtggtttgtaagcaaagttttttttaagacctcattacgcaaactgaaactgcactgttatactctttctgataatgaggcacgcgatactcgaat

SEQ ID NO: 10864 - protein, 397 aa, Panicum virgatum
  misc_feature: Ceres CLONE 1725972
  misc_feature (12)..(316): Pfam Name: ArsA_ATPase Pfam Description: Anion-transporting ATPase
MVVASSGGAPPPKLVTFLGKGGSGKTTAAAAAAQYYASEGFKTCLVTQSQDPTAEQLMGCKIGNSLTECAVNLSTIKLETSKMLLEPLDRLKKVDAQVNFTQGVLEGIVGEELGVLPGMDSICSVLALQKLLNFFSAGRSGSQPEFDVVVYDCNNTEEILQLIDRSYLRYVRDLAEKTDMGRLASPSLLKLIYDAARPNGKTSEGRLSTEIWNEIEQLLERVSVWFANPSNLACFLIIDPRRSISVSSALRYWGCTTQAGGQICGAFGYTEDPSEMHQEVAQKFMPLPFSLLPFLSNDSSADWSRALSLLSQNTKEQLRNTSIHVYPSVSFDSVQKSVTLFMPGFDKSEIKLYQYRGGSELLIEAGDQRRVIKLPLAMQGKVGGAKFVDGNLIVSIR

SEQ ID NO: 10865 - DNA, 872 bp, Panicum virgatum
  misc_feature: Ceres CLONE 1725979
  misc_feature: Encodes the peptide sequence at SEQ ID NO. 10866
gaagcacgaggcggaggaggaggcggagggggcgccttcttccgcggcgcaggcgaccgcgacgacgatgctgccccggtcgagctcgcggccgcagctggacctcagcggcgcggctatccacgggacgctggaggaccgcaaccccaccatcctgctgcccaaccagtccgacgacatctcccacctcgcccttgatatcggcggttctcttataaaactggtatacttctcgcggcatgctgaactttcaactgaggataagcgtaagatatccaccaagagaagacttgggatgtttaatggtggcaggagaagctacccaattcttggagggaggctccactttgtcaagtttgagactgggaagctaaatgaatgcttggacttcatttcttccaaacaactacttcgtggtggtgttgattcaccttcgtggcgctctggagctcagcctgataacattgtaatcaaggcaacaggtggtggagcatacaagtatgcggatctcttcaaggaaagattgggagtcagccttgaaaaggaagatgaaatggactgtcttgtatctggagcaaactttttgcttaaggctatacgtcatgaagcttttacacacatggatggccacaaagaatatgttcagattgatcagaatgatttgtttccctttcttcttgttaatgtcggatctggtgttagcataatcaaggttgacgggcatgggaagtttcagcgtgtaagtggtacaaatgttggtggtggtacgtactggggattgggaaggctaatgacaaagtgcaagagttttgatgagttgctagagttgagccagcgtggagacaacagcaccattgacatgcttgtggggg

SEQ ID NO: 10866 - protein, 290 aa, Panicum virgatum
  misc_feature: Ceres CLONE 1725979
  misc_feature (61)..(290): Pfam Name: Fumble Pfam Description: Fumble
  misc_feature: SWISSPROT Homolog: EC 2.7.1.33 Pantothenate kinase
KHEAEEEAEGAPSSAAQATATTMLPRSSSRPQLDLSGAAIHGTLEDRNPTILLPNQSDDISHLALDIGGSLIKLVYFSRHAELSTEDKRKISTKRRLGMFNGGRRSYPILGGRLHFVKFETGKLNECLDFISSKQLLRGGVDSPSWRSGAQPDNIVIKATGGGAYKYADLFKERLGVSLEKEDEMDCLVSGANFLLKAIRHEAFTHMDGHKEYVQIDQNDLFPFLLVNVGSGVSIIKVDGHGKFQRVSGTNVGGGTYWGLGRLMTKCKSFDELLELSQRGDNSTIDMLVG

SEQ ID NO: 10867 - DNA, 360 bp, Panicum virgatum
  misc_feature: Ceres CLONE 1725979-R
ttgcaacttgcagaagtgagttggttcatctgcacccaactggatgaagaaacatgcatacgccgaatgatccgtccaatgtacccaggaaacttcttaccatatctgtgatagtcttgaccaagataattaaggttttaaaggtcattccccagaaagattgggatagaggttcgacccaggtaagctggagcctggagcctctttgtttaaggaggcttgaatatgcaccctcttttagcatcatagctgggctgaagtacatactcagatccctggcgagctattgtcatcaaactcgaatcaatccaataaaatgttctctgggataatgacatataatccgaaaaatcagttatt

SEQ ID NO: 10868 - DNA, 1748 bp, Panicum virgatum
  misc_feature: Ceres CLONE 1725981
  misc_feature: Encodes the peptide sequence at SEQ ID NO. 10869
aaaccatccgatccaactcgatagcacgcgccaagaactcaactgcatgcaccggaagaagcagcagtgatcagttgcactcgatcgatcgatcgatcgcgtcaagaactgcagcgcgccaccagtctcgccggcgaagaagcaggaagaagaagaaggaaggcggccggccgagcgagggagcgagcgaagctaatcatcattaactagctagtcaccatgaggatgctgttccgctgcttcgtggcctcggagccggcgggggccgggagcgagagcggcgacgagacgcgggcgacgagggagaagaaggcggtgcggcggatgcggagcgcgacggcgcggctgcggtcgctgtcgccggacgacctgtcgcggacgctggcctcctcggggctgcacgccttcaccctggcggagctccggtccgcaacgcgcaacttctccagcagccacttcatcggcgagggcgggttcggccccgtgtacaagggcttcctcgacgagcggctccggcccggggagctcccgccgcagcacgtcgccgtcaagtacctcgacgccgacgggccgcaggggcaccgcgagtggctggcggaggtggtgtacctggggatgctgagccatccgcatctggtgaagctcatcgggtacggctgccaggacgagcagaggatgctcgtctacgagtacatagccaggggcagcctcgagcaccacctcttcaagaatctgctgtcgagcctgccgtagtgcacgcggctcaagattgcggtgggcgcggccaaggggctggcgttcctgcacgaggccgaaacgccggtgatctaccgcgacttcaaggcctccaacatcctgctcgacgcggactacacggcaaagctgtcagacttcggcctggccaaggagggcccgcagggcgacgacacccacgtcaccacccgcgtcatggggacccacggctacgccgccccggagtacatcctcaccgggcacctgacggcgaagagcgacgtgtacagcttcggcgtggtgctgctggagctgctgacggggcggcgcagcgtggacaggcggcggcgcgggcgggagcagaacctggtggactgggcgcgcccgtacctgcgccacccggagcggctgcaccgggtgatggaccccagcctcgacggccagtactccggcaaggccgcgcacaaggccgccatggtcgcctaccgctgcctgcacagcgtgcccaagtcgcgccccaccatgcgcgacgtcgtggacgcgctcgagccgctgctcgccgtgtgcgccgacgtgcccgtgggccccttcgtctacacggtcccgggcgacgacgggaaggccggcgaggcggcggcggcggtggcagccaggaagaagtgcctcgcgtcggcggtgcacgccgagggcgagctgccggcggggaaccaacggtacgagagctcggtggcggggcgcaagaactcctcgccgaagcagagcaggcacaggggcgcgtgagtgcgcgacggagcaggcaccaactgatcaacttacttggattggatgcaatgggtgttagcctgtgcatttcttcctgatcaaattgtgaagtgtatatagttagtgtcagcaaggtgcaagcttaaattgttcgttgattcatttttttttcttggttatatcctgctgtggataaccgagaacaaattgtattctagctatttttaggaagaaaggatgtccttttttccttt

SEQ ID NO: 10869 - protein, 187 aa, Panicum virgatum
  misc_feature: Ceres CLONE 1725981
  misc_feature: SWISSPROT Homolog: EC 2.7.11.1 Non-specific serine/threonine protein kinase
  misc_feature: Useful for making plants with modulated drought sensitivity
  misc_feature: Useful for making plants with altered cell wall content and/or composition
MGTHGYAAPEYILTGHLTAKSDVYSFGVVLLELLTGRRSVDRRRRGREQNLVDWARPYLRHPERLHRVMDPSLDGQYSGKAAHKAAMVAYRCLHSVPKSRPTMRDVVDALEPLLAVCADVPVGPFVYTVPGDDGKAGEAAAAVAARKKCLASAVHAEGELPAGNQRYESSVAGRKNSSPKQSRHRGA

SEQ ID NO: 10870 - DNA, 840 bp, Panicum virgatum
  misc_feature: Ceres CLONE 1725990
  misc_feature: Encodes the peptide sequence at SEQ ID NO. 10871
gcattgggagcaacaccaatggaagaccaccagcactgcctctacctcgtattagctctcgtctcgctgctcgtcatcttgctcgccaagcgccggcgctccgccgcggcgcccgagcacggcctgcggctgccaccggggccatggcagctgccaatcatcggcagcctgcaccacatgatcggcaagctcccgcaccacgcgatgcgtgacctcgcgcggcgccacgggccgctcatgctgctccagctcggcgaggtgcccacgctggtggtgtcgtcccgggaggcggcgcgggaggtgatgagaacgcacgacgcggtgttcgcgacgcggccgatgagccccaccatgcgggcgctcaccgacggcggccgggggatcatcatggcgccctacggggcccactggcggcagctccgccggatcaccatcaccaagctcctcagcgcgcgccgcgtcaactccttccgcgccgtccgcgaggaggaggctgccgtcatgctgcgcgtgtgcgccgccgcggcggcggagtctcgcgccgtgaacatgcgcgagcggctgtccgagctcatcacggacaccacgatgcgcgctgcgatgggcgaccgtatcaaggaccgcgaggtcttgctgcgggcgctcgacgaagccatcgtgctcgccgccgggttcaacccagccgacctgtggccgtcatcccggatcgtcagctggctcagcagcgccgtgcgccgcagcgaggagatccgtcaaacctcgttcgggatcctcgacgaaatcatcaaggaccacctggagaagatgaagcgtggcgacggcggcgaggtcgaagacctc

SEQ ID NO: 10871 - protein, 273 aa, Panicum virgatum
  misc_feature: Ceres CLONE 1725990
  misc_feature: SWISSPROT Homolog: EC 1.14.13.68 4-hydroxyphenylacetaldehyde oxime monooxygenase
MEDHQHCLYLVLALVSLLVILLAKRRRSAAAPEHGLRLPPGPWQLPIIGSLHHMIGKLPHHAMRDLARRHGPLMLLQLGEVPTLVVSSREAAREVMRTHDAVFATRPMSPTMRALTDGGRGIIMAPYGAHWRQLRRITITKLLSARRVNSFRAVREEEAAVMLRVCAAAAAESRAVNMRERLSELITDTTMRAAMGDRIKDREVLLRALDEAIVLAAGFNPADLWPSSRIVSWLSSAVRRSEEIRQTSFGILDEIIKDHLEKMKRGDGGEVED

SEQ ID NO: 10872 - DNA, 628 bp, Panicum virgatum
  misc_feature: Ceres CLONE 1725990-R
agacaaggcagggcagtcagagttggaaggaagccttgaagaggtggaggatcttgctcaacaactggggtatctgagttcttctagcccaaagtagagtcgtgttcgtaacagttcacccgacagttggtggtgctttccgtagtattgcagatcatcttgaaccacggcttaaacggtggagattggtagctgttctgaggggttcgtgtgggaggcccagactgcgtggacaccagtatgcggaaggctcggtgctgggagggataggggaggtgttggttaacctctccatgctgaatggcaaagtgatccttgggaaggggattggcaaagaagtcctattgacaccagaccagatgggctagatatacagatgttatgagcccttatccagtagcttttacatccagaagctgttatactgtaaatgcccgtgctgcgtgccattggtagtctttcttcaggttgttcatcgggttgttgcctttaggctgaggacttgggtcactctgtgattggtgtaacctgaaaacatccttagcatgatcaacttcatcactgtgcgtcaggtttccaaagaggatcaaatctgaaggatttagcatatattcttcatatttccttc

SEQ ID NO: 10873 - DNA, 1478 bp, Panicum virgatum
  misc_feature: Ceres CLONE 1726002
  misc_feature: Encodes the peptide sequence at SEQ ID NO. 10874
accacagtactgcacactctctcttcattcccctcccaatcaaactccaaaaatcctgtcaaaatggcggctttgtcagggcctatgacaggcaagagagctctccgacacctcctcctcctctgcctcctcctcccctgtctctcccaaccactcccggctccttccccctcgccgacggcggcgcctccgccgacgttccccctctcgccgttcaacgaccgcctcgacgcggcgtacatcgcgctgcaggcgtggaagcacgccatcaccgaggaccccaagaacctgaccgccaactggtgcgggcccttcgtgtgcaactacaccggcgtcttctgcacggcggcgcccgacgacccgcacatcctcaccgtcgccggcgtcgacctcaaccacggccgcatcgccgggttcctccccgaccacatcggcctcctcgccgacgtcgcgctcctccacctcaactccaaccgcttccacggcacgctgccggggtcgatgcagcacatgcgcctcctcttcgagctcgacgtcagcaacaacctcctctccggcgagttcccggcgttcctcacctcgctgccgtcgctcaagtacctcgacctgcgcttcaacaagttcgacgggcagctccccgacgccgtgttcggccggcagctcagcctggacgcgctgttcgccaacaacaaccgcttcaacgtgaccctgtcgtcgcgggccctgaccaactccacggcgtccgtcatcgtgctcgccaacaccgaactcaagggctgcctgccgccgagcatcggcgacatggccgacacgctggtggagctcgtcctcctcaacaccagcatcagctcctgcatcccgccggagatcggcaagctcaagaagctcaaggtgctggacctcagccgcaacgagctcgccggggagctgccggagagcatcggcgacatggagagcctggaggtgctcaacgtggggtacaaccagctgtccggcgtgctgccggagagcatctgcatgctgcccaagctcaagaacctcaccgtcgccggcaactacttctgcagcgagccggtgtcgtgcctccacgtgcccctgcgcgacgaccggatgaactgcatccccgagtggccccaccagcgcacgcacgaggagtgcatcgccttcgagcaccggccgccggtgcactgcggcgccgacggctgcattcttcatcacccgctgtgaagaagaagctcatagatgtgtttggtagactgcgaagctgcctgcatgcacgcatgtgggttctagaaacagtgctccatcttgctacaatttaaaaatggttcctaattaagtacaaaagttaaattggattataaattcgcgtgtatctggtatattaggtgttggcctttgttctttttcttgtaactgttttttcttaccacagaaaaggcatattgctaatgtaacccaacacagatgtgacatgt

SEQ ID NO: 10874 - protein, 387 aa, Panicum virgatum
  misc_feature: Ceres CLONE 1726002
  misc_feature: SWISSPROT Homolog: EC 2.7.11.1 Non-specific serine/threonine protein kinase
MAALSGPMTGKRALRHLLLLCLLLPCLSQPLPAPSPSPTAAPPPTFPLSPFNDRLDAAYIALQAWKHAITEDPKNLTANWCGPFVCNYTGVFCTAAPDDPHILTVAGVDLNHGRIAGFLPDHIGLLADVALLHLNSNRFHGTLPGSMQHMRLLFELDVSNNLLSGEFPAFLTSLPSLKYLDLRFNKFDGQLPDAVFGRQLSLDALFANNNRFNVTLSSRALTNSTASVIVLANTELKGCLPPSIGDMADTLVELVLLNTSISSCIPPEIGKLKKLKVLDLSRNELAGELPESIGDMESLEVLNVGYNQLSGVLPESICMLPKLKNLTVAGNYFCSEPVSCLHVPLRDDRMNCIPEWPHQRTHEECIAFEHRPPVHCGADGCILHHPL

SEQ ID NO: 10875 - DNA, 1760 bp, Panicum virgatum
  misc_feature: Ceres CLONE 1726007
  misc_feature: Encodes the peptide sequence at SEQ ID NO. 10876
gtgtattcagctgtagctagcaatggccgctcacatcttcttcgtcacctccgtccggcctcttctcctttcggcttcgccggcggctaggaacggccggcgaggaggccgccccggtggctgtatccgcactttgccggcttccagaacgctgccgccgagcgaccatgacctccagaagagcatcatgagtgtacaaaagactctgcatggacatctgaagagcggacgggaggtgatggccgccgtcgacaacctcaagcgcctctgcatcgaccactacttcgaggaagaggtcgaaagcgccatggccgtggccgtggatctcgtccacagcgacgacctcctcgatgcaaccctatcattcaggttgctgagaaagaccggacatgatgtttcagcagatgaccttctccggaggttcaccgacggcgccggcgagctcagcctcgctctcaccgaggacatttgggcactcctgagcctgcatggcatgtcacacctggacatgggagaagaggcatcatcactccacaaggcaaaggacttctcaagcaagcaccttgcatctgccatcaggtacctgaatcccggcctggcaaggtatgtgaggcagtccctggatcacccctaccacatgagcctgatgcagtacaaggccaggcaccacctctgctacatgcagagcctgccaaataggaaaagcactgcagcaatggaggagctggcaactgcagagttccatttcaacagactgctgcatcagaaagagatggaagaggttaaaagatggtggatgggtctaggattggcccaagaagtaccggtggcccgggaccaggtgctgaaatggtacatgtggtccatgacaatcatccagggatcttccttctccagataccgggttcagttgacaaagataatctctcttatctatgttgtggatgacctattcgaccttgttggcacacaagaggagctctccctcttcaccaaggcagtcaaaatatggaatactgcggctgctgattcacttcccagctgcatgaggtcatgctacaaggctctttacaccattacgaatgagatcgcagatacggccgaaaaggagcatgggatgaaccctgtcaatcatcttagaaaagcatgggaagagctgtttgatggtttcatggtcgagtcaaaatggctggcagcctgtctggttcctgcagcagaggactacctgagaaatggcgttgtcacatcaggaatgtcgcttgcattagcacacgtgctcttccttcttgggcatgatcatgcagcatttggtgatgctgcaaggttcactgaccacatccctccggccatctcttgcccgggcaagatcctcagactttgggatgacatgggcagtgccgaggatgaagcacaggaaggattggatggatcctacagggactcgtacttgatggagaaccctagctgcaccccagctgacgcggaagaacacatgcggaggctgatcgcgagggagtgggaagagctcaacagggagtgcttcagcaggacgaccttctcctccagcttcatgcaggcttgcttgaacgcagcaaggatggtgagcgtcatgtactcgtatgacaaggagcagaggctcctcgttcttgaggactacgcgaagatgctgctgctctgaagctttgctgcatgagaatccactagtgttcgttcatcttgtatgactttacttacgctactctagtgtttcattttgcacc

SEQ ID NO: 10876 - protein, 496 aa, Panicum virgatum
  misc_feature: Ceres CLONE 1726007
  misc_feature (176)..(448): Pfam Name: Terpene_synth_C Pfam Description: Terpene synthase family, metal binding domain
  misc_feature (1)..(169): Pfam Name: Terpene_synth Pfam Description: Terpene synthase, N-terminal domain
  misc_feature: SWISSPROT Homolog: EC 4.2.3.13 (+)-delta-cadinene synthase
MSVQKTLHGHLKSGREVMAAVDNLKRLCIDHYFEEEVESAMAVAVDLVHSDDLLDATLSFRLLRKTGHDVSADDLLRRFTDGAGELSLALTEDIWALLSLHGMSHLDMGEEASSLHKAKDFSSKHLASAIRYLNPGLARYVRQSLDHPYHMSLMQYKARHHLCYMQSLPNRKSTAAMEELATAEFHFNRLLHQKEMEEVKRWWMGLGLAQEVPVARDQVLKWYMWSMTIIQGSSFSRYRVQLTKIISLIYVVDDLFDLVGTQEELSLFTKAVKIWNTAAADSLPSCMRSCYKALYTITNEIADTAEKEHGMNPVNHLRKAWEELFDGFMVESKWLAACLVPAAEDYLRNGVVTSGMSLALAHVLFLLGHDHAAFGDAARFTDHIPPAISCPGKILRLWDDMGSAEDEAQEGLDGSYRDSYLMENPSCTPADAEEHMRRLIAREWEELNRECFSRTTFSSSFMQACLNAARMVSVMYSYDKEQRLLVLEDYAKMLLL

SEQ ID NO: 10877 - DNA, 1786 bp, Panicum virgatum
  misc_feature: Ceres CLONE 1726008
  misc_feature: Encodes the peptide sequence at SEQ ID NO. 10878
atccatcccgtgctcgctgccaacgccgacgccgccgccgctccctcgctcctacccacatcggcgatcgcgccctcgctcctccccacagctgcggccgcgccatcgtcgatcccaagcttggcggggaggagaatcccgaggccgaggtcgtggagctgcagacccagaccgcgctggtgttcctcttcttcttcaagtccagctggtccgcgtggttgctggtgttcctcttctgcgtcggcgctattacccaattccaatgaacttgcattacttcagctgatccatggagcaaatgccctggattgcttcacctcatctttgattcatcatctacagtattttccagggaatggaatatgttgcatcatctcttgccataagaagctgtactgagaatgatgaatgtatatgatgcatactcaatgattgcatatacccaatgattgcatataccaaacaatggaggacgaagattgtaccctttgttcgttacttgattgctgaggataacccgaattatgagtttctcgatgatgatgacgacatacacattctggtgtcagccatggatgcagagagctcctaccacggcttaatacatgtgagacgatttgtccccagagaacgtgctgatggagaggttccgtatgaagcgtcacgtgttcatccgcattcttaatgcagttcagtctgtggacagctacttccagcaacgcgaggattgtactgggcttttaggattgagtgctttgcagaaggtggtagccgcaatgcgcatactggcgtatggtttgccgttagacgccgttgatgagtatgtgcaaattggcacgtcaactgctcgtgaggctcttaaccatttctacagtgctgttatagttgcctttggggaggaatacctgcattctctaacccctgtcgaagtggctcgtgtactgcaagagggtgagagacgaggtttcccaggtatgcttggtagcatagattgtatgcactgggaatggcggaactgccctactgtttggaagggcatgttcactggacgcgggaagcacccatccatgatcttggaggctgtagcatctcatgacctttggatatggcatgcctactttggccttccaggcagctgcaatgttatcaatgttctgcagaggtcgcctattttctcagcatatatccgaggagagtcacctcctgttcacttcaccgtcaacggacagacatatgacatggggtactaccttgcagatggtatataccctgattggccagcatttgtcaagagtgttcgccatcctatggagaggaagacacaacattttgctgctgtgcaagagggtgcgcgcaaggatattgagagagcttttggagttcttcaagctaggtgggcagtaatctgtgggccggcttatggatgggatagggagcagctttctgatattatgaccgcttgtattatcatgcataacatgattgtcgaggatgagaagtctgaggcaatcaataccaacttcgacaacattggcagacaagtcaacccttcaggtggaaatgtagcggaatgagaagcctttgtagcagcacatcacaagttgcgtgaccaagcttgccatatccaacttcagaaggatctcatagagcacaactggatgcgatatggttcaatctagtttttttttccttttcttcagttgtaatgcttcagaaactgtagttttttcctttttttgtaacatttatgattggacgaaataaaatgatctagagaagtggattg

SEQ ID NO: 10878 - protein, 311 aa, Panicum virgatum
  misc_feature: Ceres CLONE 1726008
  misc_feature (180)..(290): Pfam Name: Plant_tran Pfam Description: Plant transposon protein
MERFRMKRHVFIRILNAVQSVDSYFQQREDCTGLLGLSALQKVVAAMRILAYGLPLDAVDEYVQIGTSTAREALNHFYSAVIVAFGEEYLHSLTPVEVARVLQEGERRGFPGMLGSIDCMHWEWRNCPTVWKGMFTGRGKHPSMILEAVASHDLWIWHAYFGLPGSCNVINVLQRSPIFSAYIRGESPPVHFTVNGQTYDMGYYLADGIYPDWPAFVKSVRHPMERKTQHFAAVQEGARKDIERAFGVLQARWAVICGPAYGWDREQLSDIMTACIIMHNMIVEDEKSEAINTNFDNIGRQVNPSGGNVAE

SEQ ID NO: 10879 - DNA, 873 bp, Panicum virgatum
  misc_feature: Ceres CLONE 1726010
  misc_feature: Encodes the peptide sequence at SEQ ID NO. 10880
ttcttcaaccccgcctcctccttgacttcgccaccgtccttcctcgtcgtctcggtcttggaagcaagcaaggtagctgcacggaggcaaccgcgcagtaaggtgctcttggttctctgggatgatgaggcgcaggcagctcttgctggcgactgcctgcttgtgggctctgtcgtgcgccccgctgctccgtgcttccacccctgacggacttctcagggtcggcctgaacaagaacaagctcgaccgcgaggcgctggccgcggccaaggttgaaaggcagcacgacagccgccgcctgagggccgccggcgccgacgaggtccctctcatcgactacctcaacacccagtacttcggggtcgttggcatcggcacgccgccgcagaacttcaccgtcatcttcgacactgggagctccaacctctggatcccctcctccaaatgctatttctcgatagcatgttacttccaccacagatacaagtccggcaagtctagcacttacaaagctgatggtgaggcttgcgaaattacttatggctctggatcaatttccggattcttcagcaaggataacgtgctggttggagaccttgttgttaaaagccagaagttcattgagactactcgcgaacccagtttctcattcatccttgggaagtttgatggcattcttggtcttggataccctgaaatctctgtcggcaaagctcctcccatttggcagaacatgaaagagcagaaacttcttaaggatgacgtcttctccttctggcttaaccgaaaccctgatgcatcttccggtggcgagcttgtctttggcggcgtcgaccctaaacacttcaaggggaaccacacttatgttcctgt

SEQ ID NO: 10880 - protein, 250 aa, Panicum virgatum
  misc_feature: Ceres CLONE 1726010
  misc_feature (77)..(250): Pfam Name: Asp Pfam Description: Eukaryotic aspartyl protease
  misc_feature: SWISSPROT Homolog: EC 3.4.23.40 Phytepsin
MMRRRQLLLATACLWALSCAPLLRASTPDGLLRVGLNKNKLDREALAAAKVERQHDSRRLRAAGADEVPLIDYLNTQYFGVVGIGTPPQNFTVIFDTGSSNLWIPSSKCYFSIACYFHHRYKSGKSSTYKADGEACEITYGSGSISGFFSKDNVLVGDLVVKSQKFIETTREPSFSFILGKFDGILGLGYPEISVGKAPPIWQNMKEQKLLKDDVFSFWLNRNPDASSGGELVFGGVDPKHFKGNHTYVP

SEQ ID NO: 10881 - DNA, 393 bp, Panicum virgatum
  misc_feature: Ceres CLONE 1726010-R
aggacaggatcgggctttgcaaaatctgcatgagtgtgtcagcactctgctccgttaatatagtttctctatcagctacatgcacacagtacactgcaaataaatggatcgcaaaaaatgctaaaaccgggaacatgatttagcacacgggtagacctttgtttctgaagaagactaaatgaatgcttggagagctatgcttgaagatttgaagacatgtatgtttgatgtttactgaagaaagggacactgagaaataatatcacgctcatgtcatctcatcttgaaaattgtttgttcatatttgtacaacttatggtttgtaaaaataacatctggattgacttggaactgatgagcatgtgacaatgcaatttgcttctctgttgggat

SEQ ID NO: 10882 - DNA, 814 bp, Panicum virgatum
  misc_feature: Ceres CLONE 1726013
  misc_feature: Encodes the peptide sequence at SEQ ID NO. 10883
ctcccgcgaccttttcacagcgcagaaatatctcctctcctcgccttcgcttccatttccacccagcagccacagcagcaagtatcccaacagattccctccgcgatccgccacttgtccgggcgattccagctcccgatcgcgcgaatcgagttcgttcttggccgcaggagccgggttctggccgcaatcgggtggttcgttctcgaccggaggggaggcagctcaatcgggggttcttggtttccgcgggccgagtcctcgggcggcggctgcggccatggagccgtcggcggcggccgcgggcattgtgaaggaggagctcctggagcagcagccgctgcaggacggcgtgcgcggcggggacgcgccgcgcccgatggaggggctgcacgaggtcggccccccgccgttcctgaccaagacgttcgacctggtggaggacccggccaccgacgcggtcgtctcctggagccgcgccggcaacagcttcgtcgtctgggacccgcacgtcttcgccgacgcgctgctcccgcgcctcttcaagcacagcaacttctccagcttcgtccgacagctcaacacctatctaaatggaacaagatactgtggatgaagtacaagaaccagattgttttgttctagaagactactgatcaccttcagatgctatagtatactgctgctcattgtcattattccagctaccctcattgcaaattatagaaatctatgaaatttgcagaagagtttttgccaagctaacatattggctagtgactgtgacctgacgatggtcatcttgtttgttgca

SEQ ID NO: 10883 - protein, 111 aa, Panicum virgatum
  misc_feature: Ceres CLONE 1726013
  misc_feature (43)..(110): Pfam Name: HSF_DNA-bind Pfam Description: HSF-type DNA-binding
  misc_feature: The sequence is a functional homolog of SEQ ID NO 1685 in the 10/412,699 US patent application
  misc_feature: Useful for making plants with modulated heat sensitivity
  misc_feature: The sequence is a functional homolog of SEQ ID NO 1686 in the 10/412,699 US patent application
  misc_feature: The sequence is a functional homolog of SEQ ID NO 200 in the 10/225,068 US patent application
  misc_feature: The sequence is a functional homolog of SEQ ID NO 2428 in the 10/374,780 US patent application
  misc_feature: The sequence is a functional homolog of SEQ ID NO 942 in the 11/435,388 US patent application
  misc_feature: The sequence is a functional homolog of SEQ ID NO 2794 in the 10/374,780 US patent application
  misc_feature: The sequence is a functional homolog of SEQ ID NO 82 in the 10/225,066 US patent application
  misc_feature: The sequence is a functional homolog of SEQ ID NO 882 in the 11/435,388 US patent application
  misc_feature: Useful for making plants with modulated low light sensitivity
  misc_feature: Useful for making plants with modulated nitrogen use efficiency
  misc_feature: The sequence is a functional homolog of SEQ ID NO 1026 in the 10/225,066 US patent application
  misc_feature: The sequence is a functional homolog of SEQ ID NO 110 in the 11/375,241 US patent application
  misc_feature: The sequence is a functional homolog of SEQ ID NO 2280 in the 10/374,780 US patent application
MEPSAAAAGIVKEELLEQQPLQDGVRGGDAPRPMEGLHEVGPPPFLTKTFDLVEDPATDAVVSWSRAGNSFVVWDPHVFADALLPRLFKHSNFSSFVRQLNTYLNGTRYCG

SEQ ID NO: 10884 - DNA, 534 bp, Panicum virgatum
  misc_feature: Ceres CLONE 1726013-R
agtagagttgtgtttgtaacaggtcacccgacagttgctggtgctttccgtactattgcagatcatcttgaacaccctgttaaacggtggagatttgtagctgttctgaggggttcgtgtgggaggcccagactgtggggacaccagtatgtgaagggctccgtgctgcgagggatacgtgaggtgttggctaacctctccatgctgactggcaaagtgatccttacgaaggtgactggcaaagaagtcctatagacaccagaccagatcgacaagatatacagctgttatgagcccttatccagtagctcttacatccagaagctgttctactgtaaatgcccgtgctcgtgccattggtagactttcttcaggttctgcattgggttgtagcctttaggttgagtacttgagtcactctgtgattggtgtaacctgaaaacatccttagcatgataacttcatcactgtgcgtcaggttgccaaataggatcaaatctgaacgatttagcatatattcttcctattgccttc

SEQ ID NO: 10885 - DNA, 956 bp, Panicum virgatum
  misc_feature: Ceres CLONE 1726020
  misc_feature: Encodes the peptide sequence at SEQ ID NO. 10886
acccatccattccacctccgttcaccccgtccatttgatttgcgtttagtgcgttgcgtttcttgggtctgcctctctttgggaggagcgcgcctccttccattggcactcctgttctccgctcggagaaaggcttgaggacccaagaagaggatagcaatgggggaagctgccggcgaccgcgtcctgagccgcctccacagcgtcagggagcgcatcggtgactccctatctgctcaccccaatgagctcgtcgctgtcttcaccaggctgaaaaaccttggaaagggcatgctgcagccccaccagatcattgctgagtacaacagcgctatccctgaggctgagcgcgagaagctgaaggatggtgcctttgaggacgtcctgagagcagctcaggaagctattgttatccccccctgggttgcactggccatccgccctaggcctggtgtctgggagtatgtgagagtcaatgtcagcgagctcgctgttgaggagctgagagtccctgagtacctgcagttcaaggaacagcttgtggaagaaggccccaacaacaactttgttcttgagctggactttgagccattcaatgcgtccttccctcgtccttctctgtccaagtccattggcaatggtgtgcagttcctcaacaggcacctgtcgtcaaagctcttccatgacaaggagagcatgtaccccctgctcaacttccttcgcgcccacaactacaaggggatgaccatgatgttgaatgacagaatccgcagcctcagtgctctgcaaggcgctctgaggaaggctgaggagcatctgtccagccttccagctgataccccatactctgacttccaccacaggttccaggagcttggtctggaggaggggttgggggtgactggcgctaggcgtgcgcaggagactattcacctcctcttgggactttcttgagg

SEQ ID NO: 10886 - protein, 264 aa, Panicum virgatum
  misc_feature: Ceres CLONE 1726020
  misc_feature (11)..(264): Pfam Name: Sucrose_synth Pfam Description: Sucrose synthase
  misc_feature: SWISSPROT Homolog: EC 2.4.1.13 Sucrose synthase
  misc_feature: Useful for making plants with altered carbohydrate content
  misc_feature: The sequence is a functional homolog of SEQ ID NO 12 in US patent 7091398
  misc_feature: Useful for making plants with altered cell wall content and/or composition
  misc_feature: The sequence is a functional homolog of SEQ ID NO 2 in US patent 7091398
MGEAAGDRVLSRLHSVRERIGDSLSAHPNELVAVFTRLKNLGKGMLQPHQIIAEYNSAIPEAEREKLKDGAFEDVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGALRKAEEHLSSLPADTPYSDFHHRFQELGLEEGLGVTGARRAQETIHLLLGLS

SEQ ID NO: 10887 - DNA, 408 bp, Panicum virgatum
  misc_feature: Ceres CLONE 1726020-R
  misc_feature: Encodes the peptide sequence at SEQ ID NO. 10888
agacccggcggtacctggagatgctgtacgcgctcaagtaccgcaccatggcgagcacggtgccgctggccgtggagggagagccctccagcaagtgaggcgcccggggcctgaatgaaaggagcagggagcacttggagtcgtgtctttttcctgggtttcccttcctcattcggaggcgaaaaaagaagagtttgcatttcgtaggctggctttcttcaagaatttaaggtcgaccttcttccattgatgtgggtgctgctgctagtttgagttgattcagtagttgggggatggatggggtgtgtcagtgtgcagttggtcatgggtgctcccttgtttcctgggtggatggatggatgttgctccttcaataaaacgcagcggccttacttggcgccgtttcag

SEQ ID NO: 10888 - protein, 31 aa, Panicum virgatum
  misc_feature: Ceres CLONE 1726020-R
  misc_feature: SWISSPROT Homolog: EC 2.4.1.13 Sucrose synthase
  misc_feature: Useful for making plants with altered carbohydrate content
  misc_feature: The sequence is a functional homolog of SEQ ID NO 2 in US patent 7091398
  misc_feature: The sequence is a functional homolog of SEQ ID NO 12 in US patent 7091398
  misc_feature: Useful for making plants with altered cell wall content and/or composition
TRRYLEMLYALKYRTMASTVPLAVEGEPSSK

SEQ ID NO: 10889 - DNA, 934 bp, Panicum virgatum
  misc_feature: Ceres CLONE 1726026
  misc_feature: Encodes the peptide sequence at SEQ ID NO. 10890
agcaggtggtggccgttgtgggcccgcagtcgtcgggcatcgcccacgtcatctcccacgtcgtcagccagctgcgcgtcccgctggtgtccttcgccgccaccgaccccgcgctcacctccgcgcagtaccccttcttcgtccgcgccgcgcacgacgacgccttccagatggccgccgtggccgacatcgtcgcccacttcggctggcgggaggtcaccgccgtctacgtcgacaccgactacggccgcggcggcgtcgacgcgctgggcgacgcgctcgaggccgcgcgcgccaggatcacctacaaggccgcgttcccgccgggcgccgaccgcgccgcgctgggcgacctcctggtgcgcgccaacatgatggagtcgcgcgtcttcgtcgtccacgccggcccagactccggcctcgacatcttcgccctcgcgcacacgctcaacatgatggacagcggctacgtctggatcgccaccgagtggctcgccgccgccatcgactcctcgtcgtcgtcgccgtcgtggagagcgattacaatgggccggatacagggcgtgctcacgctgcgccagtacaccccggactccgacgccaagaggtctctggagacgaggttcagcgccgccagccggcagagcagcagcatcaacgcctacgggctcttcgcctacgacgccgtctggatggcggcgcgcgccatcgaccagttcctcggcgacggcggcaacatctccttctccgttgaccccagcatccgcgacgccaacgggagcgcgctgcgcctgagctcgctccgggtcttggaccagggcgagcagctgctgcggaaggtcatgctcgccaacttcaccggcgtcaccggccaggtgcggttcgacggcaggaccctcgtcaacccggcctacgaggtcctcaacgtcggccg

SEQ ID NO: 10890 - protein, 310 aa, Panicum virgatum
  misc_feature: Ceres CLONE 1726026
  misc_feature (1)..(310): Pfam Name: ANF_receptor Pfam Description: Receptor family ligand binding region
QVVAVVGPQSSGIAHVISHVVSQLRVPLVSFAATDPALTSAQYPFFVRAAHDDAFQMAAVADIVAHFGWREVTAVYVDTDYGRGGVDALGDALEAARARITYKAAFPPGADRAALGDLLVRANMMESRVFVVHAGPDSGLDIFALAHTLNMMDSGYVWIATEWLAAAIDSSSSSPSWRAITMGRIQGVLTLRQYTPDSDAKRSLETRFSAASRQSSSINAYGLFAYDAVWMAARAIDQFLGDGGNISFSVDPSIRDANGSALRLSSLRVLDQGEQLLRKVMLANFTGVTGQVRFDGRTLVNPAYEVLNVG

SEQ ID NO: 10891 - DNA, 572 bp, Panicum virgatum
  misc_feature: Ceres CLONE 1726026-R
tgtcggagaacggcgacctgcagcgcatccacgacaagtggctcagcccggggacgtgctcgtcgcagagcaccgacgtgggcgccgaccggctcaacctcagcagcttctgggggctcttcctcatctccggcgtggcctgcttcgtcgccctgctcatctacttcgccaggatactctgccagttctgtgagtaccatgacggcggccgcagcggtagcgacgaaggcggaggggtgttcccggatccggagaggagcctgcggcggccggcgaggctgagcagcatccgggacctgatgtcgttcgtggacatgaaggaagcggaggtgaagagagccatccggagcaggtcccgcgagaggcggctggacaggtccatgggaggcagctccatctccgaagggccttcattgtcgcggccgtcgtcgatcacgtcgccagtgtaataagcagcaagggtttttctttaatttgctgatgatgacaagtagatagatgagatactcctctgatagcggtctgactgacacttaggcattcaatactcctctgatagcggtctgactgac

SEQ ID NO: 10892 - DNA, 1789 bp, Panicum virgatum
  misc_feature: Ceres CLONE 1726029
  misc_feature: Encodes the peptide sequence at SEQ ID NO. 10893
attaattttccgcgctgcgcttgtagacatctatccagcagagcgcagcaggatggtgtacgcgctcctgctggtcgccttggcggccgtcgccgccgcggcggtgctccgccactacctcccgctgctccgcggcggcctccccaagggcagcttcggctggcccctcatcggcgagaccatcggcttcctccacgcgcacccgtccaacaccgccggcggcttcctcaaggagcacgtcgccaggtacgggacggtgttcaagtcgcacctcttcggctcgccggcggtggtctcctgcgacgaggagctcaaccacttcgtgctgcacaacgaggagcgcctgttcgagtgcagctaccccggcgccatccgcaccatcctcggcgagtcctccgcgctggtggtcaccggcgagcgccaccgccagatccggagcatgttcctcgccctcgtcgcctccacggggctcaaggcctcctacgtcgccagcgtcgacaagtccgcgcgctccctcatcgcgtcctggcgcggccgcgagaccatcagcttctgcgaggaggcgaggaagttcccctacaaggtgatcatggagcaggttctgggcctgccgccggacggcccggtggccctccggatcctggaagagtaccagatcttcatgaaggggatcatctccctccctatcaccctccccgggacagcattttccaaggccgtcaaggcaaggaagaggatatccgagaccatggagaagttcatcgaggacaggaagcgcagcccaaccaagcaggccgtcttcctcgacgtgctcctcgcgaacaaggagctcactcacgacgacaaggtcgccttcctgctggactcgctgctagcaggccacgagaccacctctgtgctgctctccattctcgtctatttcattgggaaatctcccagcatcatcgaccaactcaagaaagagcatgaggccatcaggtccacaaaggggaaggaggagcccttgacgcctgacgactacaggaagatggagtacaccagtcgtgttatcaatgagggactgagatgtggcaacatcgtcaagctagtgcacaggaaggttctcaaggacgtcacctacaaaggatacgtgatcccggctggttggaaaatcctgcccatcttgggtgctgtccacgtggacccatcgcatcatctggaacccgagcagtttcagcctcgcagatgggaggggctgaaccagccggctggcaagagcttcgcgccgttcggaggtggactgcggctctgccctggatcggagattgtcaaagtggaggctgctttcttcctgcaccaccttgtgctcaactacaggtggaggatgggtgaagaggacgctcccatgctgcaccagtacgtggaattcaagaagggcctgcccatacagctcgagccggtcagctgatgctcatcaagcctttgcctcgctcgctcttcgtcaagactccaagagagatgaaataagttgagacgtcggacccccgccagccagccagtcctgaatcgcgatttacaagtcacaaaaaaacaaaaaataaataaaataaaaatagctgtctacgtttatgtaattttattttttacgcgtaatttactgttattatgatgcataggcatcatggtttatgtatcacccgagatgggggacacgtacggtacggggtttggcacgagtcatgcaggtctcaaacctgaacctccagttgtagcactcgccatatctatcatatcctcccgttggttttcc

SEQ ID NO: 10893 - protein, 464 aa, Panicum virgatum
  misc_feature: Ceres CLONE 1726029
  misc_feature (31)..(462): Pfam Name: p450 Pfam Description: Cytochrome P450
  misc_feature: SWISSPROT Homolog: EC 1.14.13.93 (+)-abscisic acid 8'-hydroxylase
  misc_feature: Useful for making plants with modulated oxidative stress sensitivity
MVYALLLVALAAVAAAAVLRHYLPLLRGGLPKGSFGWPLIGETIGFLHAHPSNTAGGFLKEHVARYGTVFKSHLFGSPAVVSCDEELNHFVLHNEERLFECSYPGAIRTILGESSALVVTGERHRQIRSMFLALVASTGLKASYVASVDKSARSLIASWRGRETISFCEEARKFPYKVIMEQVLGLPPDGPVALRILEEYQIFMKGIISLPITLPGTAFSKAVKARKRISETMEKFIEDRKRSPTKQAVFLDVLLANKELTHDDKVAFLLDSLLAGHETTSVLLSILVYFIGKSPSIIDQLKKEHEAIRSTKGKEEPLTPDDYRKMEYTSRVINEGLRCGNIVKLVHRKVLKDVTYKGYVIPAGWKILPILGAVHVDPSHHLEPEQFQPRRWEGLNQPAGKSFAPFGGGLRLCPGSEIVKVEAAFFLHHLVLNYRWRMGEEDAPMLHQYVEFKKGLPIQLEPVS

SEQ ID NO: 10894 - DNA, 1362 bp, Panicum virgatum
  misc_feature: Ceres CLONE 1726031
  misc_feature: Encodes the peptide sequence at SEQ ID NO. 10895
tccctcgccaggcgccaccgccccccgcacctccccgccacgccacgtagagggaatggcgatggcgagcggcgtatcctccggccccgtgctgcagctcccctccctgcgggtgccgtccagtagattgctgccacggagagcagccgctggagctccggcaggtaatttatttgtgaagagagatgttgtatataacagaagaagttaccaccattttttaccatcgaagcaaagaggaggcctgcaagcagcagtcctgcctgttgctccaccaatattagatgatgaggaaacaaggaagcaaatggctgaagattttgggttcacacaaattggagaagaactgccagatagtgtcactcttaaagatgtcatggatactctacctaaagaggtatttgaaatcaatgatataaaggcttggacatcagttttaatatcagttacttcctatgcactgggtctatttttcattgcaaaatctccatggtatcttcttcccttggcttgggcttggactggcacagcagtgaccgggttttttgtcataggtcatgattgtgctcacaaatcgttttcaaggaataagttggtggaagatatcgttggaaccttagcattcatgccattgatatatccttatgaaccgtggagattcaagcatgaccgacatcatgccaagacaaatatgttgatagaagataccgcgtggcaacctgtttggcaaaaggaaattgaatcatcaccttttctgaggaaggctattatttttggctatggccctatcaggccatggatgtcaattgctcactggttgatttggcactttgatctaaaaaaattcagaccaaatgaagttccaagggttaagataagcttagcatgtgtgtttgcattcatggcaattggatggcctttgatcattctcaaatcaggactggctggatggtttaagttctggtttatgccatggatggtttatcatttttggatgagcacttttacaatggtacatcacacggctccccatataccattcaaatcctcggatgagtggaatgctgcacaagctcaattaaatggcacagttcattgtaactaccctcaatggattgagatcctttgccatgacataaatgtgcatgtcccacaccatatttctccaagaattccaagttataacctccgtgctgcctatgattccatcaaacagaactggggcaagtatgtcaatgaagccaactggaattggcgattgatgaagacgatactgactacatgccatgtgtacgacaaggagagatactatgtcccattcgacgagctctcacctgaggaatcccaaccaatcaaattcct

SEQ ID NO: 10895 - protein, 435 aa, Panicum virgatum
  misc_feature: Ceres CLONE 1726031
  misc_feature (152)..(389): Pfam Name: FA_desaturase Pfam Description: Fatty acid desaturase
  misc_feature: SWISSPROT Homolog: EC 1.14.99.33 Delta(12)-fatty acid dehydrogenase
MAMASGVSSGPVLQLPSLRVPSSRLLPRRAAAGAPAGNLFVKRDVVYNRRSYHHFLPSKQRGGLQAAVLPVAPPILDDEETRKQMAEDFGFTQIGEELPDSVTLKDVMDTLPKEVFEINDIKAWTSVLISVTSYALGLFFIAKSPWYLLPLAWAWTGTAVTGFFVIGHDCAHKSFSRNKLVEDIVGTLAFMPLIYPYEPWRFKHDRHHAKTNMLIEDTAWQPVWQKEIESSPFLRKAIIFGYGPIRPWMSIAHWLIWHFDLKKFRPNEVPRVKISLACVFAFMAIGWPLIILKSGLAGWFKFWFMPWMVYHFWMSTFTMVHHTAPHIPFKSSDEWNAAQAQLNGTVHCNYPQWIEILCHDINVHVPHHISPRIPSYNLRAAYDSIKQNWGKYVNEANWNWRLMKTILTTCHVYDKERYYVPFDELSPEESQPIKF

SEQ ID NO: 10896 - DNA, 856 bp, Panicum virgatum
  misc_feature: Ceres CLONE 1726034
  misc_feature: Encodes the peptide sequence at SEQ ID NO. 10897
cagccacttcgaagcggcggcccaccacgcgcgtcctgcttcctcgcctcgccgccgcctcaggcgcagctgctcgccgtcgcggcgcgatcgccgtgtccagtagcggcggcgagagcacagcgaggaggaggaagcgaaccggcgccccgcaaaggctctagctcgtgagcttggcttcttcgatttgactggacgcgggagctgtgcctgtgcggccatatccacagtcctcacatggccgcctccgtcgcctcgtcggcgttatttctggcgccggcgccggcgtccaagaacggcacgggcgggtcgtccaaggacagcctggacatgcgtggggtcgccggaaacgcgggcgtggcgaggtcctcggcgaggttgcgcgccgccgtccccaaggtgagcggcggcggcaaggctgcggtgactgacggtgaggacgaggcggcccgcccctcggccccgaggacgttctacaaccagctgccggattggagcgtgctgctcgcggccatcacgaccattttcttggcggcggagcagcagtggacgctggtcgactggaagcccaagcggccggagatgctcatcgacacgttcggcttcagtgggcaggtattccggcaggacttctccatccggtcgtacgagatcggggccgatcggacggcatcgatagagacgcttatgaaccatttgcaggagacggcgctgaatcatgtcaagagcgctgggctgctgggcgatggctttggttcgactccggagatgagtaaacgcaacttgctttggggtgtcagtcaaatgcaggtcctggtggagcagtacccatgctggggtgatacagtgggcatag

SEQ ID NO: 10897 - protein, 206 aa, Panicum virgatum
  misc_feature: Ceres CLONE 1726034
  misc_feature (125)..(206): Pfam Name: Acyl-ACP_TE Pfam Description: Acyl-ACP thioesterase
MAASVASSALFLAPAPASKNGTGGSSKDSLDMRGVAGNAGVARSSARLRAAVPKVSGGGKAAVTDGEDEAARPSAPRTFYNQLPDWSVLLAAITTIFLAAEQQWTLVDWKPKRPEMLIDTFGFSGQVFRQDFSIRSYEIGADRTASIETLMNHLQETALNHVKSAGLLGDGFGSTPEMSKRNLLWGVSQMQVLVEQYPCWGDTVGI

SEQ ID NO: 10898 - DNA, 854 bp, Panicum virgatum
  misc_feature: Ceres CLONE 1726035
  misc_feature: Encodes the peptide sequence at SEQ ID NO. 10899
catctgctccctctgtttctcttctccaacctttcccttctctccgagagaaactctctcctgatctccccccttgctcgagatcttccttccctggcggcgacgactgggcgagcggcggcccagccctttgccggcaacgagcgcatcctccagaacaagaagaattatcgggtatacatgtgtacacccatgtcctatgctgggtccgcccctgaacccaagcataaccattgttatatttttcttatcaggctcacagaacacggtctttttatgttataaagctgcaatgaaggatgctcaggatattcagagcacgacagaattgcagtcatcagcacaaggtattaatgaagtgcagagtcaacaaccaaatgcaatggccactgatgctcctgcaggagattctggttccttgtcagtagcaagtaatgacaataagaaggtctctcgtgaagacattgaacttgtacagaatttgatagaacgatgtctacagctatacatgaacaaaggagaggttgttaggactctatctactcgtgcaagaatagaacctggcttcactaccttagtatggcagaaactcgaagaagagaactctgagttctttagggcttactatatacggttgaaattgaaaaggcagatcatcttgttcaatcatttattgcaacaccagtacaatttaatgaaatatccagtaccttcaagtgttccattggctccaatgcaaaatgggattcatcatatgccagttggcaatttacccatggggtatccagtacttcagcagcctataatgcctgctccaggccagcctcacatagacccaatgggctgtggtatgt

SEQ ID NO: 10899 - protein, 218 aa, Panicum virgatum
  misc_feature: Ceres CLONE 1726035
  misc_feature: Useful for making plants with modulated water use efficiency
  misc_feature: Useful for making plants with modulated drought sensitivity
MLGPPLNPSITIVIFFLSGSQNTVFLCYKAAMKDAQDIQSTTELQSSAQGINEVQSQQPNAMATDAPAGDSGSLSVASNDNKKVSREDIELVQNLIERCLQLYMNKGEVVRTLSTRARIEPGFTTLVWQKLEEENSEFFRAYYIRLKLKRQIILFNHLLQHQYNLMKYPVPSSVPLAPMQNGIHHMPVGNLPMGYPVLQQPIMPAPGQPHIDPMGCGM

SEQ ID NO: 10900 - DNA, 311 bp, Panicum virgatum
  misc_feature: Ceres CLONE 1726035-R
agatcaggaggacatagttgagtattttgctgatgccatcaacggatctcaatcagatgaagagaaaccacagtgatgctcttttttcatatcgtagccccgttcaggttcaggaaggactccaatctctcatgtagtgtaactttgctgcgatgctgcggcgaacctaactgtgttatcccccttcctccccacacaccaggtggggtaattccgtaattggcctttgccgctagagaatatttttagtagtggttaaaatcctaattctttggaataaacagttggttggtgtagccttttggctggac

SEQ ID NO: 10901 - DNA, 806 bp, Panicum virgatum
  misc_feature: Ceres CLONE 1726043
  misc_feature: Encodes the peptide sequence at SEQ ID NO. 10902
atttttacttccctcgtcggcaaaatttcacgcaccaggccgccactgccagcacaggaaaggaaaaaaaaaccaccccagaaaaaaaataaccgaatcaaacgcgtccgccgggaggccagaaatatagcgaggaaggaagggggatagcggcgagggggacgaacaagcggccgcgcagaaatggcgtcgatgcagagctggcgcaaggcctacggcgccatcaaggacacgaccaccgtcagcctcgccaacctcaactccgacttcaaggatctggatgtggcgatcgtgaaggcgactaaccacgtggagtgcccgcccaaggagcgccacctgcgcaaagttgttgcggcgacatccatcgccaggccacgagcggatgttgcctactgcatccacgctcttgcccgccgtcttgctaagacccgcaactggattgttgcactgaaaacacttgtagtgatccatagacttcttcgagagggtgatcctacatttcgagaagagcttcttaactttacacaaaggggacgaattctacaactttcaaactttaaggatgattccagcccaattgcttgggattgttctgcttgggttcgcacatacggtttgtttttggaggaaagattggaatgcttcagagttctgaagtatgatgtcgaagctgagcgtttgtccaaacagggtcaaggtcctgaaaagggacacagtagaactagagagttggattcacaggatctattagagcaattgccagcattgcagcagctattataccgacttgtgggatgccggcctga

SEQ ID NO: 10902 - protein, 207 aa, Panicum virgatum
  misc_feature: Ceres CLONE 1726043
  misc_feature (29)..(207): Pfam Name: ANTH Pfam Description: ANTH domain
MASMQSWRKAYGAIKDTTTVSLANLNSDFKDLDVAIVKATNHVECPPKERHLRKVVAATSIARPRADVAYCIHALARRLAKTRNWIVALKTLVVIHRLLREGDPTFREELLNFTQRGRILQLSNFKDDSSPIAWDCSAWVRTYGLFLEERLECFRVLKYDVEAERLSKQGQGPEKGHSRTRELDSQDLLEQLPALQQLLYRLVGCRP

SEQ ID NO: 10903 - DNA, 281 bp, Panicum virgatum
  misc_feature: Ceres CLONE 1726043-R
ccagtggtgaacaacggacatcagcaacataacccattcggtggtgcccgacttttgtaggccatagttacatgagcaaattcgtgccccggcaaatgcgatttttgtgtgattatatcatgcattgtgcttggccattattgtatgcgacccctgtatcatgtgttggcttcatcacacggggctgctgagttacccgatccttgttgtaaagaaattagtgacctgtgtagcaccaagtatatgtcaataaacagtaggacgtggttataattatagcg

SEQ ID NO: 10904 - DNA, 678 bp, Panicum virgatum
  misc_feature: Ceres CLONE 1726049
  misc_feature: Encodes the peptide sequence at SEQ ID NO. 10905
actaccagacgccgcgaccagaaggcagcagcaaccgaagcgcgcaggagccgagctaaccgtcgcacaccagcgcacgccgaaatggcgcgcgccgtgcgctctctgcctcgcgctggtctgcctcctggccgcgcactccgccgtggcgcagaagtccgccacccccgccccggccaccgcgccggccgccaccgccaccccgccggccccgtccaagaagacgcccgcgcccgccgcagctccgcccaccacctcccctgccaccccggccccggccgccgcgccgccaaccacccaggccacccccgcgcccgccgcggccccgcccactaccaccacgcctgcccacgccgtggcgccgcccaagtcctcccccaaggcggccacccccgccccggctcccaaggccaaggccaccccgcctgccaacccaccggtggccgagctgccccctgctgccacgccccccgcccccgccgcggacacccccgccgccgcgcccactaagcccgccgaggtccgagcccccgccccgtccaataagaagaatcaagaagtcatcctcctcgaagagcaaggagaataagagcaaggtcccagccccatcccgcgtcgccgatgcccccaccagctctaagcactccaaggcttaggcacccgcgtccagcgaggccg

SEQ ID NO: 10905 - protein, 195 aa, Panicum virgatum
  misc_feature: Ceres CLONE 1726049
  misc_feature: Useful for making plants with altered carbohydrate content
LPDAATRRQQQPKRAGAELTVAHQRTPKWRAPCALCLALVCLLAAHSAVAQKSATPAPATAPAATATPPAPSKKTPAPAAAPPTTSPATPAPAAAPPTTQATPAPAAAPPTTTTPAHAVAPPKSSPKAATPAPAPKAKATPPANPPVAELPPAATPPAPAADTPAAAPTKPAEVRAPAPSNKKNQEVILLEEQGE

SEQ ID NO: 10906 - DNA, 441 bp, Panicum virgatum
  misc_feature: Ceres CLONE 1726049-R
tctttcgattagctttcccctgcttggacgaaacactgctgcttataaaatgtcgggatgctcgcttgccctcaatgaatctgcggttttttcaagggacaagcggtgtcaatggcgtcgtaatggcgagaggtgtggtttgcggccaaatgctttccgggacgcagctggccgcctgctgtgtttttgcccgcagcgacacctgccagccaatcctcttgatatctacagcgcgtgtgaattgcgacgggccagctactacattgccatttgtcggtgtacgctagctacggttgctcgtgcaaatatcaagccattgagatgagaagtgtgcggtgcttcagcagttcaacgtggtcgcttaggtcacatctgcatggctgcatgtacacgacggcgggcggattgagaaatttgggaattggaacggcatgaagacac

SEQ ID NO: 10907 - DNA, 816 bp, Panicum virgatum
  misc_feature: Ceres CLONE 1726051
  misc_feature: Encodes the peptide sequence at SEQ ID NO. 10908
gaaaccgccccaatcaaaccccgcgcgtcgcgagccgcagcaaatggcgtgcgtcgccgcgctcctcgcctccccggcgctcctccccttcccgtccactgcctcatccacggccacgtcctcctgctcgtgccgcctccgctcccgccccgccgtcgtcgcccacgcgccgcgccagcagccgcgagggcggcgcgcgctccggcgcttcgatgaggtggaaggggtgtcgaagaagcggcgcggcatcggaggaggagccagcggcgctgcggggtcgcaggcatcgtcgccgcgcagggacagggggctcgccgtcgacttcaaggagtcgcaggttgctgagttggaagatcttgaagaggacaaattccttaatgctgttgtcaaggtctattgcactcatatcgcacccgattatggtctgccttggcaaaagcaaaggcaacattcaagcagtgggagcgcttttatgattggtgatggcaaactcttgacgaatgcacattgcgttgagcatgacacccaggtcaaagtaaagagaagaggagatgacaagaagtatattgccaaggttttagctaggggtatcgaatgcgaccttgcattgctgtctgttgagaatgaagagttttggaaaggaacagaggcactttcttttgggcgtttgccttgccttcaggattcagtaactgttgtgggatatcctcttggtggagacacaatatctgtaacaaaaggcgttgtatcgcgcattgaggtcactccatatgcacatgggacatcagaccttcttgggattcaaattgatgcagc

SEQ ID NO: 10908 - protein, 257 aa, Panicum virgatum
  misc_feature: Ceres CLONE 1726051
  misc_feature (117)..(255): Pfam Name: Trypsin Pfam Description: Trypsin
MACVAALLASPALLPFPSTASSTATSSCSCRLRSRPAVVAHAPRQQPRGRRALRRFDEVEGVSKKRRGIGGGASGAAGSQASSPRRDRGLAVDFKESQVAELEDLEEDKFLNAVVKVYCTHIAPDYGLPWQKQRQHSSSGSAFMIGDGKLLTNAHCVEHDTQVKVKRRGDDKKYIAKVLARGIECDLALLSVENEEFWKGTEALSFGRLPCLQDSVTVVGYPLGGDTISVTKGVVSRIEVTPYAHGTSDLLGIQIDA

SEQ ID NO: 10909 - DNA, 246 bp, Panicum virgatum
  misc_feature: Ceres CLONE 1726051-R
tgggggatcagtaccatacttctccccttgtgaggttcctacacgtaccgtagcggcaaagctgagtcatgttgtatgtttagaatagacaaaattcagaagtcataatttgtacggtaggagccatagagtgatttattcatcttcatttttcgggggtttataggaagctgagaaagggccgcacaatttgggccgtgagcaatcatgttttttcgggacacgtcgtccagaaattttgttggt

SEQ ID NO: 10910 - DNA, 779 bp, Panicum virgatum
  misc_feature: Ceres CLONE 1726053
  misc_feature: Encodes the peptide sequence at SEQ ID NO. 10911
atttgtcacctgggaacccgtacactgagcacgctccagtcgctcacgcgggctatggaggaggccgcagcaagggagcggaagaggccgcgcgagggcgacgcggctccttccgccgcggcggcggcgggggcggggaaggcgcagtacgtgtacctgcccgtcgccgacgccctcaaggcccccggcgccagggtcttcctcttcgccgccgtctccgagatcggcgccgccgtccgcagccgtggcacggatttcactcttacattgagggttgcagatcaatcacgtccagctgggatctctgtaacattttttgctgacaatgtcgccttgttgccctgtgttaaggcaagcggagatgtgatcagtcttcataatgtcgtgataacaatgcatggagaattttttgttacatttaacaagaaattttcttcattcgccctatttgagggcaaggtatctacagagtgcagcccatatcagacttctacaaaatattatgggacccaatatgataatgaacttttgacccagatgagaacgtggcttgcttataatcctccaggtctgaaagatcttgaattgcagttaaggagtttaaagtccgatactacttttgatttagtatgcaaggttcttcatgtctatgaaaataacggtgaatggatattttatgtttgggatggaactgatacccctgcagctgagtttcaggcaattttggatgctgaggcggttgagtcatcccctttacatctggaaggagtgcctctacc

SEQ ID NO: 10911 - protein, 241 aa, Panicum virgatum
  misc_feature: Ceres CLONE 1726053
  misc_feature (64)..(167): Pfam Name: Telo_bind Pfam Description: Telomere-binding protein alpha subunit, central domain
MEEAAARERKRPREGDAAPSAAAAAGAGKAQYVYLPVADALKAPGARVFLFAAVSEIGAAVRSRGTDFTLTLRVADQSRPAGISVTFFADNVALLPCVKASGDVISLHNVVITMHGEFFVTFNKKFSSFALFEGKVSTECSPYQTSTKYYGTQYDNELLTQMRTWLAYNPPGLKDLELQLRSLKSDTTFDLVCKVLHVYENNGEWIFYVWDGTDTPAAEFQAILDAEAVESSPLHLEGVPL

SEQ ID NO: 10912 - DNA, 841 bp, Panicum virgatum
  misc_feature: Ceres CLONE 1726055
  misc_feature: Encodes the peptide sequence at SEQ ID NO. 10913
ataccatatccatcttcaattctccatccatcaagtgaagttcagcgcaaatcaccccgatgccgagcatggcggcgccattgctctgcctggcgctgctcctggcgtccggcgccgccgccggcgcccaagctctcaaagactacccacaggtaaagttcagcaccgcgtcggcgacgccggagaagtacaacacctttatcgccgctgtccgcgccgcgctggtgagcaaagctggggggaagagcaacgggatccccgtgctgctcgaccgggacgacccgctcgcgcttcaaacctacctgaacatcactctgacgaactcggcggggcattcgatcagcctgaagatggatgtcaccggagcttacttcaccgcctacgtggcgtggaagtactcgtgcctgctcaaacgatccggccgggcattctcgtcggcgatctgctattccgatgatccatggtcgagctcagctgccattgctgcggcgctgcagtactccgccggcgtcgggagaggcggcggcggcggctatcctgctgcaggccgccaggatcttggagccgccgcgacatggcgggcgaaggatctggaccaggccgtgtcgtcgctgttcctgttccccactggcaacgccaccaaggaggacgtgggccgcgccgtcgccgcctgcgacatgatgatcgcgggcgcggcggcgttcccgtacgtccagcggcggggtgagcgccggcatgcgggacggcaacggcgtccccgacgacccgagcctgcacggcctccaggcgcgctggccggcgctctcccgcgcgggtcaggagtccttccagggcgccttcc

SEQ ID NO: 10913 - protein, 257 aa, Panicum virgatum
  misc_feature: Ceres CLONE 1726055
  misc_feature (26)..(256): Pfam Name: RIP Pfam Description: Ribosome inactivating protein
  misc_feature: SWISSPROT Homolog: EC 3.2.2.22 rRNA N-glycosylase
MAAPLLCLALLLASGAAAGAQALKDYPQVKFSTASATPEKYNTFIAAVRAALVSKAGGKSNGIPVLLDRDDPLALQTYLNITLTNSAGHSISLKMDVTGAYFTAYVAWKYSCLLKRSGRAFSSAICYSDDPWSSSAAIAAALQYSAGVGRGGGGGYPAAGRQDLGAAATWRAKDLDQAVSSLFLFPTGNATKEDVGRAVAACDMMIAGAAAFPYVQRRGERRHAGRQRRPRRPEPARPPGALAGALPRGSGVLPGRL

SEQ ID NO: 10914 - DNA, 675 bp, Panicum virgatum
  misc_feature: Ceres CLONE 1726061
  misc_feature: Encodes the peptide sequence at SEQ ID NO. 10915
agtagcaaagctagcccacttttccttgagaggacggagctctttttttaaaggcagcaagcccaaccaaacccttctccttcgagaggtcgccgaggagagctgcgcctgcgagggaggaggaggagcttcggaggggaagaagaagaagaagaagaagaagaagaagagggggggagccatgctggaccatctcgtcgggctggtgagggtgcgcgtgctcaggggggtgaacctcgccatccgcgacctccgatctagcgacccctacgtcgtcgtccgcatcggcaagcagaggctgaggacgaaggtggtcaagaagaacaccaacccggaatggaacgaggaactcaccctctcgattgaagaccctgcacatcctgtcagactggtatgcatgcatccccttccgtctcatttccccctttctttcctgaatccgttatcttgttttttttctttttacccctactcctccttcgaactcttaagaaagaaattcagaaccatgcatgagtagcacaaggaattagtttactgctccaccttgcacacatgacatttttattataagttatacattattaccgggctttctcgatattttcagtttgtacttgtagttgtacgaagcattccatagccatgcttctttgctactccctccttccctgt

SEQ ID NO: 10915 - protein, 112 aa, Panicum virgatum
  misc_feature: Ceres CLONE 1726061
  misc_feature (9)..(86): Pfam Name: C2 Pfam Description: C2 domain
MLDHLVGLVRVRVLRGVNLAIRDLRSSDPYVVVRIGKQRLRTKVVKKNTNPEWNEELTLSIEDPAHPVRLVCMHPLPSHFPLSFLNPLSCFFSFYPYSSFELLRKKFRTMHE

SEQ ID NO: 10916 - DNA, 614 bp, Panicum virgatum
  misc_feature: Ceres CLONE 1726061-R
gatgtgcgcacgcgcgctcacacacaccccgtgattgtaattgtattaaccagctctctctcttaaagagagaaatggatgctcatattctcggttatcatgcattgacagtgatgcttctttctcaatctccaggaagtgtttgacaaggacacattcgtcgatgattcgatgggtaccgcagagctggacatccgcccgttggttgaggtcgtgaagatgaagctccaggatgttgccgatggaactgtggtaaagaaactggtgcccaacagacagaactgcctggccgaggagagctccatttacatctccgaggggaaggtgaagcaggacctggttatcaggctgaagaacgtggagtgcggggagatagagctccagcttcagtgggtcgacctccctggttccaagggtgtatgagctccgctctgccctgctgatctcaggggttctcgagtgaaagtaaagttcatgtgacgaatgtaaatgtaatctaaggatggttatggtacagcaagtgctgaactgctgattaggattttttatgttcttttatgattgtatataaggggttgtttggatctgtgttttgtgaaaaccagatttcatag

SEQ ID NO: 10917 - DNA, 2736 bp, Panicum virgatum
  misc_feature: Ceres CLONE 1726065
  misc_feature: Encodes the peptide sequence at SEQ ID NO. 10918
acgttcacgactccgattcaaacgccggaaaggcaacagcgctgccgtcctcgccaactccaacccgccatcgcaaggactcccgtcagctgccatgcgccgccgccccggccgcaccattgccgccgcgcccagtggcttcctccacctttccctcctcgcctccctccgccgccacccttccctccaggcgcacgcgcagttgctgctcctcggcctcccgctcccgcccgccgccgcctcccgcctcctccgcccgcacctccgcgccggccacccgctctcctccctccgcctattcctccgcgtgcttcgcgaccatcagccctccgcaaccagcgccaccgcctcccaggagcaggaggccgtccccaactcccactccctctcggcagcactcgcggcctgctcccgccacgactccccttcccccggcttctgcatccacgccttcctcctcaaatcgggattcgcctccgacatcttcgccacaaactcgctcctccatttctacgcctcattcggtctccactcccttgcgcgcaagctgtttgacgaaatgccggcgagggacaccgtgtcgttcaacactctgatcgattcgcacgtgcagtctggaagtattgacggcgcgtttggggtgttcaggaatatggtgcggggagggttccggctggatggatggaccatcacagcgttgctgggcgcatgcgctgagttacgcgatttgatggtggcaaaagctgcacatgaggttgccaggagagtactgaggctgaaattgttcaactctggagatgtggtaattgggttagtggacatgtatgtgaagtgtggggcagtgcagctcgccaggaaggtgtttgatttgtccgaggagaaagcaaagggtgtgaggatttggagtgtaatgttgtcagggtatgcgagggctggggaaattgacgtggctcaaaggttatttgatgagatgcccaataaggatttggttgcatggacagttttgattggtggatatgtgcaggcaggtagatacaatgaggcacttcggttgtttgaggagatggaagcgacaggacttgaggctgatgaggtgacagttgtcacagtgctttcagcttgtctccagcatggtgcgattggtctggcaaaaaggcttcatcgtcatatgaaccagaatggactgattagcagaaatgcaagagtcgccaccagtttcgtgcacatatatgcaaagcatgggtgcatacagacagctatggatgtgtttcgtggagttagtgatgaattcaagaccgtcgagttgtttaatgctatgatacatggacttgctcaccatggttatggcgacaaagctgtttcacttcttgatgaaatgaaatcactggggctccatcctgatgagaccacttttgtgggtgccttgtgtgcatgcagtcgcagttgcttggtcatgcaagggcgtgaaatgttcaattcaatgttggacaagtacggtgtcaaaccagatgccaagcattatgcttgcatggttgatctccttggaagagctggacagcttgacgatgcttacagatttatccaaaatatgccttgtgaagcaaatcatgtgatatggtcatctcttctgacagcttgcaagatccatggaaataacaagattagaaagcttgcggagaagcaacttctcaaattagatactagctacaagcctgaaaagctaattttatctggtttattttctgatgagaagaggaaagaggtagctgcaagggtgagaaaggttataaggcgcaaatctgagcacaggcaaacccgctaaaaatggcatggaatgtttaggtttgaagacccaagaccctaaggtcggtgttccccaggaagaaggcataactgttctcgaagagtaacttgagtaggctttcaaagaaggtgatggccaaccacaaggaaagctaacatttttgcttatttcttcacctcttgctctcagtataacttatgatcagagccttcctggatatgtgaactatcaaggccaactcaaggtagggcataagtgatcatgggaaaggaacagtgcaaggttgatggttcgaagacttatgttttgaagtttgatatgcactgccaatgcaatggttgtatcaagaagatcaatgatggggtgaaagaaattagcctttccgaagaggtggagagggctgatcttttaatagagacaggagaggtgacagtttctgggagaatggaccctgagaaactctgttctctgttgcatggggtgacaaagaagtgtgtggaaatagttactcaaagcacccaatctgaaggacacactgcatcatctcagcaaaacaagaacgtatatcgtcaggcgcctcctgccttccccgtaaccccgagcgccccgccgttgccggaggaggcatggagcagcgggacggtgccttcagatcgatgctggtaccggtggtcggcgccctcgagctcgtacggcgtgtggactgcatcggacatcgccgcgacgctggccatgtacgagctctgagctgcatatccgcacctgcccacagatgctgttgatggaccagttgcttgcttgcttgcttcatagactgatgggtttgtgactttgaaagatgtgggatggttctgttttgcttcgtcgcagcatctgtaactactgtataatctaaatttcttttaaggatgagtgaggcttagtagtagtct

SEQ ID NO: 10918 - protein, 575 aa, Panicum virgatum
  misc_feature: Ceres CLONE 1726065
  misc_feature (299)..(333): Pfam Name: PPR Pfam Description: PPR repeat
  misc_feature (403)..(437): Pfam Name: PPR Pfam Description: PPR repeat
  misc_feature (162)..(196): Pfam Name: PPR Pfam Description: PPR repeat
MRRRPGRTIAAAPSGFLHLSLLASLRRHPSLQAHAQLLLLGLPLPPAAASRLLRPHLRAGHPLSSLRLFLRVLRDHQPSATSATASQEQEAVPNSHSLSAALAACSRHDSPSPGFCIHAFLLKSGFASDIFATNSLLHFYASFGLHSLARKLFDEMPARDTVSFNTLIDSHVQSGSIDGAFGVFRNMVRGGFRLDGWTITALLGACAELRDLMVAKAAHEVARRVLRLKLFNSGDVVIGLVDMYVKCGAVQLARKVFDLSEEKAKGVRIWSVMLSGYARAGEIDVAQRLFDEMPNKDLVAWTVLIGGYVQAGRYNEALRLFEEMEATGLEADEVTVVTVLSACLQHGAIGLAKRLHRHMNQNGLISRNARVATSFVHIYAKHGCIQTAMDVFRGVSDEFKTVELFNAMIHGLAHHGYGDKAVSLLDEMKSLGLHPDETTFVGALCACSRSCLVMQGREMFNSMLDKYGVKPDAKHYACMVDLLGRAGQLDDAYRFIQNMPCEANHVIWSSLLTACKIHGNNKIRKLAEKQLLKLDTSYKPEKLILSGLFSDEKRKEVAARVRKVIRRKSEHRQTR

SEQ ID NO: 10919 - DNA, 1959 bp, Panicum virgatum
  misc_feature: Ceres CLONE 1726071
  misc_feature: Encodes the peptide sequence at SEQ ID NO. 10920
aaatccgggggcagagaggggagaccggggaagaaaaactcgaagacgcagccgacgagctccgccgccggaactcagagatggccgacggaagcgcctccgcctcgccgtcctccgcttctccgcaccagcaccatcgagatgccatcaagtcctcagtgcacaattcagcatctagccggaggagggaacatgctattgcagtagggaaggaaaaaagagaagccttgatgcgtgcaaagcgtgtatgtcgagctcctctttctggcagtgacgagactgtaatggaagagggtgatatggttattgatgaggagaaagcaaatcttgaagcccagacggctcaagctgttgaagaattgaaatctgctttatcaacccagggaaaaggagctcagaagaagaaaatagaagtgcttcgtgctttaagacgtttgttgtcacagtctgaagtacctcctgttgaagcagcaattaaagctggagcaatacctcttctagtgcagtatctgtcatttggatcatcagatgaacagttgctggaggctgcttggtgccttacaaacatagcagcgggggaaccagaagaaactaagtccttactgcctgctctaccattgctcattgctcaccttggtgagaagagctccacacttgtcgctgagcaatgtgcatgggccattggtaatgttgctggtgaaggagcagacctgagaagcaaattacttgctcaaggtgctttgtggccccttgctcgtttaatgctgtcaaacaagggttctacagcaaggactgctgcttgggcattgtcaaatcttatcaaggggcctgatcccaaggctgcgaatgagcttattagcattgatggtgtgctgaatgcaatcatacggaacttggagaaagcagatgaagagctagcaactgaggtggcgtgggtagtggtttatctttcagcactttcagaaaaagctaccagcctaatagtaagaagttcggtgcctcaattgctgattggacgcctcctatcatctgagaacttacagttactcattccggtacttcgcagtttaggaaatcttgtagccggtgatggatacatggttgattcagtcctaattgttggaaacagtatcacagatcaagccttatcaagtcttataaaatgtttgaagagtgacaatagggttctcaaaaaggaggcatcatgggccatgtcaaatattgcagcaggcagtttcgagcacaagaaattgattttcgccagtgaggcaatgcctttgctgatgcacctcctcatgactgcacaatttgacatccgcagggaagcagcatacactctgggcaatctgtgtgttgtcccagcaggaaatgctgggcccccaaacataatcgtggatcatttggccgctatcgtaaatgatgggggccttcctgggtttataaatttggtgagatctgctgacatagagagcgcaaggcttgggcttcagttcctggaactggtgatgaggggataccccaatgggcaaggtccaaaactcgtggagagggaggacggcatcgaggctatggagagatttcagttccatgagaacgagctgatgaggaatttagccaacgggttggtcgacaaatactttggcgaagactatggcctcgattgagttcctggttccatccatacatcggagtaaacttgaagccaaatcctccgatacattaaaaatgtgaaatgcaatttcgcgatccctaaatggaagaatgtgcgaattggaatagtggccgtgtactttagcccttgatactggtgcatcggaggctgtagttggaaaatgtgagtgtgtaaagcgtgaactgactgtgacctatggatagtgcaagtaaactgtcgatatgcttgggcatgttgtacgatagtcaaatagaagtgctgaaataaagtggacctgctgtttcccc

SEQ ID NO: 10920 - protein, 527 aa, Panicum virgatum
  misc_feature: Ceres CLONE 1726071
  misc_feature (124)..(165): Pfam Name: Arm Pfam Description: Armadillo/beta-catenin-like repeat
  misc_feature (208)..(248): Pfam Name: Arm Pfam Description: Armadillo/beta-catenin-like repeat
  misc_feature (385)..(425): Pfam Name: Arm Pfam Description: Armadillo/beta-catenin-like repeat
MADGSASASPSSASPHQHHRDAIKSSVHNSASSRRREHAIAVGKEKREALMRAKRVCRAPLSGSDETVMEEGDMVIDEEKANLEAQTAQAVEELKSALSTQGKGAQKKKIEVLRALRRLLSQSEVPPVEAAIKAGAIPLLVQYLSFGSSDEQLLEAAWCLTNIAAGEPEETKSLLPALPLLIAHLGEKSSTLVAEQCAWAIGNVAGEGADLRSKLLAQGALWPLARLMLSNKGSTARTAAWALSNLIKGPDPKAANELISIDGVLNAIIRNLEKADEELATEVAWVVVYLSALSEKATSLIVRSSVPQLLIGRLLSSENLQLLIPVLRSLGNLVAGDGYMVDSVLIVGNSITDQALSSLIKCLKSDNRVLKKEASWAMSNIAAGSFEHKKLIFASEAMPLLMHLLMTAQFDIRREAAYTLGNLCVVPAGNAGPPNIIVDHLAAIVNDGGLPGFINLVRSADIESARLGLQFLELVMRGYPNGQGPKLVEREDGIEAMERFQFHENELMRNLANGLVDKYFGEDYGLD

SEQ ID NO: 10921 - DNA, 3083 bp, Panicum virgatum
  misc_feature: Ceres CLONE 1726072
  misc_feature: Encodes the peptide sequence at SEQ ID NO. 10922
aggcggtttcaggccagcccccgcgcgccgcgccctggtgggcgccgcacgggctcgaccggaggaggagcggggagcagcggtccgggcgagcgggtggagctcccggatcgatcggggaagtcgccgccgacgcgaggagccgaccccgcgcgcgcgcgcccgggtggttggttgatccctcggcctccatccatgcccgtggcggccggaccagttcgtccgtcgagccgggatcgctgctgctaaggcagaggcgcagaaggaagcggaagcgttagccacgccaccacccacgcggacggcagtaatggacggccaccacttgcccccctcccaacaaccgccgccggcgcagccggagcggcgcagcagcttcaactacgacatcgagagcacggacgccgcatggcgcggcacgcacacggcgtcggaggcgctgatgcggtatgacgacgacggcccgcgcgagccgctgctgcggaagcgcaccacgaacactacctcccagatcgccatcgtcggcgccaacgtctgccccatcgagagccttgactacgaaattgtggaaaacgaccttatcaagcaagattggcgatcacgaaagaagcagcaaatattccagtatattgttctgaaatggtccctagttcttctcattggcttgtgtacgggacttgttggcttcttcaacaaccttgcagttgaaaacattgctgggttcaaactgttgctcacaagtgatctaatgctccagaagaggtacttcacagcctttctggcatatggaggctgcaatttagtcttggcagccagtgctgcagcaatctgcgcttacatagctcctgctgctgctgggtctggtatccctgaagttaaagcataccttaatggaattgatgcttacgctatattagctcctagcacactctttgtgaagaactcccattcaaggactactaggccatatgaagctgaatcgacaggcttttttttatacttggagagcagccatactaccttgagctacaacaaattcaaaagagtgtcattgctgatatttggttcaatacttggagtttcatctggatttgtacttggaaaggaaggtccgatggtacatacaggagcatgcattgctaacttgcttggtcaaggggggtcacgcaagtaccatcttacatgtaactggctcagatattttaagaatgacagagataggcgggatttgattacttgtgggtctgctgctggtgttgcagcagcattccgtgcacctgttggtggtgtgctctttgctcttgaggaagcagcatcatggtggcgaagtgctctcctatggagaacattttttacaactgctgttgttgctgttgtattgaggggcctgatcgggttctgccgtagtggaaaatgtggtctctttggtcaaggagggttgattatgtttgatcttagtgcaaccatacctacttacagtgctcaagatgtcgttgcaattattgttcttgggatcatcggaggggtctttggaggcctgttcaactttctcttggataagattctccgtgcctacagttttatcaatgagaaaggtgttccatacaagatccttcttacaatcacaatatcgattatcacatcagcatgctcgtatgggctcccttggctcgctccatgcactccatgcccagctgatgctgtggagcaatgcccctccattggacgctctacaaactataagaattttcagtgcccaccaggtcactacaacggtcttgcatcacttttctttaacacaaatgacgatgccatacgcaatctgttcagcagtggtaccgagaaagaattccaaatgtcaactctttttgtctttttcactgccatttactgccttggacttgtgacgtacggtattgctgtcccatctggtcttttcatccctgttatacttgctggggctacatatgggcgcatagtggggacgctgcttggtccaatatcagaccttgatcctggactctttgcacttctcggtgcggcatctttccttggtggaacaatgaggatgaccgtctcagtttgtgtgatacttctggagctcacaaatgacctccttatgctaccgttggtcatgctcgttcttctgatatcgaagactatagcggacagcttcagcaaaggagtttatgaccaaatcatagtgatgaaaggaatgccgttcctggaggctcatgccgaaccatacatgaggcacttggttgctggtgatgttgtatctggaccactgatctccttttcaggcgttgagagagtgggtaacattgttcaggcgttgaggatcacaggccacaatggatttcctgtggtggatgaaccacctctatcagaggctccagagctcgttggactcgtgcttaggtcccatctgctggtcctgctgaaaggcaagggcttcatgaaagataaggtgaaaaccagtggtagcttcgtgctgaaaaagtttggtgcctttgattttgccaaggctgggtctggataaggtccgaagatcgaagacctggatttcacagatgaggaaatggatatgtatgttgatctccatccaattacaaatacctcgccgtacacagtggttgagaccatgtcactcgcgaaggctgcggtccttttcagggcactaggattgagacatctgttggttgtgccaaagaccccagggagaccacctatcgtcggaatcctgacgaggcacgatttcatgccggagcacattcacgggctgttcccaaatgtccacaagtcacactgaggaagtatcaagcatatgttttgtttgctatttcttgccttgtagcttagctgtatgcagagaaagctgccttgtgcaatatttggtgcccccatctggcattttgtttaccatctggcattttgttttccctttcgtatttattacagagtactccaagatcttaaaactgtggaataatattgtattcgttgtaaagagctgatctcacacatcagcaattgaatggatttttgcagtccatcttatagattttcaataataacctggc

SEQ ID NO: 10922 - protein, 743 aa, Panicum virgatum
  misc_feature: Ceres CLONE 1726072
  misc_feature (165)..(621): Pfam Name: Voltage_CLC Pfam Description: Voltage gated chloride channel
MDGHHLPPSQQPPPAQPERRSSFNYDIESTDAAWRGTHTASEALMRYDDDGPREPLLRKRTTNTTSQIAIVGANVCPIESLDYEIVENDLIKQDWRSRKKQQIFQYIVLKWSLVLLIGLCTGLVGFFNNLAVENIAGFKLLLTSDLMLQKRYFTAFLAYGGCNLVLAASAAAICAYIAPAAAGSGIPEVKAYLNGIDAYAILAPSTLFVKNSHSRTTRPYEAESTGFFLYLESSHTTLSYNKFKRVSLLIFGSILGVSSGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIGFCRSGKCGLFGQGGLIMFDLSATIPTYSAQDVVAIIVLGIIGGVFGGLFNFLLDKILRAYSFINEKGVPYKILLTITISIITSACSYGLPWLAPCTPCPADAVEQCPSIGRSTNYKNFQCPPGHYNGLASLFFNTNDDAIRNLFSSGTEKEFQMSTLFVFFTAIYCLGLVTYGIAVPSGLFIPVILAGATYGRIVGTLLGPISDLDPGLFALLGAASFLGGTMRMTVSVCVILLELTNDLLMLPLVMLVLLISKTIADSFSKGVYDQIIVMKGMPFLEAHAEPYMRHLVAGDVVSGPLISFSGVERVGNIVQALRITGHNGFPVVDEPPLSEAPELVGLVLRSHLLVLLKGKGFMKDKVKTSGSFVLKKFGAFDFAKAGSG

SEQ ID NO: 10923 - DNA, 2056 bp, Panicum virgatum
  misc_feature: Ceres CLONE 1726076
  misc_feature: Encodes the peptide sequence at SEQ ID NO. 10924
gcaagcaaatgccgcgaagaggaggacgcgtgtagtagccgtcgcatactcgcatgtgaagcaggggccttgcccaattctcaagtagctgaaggagaaagaagaggccaggttgggcgatcgaggcggccggtcaggggatgggcaccgactcgccgtcgccgtcgacggcgccggtggccggcctcggggccaagggcgcggcgagggcggtggcgcagcaccaccaggccgtggtcgggttcctcctcggcttcttcctcgtcctgctgctctacaccaccgtttcctcccagttcggttcgcagaacgccattggtgtcctacagtctacgtcgacgtcgccggccgtgcgtacgggtcaaaacgccatgactccaacgtcgccatcgccgaagccgaacgacgtgaaaaaaggagatcatatcaaggaagacaataaagagcaacaaagcaatacacctaacaagatggaggaggatcgtacccaacatggtatcaatggaatcgaaaaggaaaatcaaactgaagccaaattggatgatgagaaagtgaaaaatccagagggaggtcaagcagcagtgaacgatgcaagaagtgacaggatggaggaggaagatcttatccggcaagaaatcgatcaaggcagcatgatcaagaatgataccaacatcggacaagttacgccacgcaagccaatctgcgacctctccgatcccagatacgacatctgcgagatctccggcgacgctcgcgccctgggagccaaccgcaccgtcctctacctcccgccggccggcgagcgcggcgcggacagccaggagtggagcatccgggaccagtcacgcaagtacctcgagttcgtgggcaacgtcaccgtcaggtcgctgaacgcctcccaggctgcggcggcgccggcgtgcacctcccggcacgccgtcccggccgtggtgttcgccatgaacgggctcacgtccaacccctggcacgacttcagcgacgtgctcatccccctcttcctcaccacgcgcgcgctggacggcgaggtccagttcctcgtctccgacctccagccgtggttcgtggacaagtaccggctcatcctccgcaacctctcccgccacgacgtcgtcgacttcaaccgggacggcggcgtccggtgctacccgcgcgtcaccgtcggcctccgcagccaccgcgacctcggcatcgaccccgcgcgcgcgccgcggaactacaccttgctcgacttccagctctacgtccgcgagatctacgggctgccgccgccgggcatcgacgtcccgtacaaggagcagcagcagcggaccatgccacggctgatgctgataaaccgtggccggacgaggaagttcgtcaacttcccggagatcgtcgcggcggcgcgggacgccgggttcgaggtggtgcccgtggagccgcgccgggacctcggcgtggaggagctcgcccgggcggtggactcgtgcgacgtgctcatgggcgcgcacggcgccgggctgaccaacttcttcttcctccggagcaacgcggtgatgctgcaggtggtgccgtgggggcacatggaacactcgtgcatggtgttctacggcgggccggcgagggagatgcggctgcgggacgtcgagtacagcatcgccgccgtggagagcacgctctacgataagtacggcgaggatagcccggtgatcagcgacccggagtcgatacacagacaagggtggcagtttgggatgaggtattactggatcgagcaggacatcaggctcaacgtcacaaggtttgctcccaccctgcaccaggtgctccagatgctcaaggaatagcaataggaggggggaattaaaagaaatatatggacagttagattattattacattacatccatgcttaattagaggggagatgtataggatgaagctttttacatttgttgtgatgatcatcattcgtcttctttctagattaatctgatggccaccaaaacctcccaatatgtgtgaacagattaccaaataaagaagattgtttccc

SEQ ID NO: 10924 - protein, 568 aa, Panicum virgatum
  misc_feature: Ceres CLONE 1726076
  misc_feature: Useful for making plants with altered carbohydrate content
MGTDSPSPSTAPVAGLGAKGAARAVAQHHQAVVGFLLGFFLVLLLYTTVSSQFGSQNAIGVLQSTSTSPAVRTGQNAMTPTSPSPKPNDVKKGDHIKEDNKEQQSNTPNKMEEDRTQHGINGIEKENQTEAKLDDEKVKNPEGGQAAVNDARSDRMEEEDLIRQEIDQGSMIKNDTNIGQVTPRKPICDLSDPRYDICEISGDARALGANRTVLYLPPAGERGADSQEWSIRDQSRKYLEFVGNVTVRSLNASQAAAAPACTSRHAVPAVVFAMNGLTSNPWHDFSDVLIPLFLTTRALDGEVQFLVSDLQPWFVDKYRLILRNLSRHDVVDFNRDGGVRCYPRVTVGLRSHRDLGIDPARAPRNYTLLDFQLYVREIYGLPPPGIDVPYKEQQQRTMPRLMLINRGRTRKFVNFPEIVAAARDAGFEVVPVEPRRDLGVEELARAVDSCDVLMGAHGAGLTNFFFLRSNAVMLQVVPWGHMEHSCMVFYGGPAREMRLRDVEYSIAAVESTLYDKYGEDSPVISDPESIHRQGWQFGMRYYWIEQDIRLNVTRFAPTLHQVLQMLKE

SEQ ID NO: 10925 - DNA, 846 bp, Panicum virgatum
  misc_feature: Ceres CLONE 1726081
  misc_feature: Encodes the peptide sequence at SEQ ID NO. 10926
gagacaacagcaatgaagcagaaagtaataacttagattgtgttgacaaagtgactcttcttgaaaataaggttcagcctgagccagtaaaagacagtgtttctgatctctgtacactattgcctcgttcatcttctgatcctgagtttgaggggcctgctgatgctgaatttgatgctaagactgctctgaagatatgctcaccagaggaatatgaacaacttaaatctgagaagaccaatctggaggtagaactagtgaagtgcaatgacataatagaagaaacaaaggttagattaagtgatatggagaaaaacttggaagacctcacagccaagttggctgacagtgagaaatcaaatagtttgagtgagacacagttgaagtgtatggctgaatcctacaagtcacttgaatcgagaaaagttgaattagagaatgagatagaagtattgcggtccaacatagatactttgacagctgaactgaccgatgaaagacaaagtcatcgggaggacttagctaaatacaaagacctcgaggagaagatggaaaggtatgagttggagaggagttcaatgtttgtagatgaggatccggataccaattcaaagcaggagaaagagatagaggctgcagcggagaagcttgcagagtgtcaggaaacaatactgattctcggccgtcagctgcaagctatgcgtccttcagctgagtctttaggttcttcacctaaccggcaacgtatggaagactttctgcaggatgctgtaggaacaaccgcaggagagtcttcccagaagccggcaggccaacctgatacagaccaggaaaatcctgggggca

SEQ ID NO: 10926 - protein, 281 aa, Panicum virgatum
  misc_feature: Ceres CLONE 1726081
  misc_feature: SWISSPROT Homolog: EC 2.7.11.1 Non-specific serine/threonine protein kinase
DNSNEAESNNLDCVDKVTLLENKVQPEPVKDSVSDLCTLLPRSSSDPEFEGPADAEFDAKTALKICSPEEYEQLKSEKTNLEVELVKCNDIIEETKVRLSDMEKNLEDLTAKLADSEKSNSLSETQLKCMAESYKSLESRKVELENEIEVLRSNIDTLTAELTDERQSHREDLAKYKDLEEKMERYELERSSMFVDEDPDTNSKQEKEIEAAAEKLAECQETILILGRQLQAMRPSAESLGSSPNRQRMEDFLQDAVGTTAGESSQKPAGQPDTDQENPGG

SEQ ID NO: 10927 - DNA, 466 bp, Panicum virgatum
  misc_feature: Ceres CLONE 1726081-R
cattcgctaaccaccagttgccagagaaacagagccgcggattcagtcgtttcttcacaaagggcaaagagtaaaaatttctccttgttgcctcatcagatttgttgattagtgacgccgaatgggtgggatggtggaggcccttaatttctgtagagctagtggggcaagcctgcttgtgtattctcacaggtgacgccgtgggttgctggaataatactcagcttgcagtccagcaggttgtgggcgtggcgagagtgtgtgtgggaatgtaagccatcggtatcttctgctagagcttgtccgggctgccgtgtgtttgctcacaaaaacctcactgtacatgtgcttacttggctgaagaagagcatggttgttggtttgtgttgaatgctctttgtgaagtagcctgtgtgccttggactggtttttggtacagttaatctgggttaattacttaaatgtc

SEQ ID NO: 10928 - DNA, 1319 bp, Panicum virgatum
  misc_feature: Ceres CLONE 1726082
  misc_feature: Encodes the peptide sequence at SEQ ID NO. 10929
gtcaaatccagcgcaagcacgccgaaaaccccactcaagaagcacacacgcccatccgaggaacaatccagagtccagtcctgtactcgagtccatgggtgccggcaacggaggagatggcggcgccgaggaggcggcggcggagcccgtcgtgctgaagatggagctgcattgcgccggctgcgcgcagaaggtcaagaaggccatcaagcgcgtgcctggtgtggagtcgatcgtggcggacgcggcggcgaacagggtcgtcgtggcggggacggccgacgcggcggcgctcaaggcgcggctcgaggccaagaccaagaaggccgtggagatcatctccgccggcagcggccccaagaggcccgcccccgccgcggagcccaaggacgccggcgccggggagaagaaggcggacaaggacgcgagccccaaggaggagaaggagaagaagcaaccgccggaggagaagaaacccaaagaggagacggtgctgctcaagatccgcctccactgcgacggctgcgccgaccgcatcaggcgacgaatctacaagatcaaaggggtgaaggatgtggtgatcgacagcaatgccaaggacgaggtgaaggtcaggggcacgatggacatccccgccatgctctcctacctcaaggagaagctcaaccgcgacgtggaggccgtggcgcccgccaagaaggacggcggcgagggcaaggacgacaagaaggacaagggcggcgacggcgacaagaacaagggcgcggccccgggcggcgacgacaagaaggacaagggcaagggcatcgaggtggcggcggcgggtccgtcaacggcggccgccgcggcgttcatggcggcgccggcggggccgagcacgtaccacgtggcgccgccgcagggctacgtggcgtaccagcagggcccgccgccacacgccggctacggctactacccgccgtacccctactacggcaatgccgatggcatgggtcacgctcacgccaaccccagcggcgccgccacctactaccaccagcccgaggccagccagcagcaggcgtacccgccgtacccctaccgcttcgacatggcaccggcgccgcagctcttcagcgacgagaaccccaacgcctgctccgtcatgtgagcagagctcactgatccgtcgtcagcgttagtagcttttagccgggaaaaatctcgacatgtgcatattgccaatgaggatttagctagcatttagtctagagctctagagaagcatttctaatcgaattttgcttcatttgtttaattaattaatccttcccgttctc

SEQ ID NO: 10929 - protein, 351 aa, Panicum virgatum
  misc_feature: Ceres CLONE 1726082
  misc_feature (19)..(81): Pfam Name: HMA Pfam Description: Heavy-metal-associated domain
  misc_feature (133)..(198): Pfam Name: HMA Pfam Description: Heavy-metal-associated domain
MGAGNGGDGGAEEAAAEPVVLKMELHCAGCAQKVKKAIKRVPGVESIVADAAANRVVVAGTADAAALKARLEAKTKKAVEIISAGSGPKRPAPAAEPKDAGAGEKKADKDASPKEEKEKKQPPEEKKPKEETVLLKIRLHCDGCADRIRRRIYKIKGVKDVVIDSNAKDEVKVRGTMDIPAMLSYLKEKLNRDVEAVAPAKKDGGEGKDDKKDKGGDGDKNKGAAPGGDDKKDKGKGIEVAAAGPSTAAAAAFMAAPAGPSTYHVAPPQGYVAYQQGPPPHAGYGYYPPYPYYGNADGMGHAHANPSGAATYYHQPEASQQQAYPPYPYRFDMAPAPQLFSDENPNACSVM

SEQ ID NO: 10930 - DNA, 1870 bp, Panicum virgatum
  misc_feature: Ceres CLONE 1726086
  misc_feature: Encodes the peptide sequence at SEQ ID NO. 10931
ataatccccccgcattgctggcgccgggctacctcctccacttcccagccggaatccgcttccctcccccttcgttttgcttcgttccggactttcggtggtatgagcagcggctggtgaattggtgagacgatgaggaaggcgctgctgctgctcgtcctctgctgcctcgccgccgccagcgaggcggtggcggtggtgggggaggaggaggcggcgtcggcggagctggcggtagtggtggacccgtcgtggcggttcccgagccagcggctgcgggacgcctacgtcgcgctgcagacgtggaagcagcaggccatcttctccgacccccgcaacttcaccgccgactgggtgggccccggggtctgcaactacaccggcgtcttctgcgcgcccctgccgcgcgggaagcccggcgccggggagctcgccgtggcgggcatcgacctcaaccacggcgacatcgcggggtacctcccgtcggagctcggcctcctcgccgacctcgcgctgctgcacctcaactccaaccgcttctgcggcctcgtccccgccacgttccgccggctccgcgtcctcgtcgagctcgacctcagcaacaaccgcctcgtcggcgcgttccccgccgtcgtgctggacctctcggcgctcaagttcctcgacctccggttcaacgacttcgagggcgccatcccgccggagctcttcgaccgcccgctcgacgccatcttcctcaaccacaaccgcctgcgctccccgctcccggacaacttcggcaactcgcctgcctccgtcatcgtgctcgccgacaacagcttcggcggctgcctccccgcgagcctcgggaacatgtccgacacgctcaacgagatcctcctcatcaacaacgggctcgactcctgcgtcccaccggaggtcgggcttctccgggaggtgactgtcttcgacgtcagcttcaacgcgctcgtcggcccgctgccgcagcaggtggccgggatgcggaaggtggagcagctcgacgtcgggcacaaccgcctctcgggggccgtcccggaggccatctgcgcgctcccgcggctcaagaacctcaccatctcctacaacttcttcaccggcgagccgccgtcctgcgcgcgcgtcgtgccgcccgacggcgacaggcggaactgcctgcccaaccgccccgcgcagcgcacgccgcagcagtgcgccgcgttctactcgcagccgcccgtcgactgcgccgcgttccagtgcaagcccttcgtccctgttccgccattgcccccgccgccgccgccgccagcgtacccagggcccttgccaccggtataccccatgccatacgcatcgccgccgccaccttcacactaccgatgattcgttgatcggagaggcactatcatcttcaccttcctccgccgccctactggatggagacagcaaagttcaccgtcacaagtgtacgtggtcagtcattgttgcgattagatttctagcgttcttgattgatagctaccggcatatatagaaaattatgattatggtgcaaatatatctgttcttggcgtcgatcagtttgcgtcatggtgatggtgaaaaggattggagatggttggtgatggatggagggaacaatttgagcttcgattgattgctaattgggttgtgaataataaactgcttgagagagacaggttacgaggatgaggattggctggtgtgttggtgcgcacctgggcctggggtgtatagagaggcttgagctcgagttcttcagttaagctgctttcagttgagagtcgagagataagctttaagaccaagaaatgtatcctacttaactattctttcttttttttgtcac

SEQ ID NO: 10931 - protein, 416 aa, Panicum virgatum
  misc_feature: Ceres CLONE 1726086
  misc_feature: SWISSPROT Homolog: EC 2.7.11.1 Non-specific serine/threonine protein kinase
MRKALLLLVLCCLAAASEAVAVVGEEEAASAELAVVVDPSWRFPSQRLRDAYVALQTWKQQAIFSDPRNFTADWVGPGVCNYTGVFCAPLPRGKPGAGELAVAGIDLNHGDIAGYLPSELGLLADLALLHLNSNRFCGLVPATFRRLRVLVELDLSNNRLVGAFPAVVLDLSALKFLDLRFNDFEGAIPPELFDRPLDAIFLNHNRLRSPLPDNFGNSPASVIVLADNSFGGCLPASLGNMSDTLNEILLINNGLDSCVPPEVGLLREVTVFDVSFNALVGPLPQQVAGMRKVEQLDVGHNRLSGAVPEAICALPRLKNLTISYNFFTGEPPSCARVVPPDGDRRNCLPNRPAQRTPQQCAAFYSQPPVDCAAFQCKPFVPVPPLPPPPPPPAYPGPLPPVYPMPYASPPPPSHYR

SEQ ID NO: 10932 - DNA, 799 bp, Panicum virgatum
  misc_feature: Ceres CLONE 1726090
  misc_feature: Encodes the peptide sequence at SEQ ID NO. 10933
ggcatgtctctctctcggcattctcccttcctagcttagtttcgcttctcgcgatcgccatgggcacctcttcccgccgcaatgccaccacagcggaggcgctgcttcttgcactgatgctgtcgtcctcggcagcgcgggcggcggccgccgacccggggttctcgtgcggcccgtcgtcgccgtcgcggtcgctcccgttctgcgaccggtcgctcccggcggcgcggcgcgcggcggacctggtgtcccggatgacggtggcggagaaggtgtcgcagatgggggacgaggcggcgggcgtgccccggctgggcgttccgccgtacaagtactggtcagaggggctccacgggctggccttctggggccacggccttcggttcgacggcgccgtccggggggtcaccagcttcccgcaggtgctcctcaccgccgcctccttcgacgagggcctctggttccgcatcggccaggcgatcggccgggaggcccgggcgctgtacaacctggggcaggcggaggggctcaccatctggtccccgaacgtgaatatcttccgggacccgcgttggggccgcggccaggagacccccggcgaggacccggccacagccggcaagtacgccgtcgccttcgtccggggcatccagggcagctccgcggccggcggcgggggcgcgccgctgcaggcctcggcgtgctgcaagcacgccacggcctacgacctcgaggactggaacggcgtgcagcgctacaacttcgccgcccgcgtcacggcgcgggacctggccgacac

SEQ ID NO: 10933 - protein, 246 aa, Panicum virgatum
  misc_feature: Ceres CLONE 1726090
  misc_feature (79)..(245): Pfam Name: Glyco_hydro_3 Pfam Description: Glycosyl hydrolase family 3 N terminal domain
  misc_feature: SWISSPROT Homolog: EC 3.2.1.21 Beta-glucosidase
MGTSSRRNATTAEALLLALMLSSSAARAAAADPGFSCGPSSPSRSLPFCDRSLPAARRAADLVSRMTVAEKVSQMGDEAAGVPRLGVPPYKYWSEGLHGLAFWGHGLRFDGAVRGVTSFPQVLLTAASFDEGLWFRIGQAIGREARALYNLGQAEGLTIWSPNVNIFRDPRWGRGQETPGEDPATAGKYAVAFVRGIQGSSAAGGGGAPLQASACCKHATAYDLEDWNGVQRYNFAARVTARDLAD

SEQ ID NO: 10934 - DNA, 268 bp, Panicum virgatum
  misc_feature: Ceres CLONE 1726090-R
tggcagagacgagtgggagatcagcttcgaagcatgaggttatttcaggtatggctggagaaagcattccgatctacaggtgggtccagtgcaattctttggttattagtaactatacaggaattcaccagacaggtacatgacataagaacttaagttatttataatttatgattcatagttttgcctcgaaaaaaatgaggctgttacatgtaatttattatcaataagaatgtttaccagtgaaatgtaactaagtttaccagtc

SEQ ID NO: 10935 - DNA, 782 bp, Panicum virgatum
  misc_feature: Ceres CLONE 1726091
  misc_feature: Encodes the peptide sequence at SEQ ID NO. 10936
ctgattcgaaaaatagatattttgactttgacaagcttgctgaggttacctcaacagttacttataatctcaacaaaattattgatatcaattactatcctgttgacaccgcaaagagatcaaatatgcggcacaggccaattggcataggtgttcaaggtttggcggatactttcatattacttggcatgccattcgattcacctgaggctcagcagttgaataaggatatttttgaaacaatttactatcatgctctgaaagcttctgccgaacttgctgctaaagaaggtccttatgaaacatatgaaggcagtcctgtcagcaagggcattcttcaacctgacatgtggaatgtagtcccatctaacagatgggattggccatctctaagggagactatttctaaagttgggatcagaaattctcttcttgttgctccaatgcccactgcttccactagtcagattcttggcaataacgagtgctttgaaccctacacgtctaacatatacagtcgacgggttctaagtggggagtttgttgtggttaacaaacatcttcttcatgatctgactgaaatgggtatttggacccctactctgaaaaaccagataatatatgaagatggttctgtccaaaagatgacagaaatccaagatgatcttaaagcaatctacaagactgtctgggagatcaagcagaaaactttggttgacatggcggttgatcgtggatgctatattgaccagagccagagcctcaatgtccatatggagcaa

SEQ ID NO: 10936 - protein, 259 aa, Panicum virgatum
  misc_feature: Ceres CLONE 1726091
  misc_feature (1)..(259): Pfam Name: Ribonuc_red_lgC Pfam Description: Ribonucleotide reductase, barrel domain
  misc_feature: SWISSPROT Homolog: EC 1.17.4.1 Ribonucleoside-diphosphate reductase
DSKNRYFDFDKLAEVTSTVTYNLNKIIDINYYPVDTAKRSNMRHRPIGIGVQGLADTFILLGMPFDSPEAQQLNKDIFETIYYHALKASAELAAKEGPYETYEGSPVSKGILQPDMWNVVPSNRWDWPSLRETISKVGIRNSLLVAPMPTASTSQILGNNECFEPYTSNIYSRRVLSGEFVVVNKHLLHDLTEMGIWTPTLKNQIIYEDGSVQKMTEIQDDLKAIYKTVWEIKQKTLVDMAVDRGCYIDQSQSLNVHME

SEQ ID NO: 10937 - DNA, 277 bp, Panicum virgatum
  misc_feature: Ceres CLONE 1726091-R
gcacaaatggtctgttctctgaacaacccgtgaagagtgcctgggcgtgcggaagctagacggatccgcgctttctttgttcatgaccccaatattatacaaccggctgatgattggagttcaataaccagaaggaagtctgtgatgtaggttgagttatagattcccatgctgggaatgccttggtccccgaatactgctacctcccgcttgtgttgtactgaaatatttgggctgatgcccatcccatgtatatatatctactactgtcaatgtt

SEQ ID NO: 10938 - DNA, 2282 bp, Panicum virgatum
  misc_feature: Ceres CLONE 1726092
  misc_feature: Encodes the peptide sequence at SEQ ID NO. 10939
attttcatcttcctctctctctttccctgcggcatccaacccccacaggccgcagcgcctgggcggagcggcggcgactgcgtgggggctggggcggcggctcggaaaggcggagcggcggcggctgggcgagggctggggctggggctggggcggaggcggcgcggcccggcggcgggcagtgacggcgagcttccccgggcgctcgcccccgactgtggcgagctcccctgccgcttgtccttgcctccacggcgcgcaacagcagcgagcggcggcggcgcccacgacgacgggcgttcgggcatctgacaggttatcccaccatggatgggacatacgatggaagccctccatctaaacttcatacaagactgaggctttgggagttttctgactgttatatatttgaaccaattgatggccttgctgacttgttattgtcagttagccgatccaatggaacaatgaatctggttgaagcactgccgccgcgtggatcatcgacacctaaagttcaaatagtttatggtgtgataggagtgctcaagcttgcagttggatcatattttctggtgatcacagaccgtgattgtgtgggatcctacttgggacacgccatttttaaagtgacaggactaaaagttcttccctgcaacaatgcactcaacacaacttcagccgaacagaaaaaaatggaaagtgaattctcggaactcctggatgctgcagagaggactatcggccttcacttctcctatgatatcaaccttactctctctgcacaaaggctacatgaacttggtgatgaatataaatcacttcccctgtggagacaggcagaaccaagatttctatggaacagttacttgttggaacctctaattgagaacaagctgaaccagtacttattgccagtaattcaaggcagttttcaaaacataaatgcagaagttggctcagaaaaggtaaatgtgaccctgattgcacgtaggtgtacacggaggataggcactcgcatgtggagacgaggagctgatgcagagggttatgctgcaaactttgttgaaacagagcagataatgcagtcaaaaggatttacagcatcgtatgtgcaagttcgaggttctatgccattcttgtgggagcagattgttgatttgacatataaacctagctttgacattgttagacaggaggaggcgcctcgtgtgcttgagcggcactttcatgatttgcaaaagaaatatggagctgtcttggctgtagatcttgtcaatacaggtggcggtgaaggtcgcctccgtgaaagatatgcaaaatctattgaacctattctcagtgaagatgtaagatatgtgcactttgacttccacagagtttgtggtcatattcactttgaacgcctttctcagctgtatgagcagatcaaagactatcttaagaaacataggtacttccttataaatgataaaggtgagaaaattgaggagcagactggcactgtcagaacaaattgtatagactgtttggatcgcaccaatgtgactcagagcatgattgggagaaaaattctggagagccaactccaacggatagaagttcttggtgttaatgatacaataagcaaccacccagcctttgatacaaactacaaagttttgtgggcaaaccatggagatgcaataagcattcagtactccggaactcctgctctgaagggagattttgttcggtatgggaagcgaactactcagggaattgtgaatgatttgcggaatgcacttgctagatactacttgaataactttgttgatgggactaagcaggatgccatggaccttcttcaagggcattacatgacatctgttagtcgagacatggcagtgccaagaaaaggaggacttctagagagttatgcgtccttccgccttgcttttgcattggttatgggagctctgatgttcatgatgatgtcactaagacatgcccggactgatgttcaccacttgttgctgtcacttctgtgggctggtctttgtattggtatcacacattttgtcagagccaatggtcgaacattcactaatcgacctcggtttcaccagtcacgccattgataggtgcaaagcaatcatttggctcatcaagtgagattgtcatcattcatcaaacttggtgatgcattggtttgtgaagaatatgtattgcatgtttttgcacgcaaacactttgtaataagttttcttccattttgtaacaagcttttgtttccttctctc

SEQ ID NO: 10939 - protein, 597 aa, Panicum virgatum
  misc_feature: Ceres CLONE 1726092
  misc_feature (67)..(361): Pfam Name: Syja_N Pfam Description: SacI homology domain
  misc_feature: SWISSPROT Homolog: EC 3.1.3.36 Phosphoinositide 5-phosphatase
MDGTYDGSPPSKLHTRLRLWEFSDCYIFEPIDGLADLLLSVSRSNGTMNLVEALPPRGSSTPKVQIVYGVIGVLKLAVGSYFLVITDRDCVGSYLGHAIFKVTGLKVLPCNNALNTTSAEQKKMESEFSELLDAAERTIGLHFSYDINLTLSAQRLHELGDEYKSLPLWRQAEPRFLWNSYLLEPLIENKLNQYLLPVIQGSFQNINAEVGSEKVNVTLIARRCTRRIGTRMWRRGADAEGYAANFVETEQIMQSKGFTASYVQVRGSMPFLWEQIVDLTYKPSFDIVRQEEAPRVLERHFHDLQKKYGAVLAVDLVNTGGGEGRLRERYAKSIEPILSEDVRYVHFDFHRVCGHIHFERLSQLYEQIKDYLKKHRYFLINDKGEKIEEQTGTVRTNCIDCLDRTNVTQSMIGRKILESQLQRIEVLGVNDTISNHPAFDTNYKVLWANHGDAISIQYSGTPALKGDFVRYGKRTTQGIVNDLRNALARYYLNNFVDGTKQDAMDLLQGHYMTSVSRDMAVPRKGGLLESYASFRLAFALVMGALMFMMMSLRHARTDVHHLLLSLLWAGLCIGITHFVRANGRTFTNRPRFHQSRH

SEQ ID NO: 10940 - DNA, 1808 bp, Panicum virgatum
  misc_feature: Ceres CLONE 1726095
  misc_feature: Encodes the peptide sequence at SEQ ID NO. 10941
gaaaccccccttcccctcccgcccgcacccacccgagatctccgcgccgacgctctccgcccgacagcaccaccgcccgcccgtcccgcgcggcgcgcgagcgggacgcgtgccgggagcggatctccactcgacagcgccgagcgggattccctgcgcgcgcggtgaccaggcagacggagacggggctagatccgcgagatcccgtccccgcgttcccgcaccttccgtgagcctgcgggattatttatcagcggccgcagctacacggtggggctgctgatcctggttggtcggaggagatgcagaggaatggcgtgctggaatgcagcgtttgtcgctccaaggtggcggttccgagccccaggagtgtgtcaagggcatacgacaagcaccgcagcaaggtgtcatccaagtaccgtgcacttaatgtgcttctcgtgtctggggactgcatcttggtcggcctccagcctatcttagtcttcatgtcgaaggttgatgggaagtttcagttcagtcctatcagcgttaactttttgacagaagttgcaaaagttatttttgccattataatgctaataattcagtctagaaaacaaaaggtgggggaaaagccgcttctgtcactttcaacctttgtacaggcagctcgtaataatgtactcttagctgttcctgctctcctatatgccatcaacaactacctaaagtttatcatgcagttatacttcaaccctgcaactgtgaagatgctaagcaatctgaaggtgctggtcatagctgttctcctaaaaattataatgagaagaaaattctctataatccagtgggaagcccttgccctattactgattggaatcagtgtcaatcaactacgctcgatacctgcgggcaccaatgcttttggtcttcccgtcactgctgttgcatatgcatatacactaatttttgttaccgtcccatcgtttgcctctgtctacaatgagtatgctctaaaaagccagtttgatacaagcatctaccttcagaatttgttcttatatggttatggtgcaattttcaacttccttggcatcttagggaccgtcatatttcaaggtccagagagttttgatatccttcgagggcattcaagggcaacaatgtttctcatttgtaacaatgcagcacaaggcattctctcctctttcttctttaagtacgcagataccattttgaagaagtactcatcaacagttgccacaatttttacgggtttagcttcggctgcatttttgggacaatccttgactgttaactttcttctaggcatctcaatagtatttatttcaatgcaccagtttttctctccactagccaaggtcaaagatgaaaaaacagcaggaacagtggagctaggagattcacaaaatcataggtcctctgagtcttcttttgtaaatatgactgctggtgccgctgacgatgcaagccatcttagcgcaactgacgagagaaaaccgctgctgcccatttaagattacatattttgaggtagatatagaagaaattctttttgcggagagtagaacaattgccattgtagactttacaagcaaaagaaatatcatatatatgcagaattcatttcaggccaccttgttccactgttttcttgttttatactccgagctttggggtcaacatatggcagtaggcccctgttatacagtatacacaacaaatgtaatgcgtatcacataccgcaattgtcccctatttttggggcaaaatgtacttgtgtcgatgattgttgtaccatcacg

SEQ ID NO: 10941 - protein, 405 aa, Panicum virgatum
  misc_feature: Ceres CLONE 1726095
  misc_feature (105)..(341): Pfam Name: Nuc_sug_transp Pfam Description: Nucleotide-sugar transporter
MQRNGVLECSVCRSKVAVPSPRSVSRAYDKHRSKVSSKYRALNVLLVSGDCILVGLQPILVFMSKVDGKFQFSPISVNFLTEVAKVIFAIIMLIIQSRKQKVGEKPLLSLSTFVQAARNNVLLAVPALLYAINNYLKFIMQLYFNPATVKMLSNLKVLVIAVLLKIIMRRKFSIIQWEALALLLIGISVNQLRSIPAGTNAFGLPVTAVAYAYTLIFVTVPSFASVYNEYALKSQFDTSIYLQNLFLYGYGAIFNFLGILGTVIFQGPESFDILRGHSRATMFLICNNAAQGILSSFFFKYADTILKKYSSTVATIFTGLASAAFLGQSLTVNFLLGISIVFISMHQFFSPLAKVKDEKTAGTVELGDSQNHRSSESSFVNMTAGAADDASHLSATDERKPLLPI

SEQ ID NO: 10942 - DNA, 1569 bp, Panicum virgatum
  misc_feature: Ceres CLONE 1726096
  misc_feature: Encodes the peptide sequence at SEQ ID NO. 10943
gcgggttggccttggccacctcatccgcctcgtcggcttcaccaccaccccaccaggaaagaacaccgccgcaccactgcaccagtcctctggcttcgggtctccccattcccttcctctcctgaagcaggggtttctctggccttcggtgcaggggactctactctattcttggactaggtaaccgctgctctgctcctctgttcgccggtgcgcttcggattggcctggccaagtggccagggaggccacagaatcacccagaccagggatataggaatttcagtatgcaacaaatggccatgtcagctttcgcagtgacctctccttcatcgcatggctgtgccttgtctgccctccatgctcgacattctcaaagattgcacacgagacgccgcagccaagtccgggcactggcacaaacacagttgcagtacaacaagctgggagattcagacctccttatcagcgaggtcactcttggaacaatgaccttcggagagcaaaacacagagaaggaagcacatgatatactctcttattctttcgatcaaggtgtcaatgtcctagatacagcagaaatttacccagttccaatgaacaaggaaactcaagggaggactgatctttatattggcaggtggatgcaatcgaagccacgagacaagataattttggccaccaaagttgccggttattcagagcggtctacttttctccgggacaatgcagaagtggtgcgtgttgatgctgccaatatcaaagagagtgttgaaaagagccttaaacgcttgtctacagattatattgatttgcttcagatacactggtcagatagatatgtggcactatttggtgaatttagttataattcaagcaaatggaggccaagcatcccttttgaggatcaactgaaagctttccaggaactaattgacgaaggaaaggttcgctacattggtgtttccaatgagacctcatatggagtaatggagtttgttcatgctgctaaggcacaaggccttccaaagattgtgagcatccagaacagttatagtctacttgtgagatgtcgctttgaagttgatcttgttgaagtttgccacccgaataactgcaatgttgggctacttgcctactccccattggctggtggggtcctcactggaaagtatctcgatgctaatgctgacatatcaaggagcaggctgaatctcttccctggatacatggcccgctataatgcctctttggctaaagaagcgacagacaaatatgtaaagcttgccaagaagcatgggctaactccagtccagcttgcccttggctttgtgcgggatcgtccatttactgctagctccatcattggagcaaccaccatggatcagttaaaggagaacatcaatgcgtttaccagtgctccacggcctctgccacaagaatttcttgatggcattgaggatcttttcaagagatacaaagacccagcaatactataggtgcttattcaccattttgatgaaaagaaccagcaattctcgaacaatacaaaaacccagcaatcatatt

SEQ ID NO: 10943 - protein, 400 aa, Panicum virgatum
  misc_feature: Ceres CLONE 1726096
  misc_feature (50)..(392): Pfam Name: Aldo_ket_red Pfam Description: Aldo/keto reductase family
  misc_feature (198)..(392): SWISSPROT Homolog: EC 1.1.1.65 Pyridoxine 4-dehydrogenase
  misc_feature (55)..(180): SWISSPROT Homolog: EC 1.1.1.91 Aryl-alcohol dehydrogenase (NADP(+))
MAMSAFAVTSPSSHGCALSALHARHSQRLHTRRRSQVRALAQTQLQYNKLGDSDLLISEVTLGTMTFGEQNTEKEAHDILSYSFDQGVNVLDTAEIYPVPMNKETQGRTDLYIGRWMQSKPRDKIILATKVAGYSERSTFLRDNAEVVRVDAANIKESVEKSLKRLSTDYIDLLQIHWSDRYVALFGEFSYNSSKWRPSIPFEDQLKAFQELIDEGKVRYIGVSNETSYGVMEFVHAAKAQGLPKIVSIQNSYSLLVRCRFEVDLVEVCHPNNCNVGLLAYSPLAGGVLTGKYLDANADISRSRLNLFPGYMARYNASLAKEATDKYVKLAKKHGLTPVQLALGFVRDRPFTASSIIGATTMDQLKENINAFTSAPRPLPQEFLDGIEDLFKRYKDPAIL

SEQ ID NO: 10944 - DNA, 1858 bp, Panicum virgatum
  misc_feature: Ceres CLONE 1726103
  misc_feature: Encodes the peptide sequence at SEQ ID NO. 10945
atcccgcactggcgcgggtgggaatgctccgcgcgctaccagatgcgacgctcacgctcctactgcccctgcgctgaataataaaaagctgccaaagaggtcaaatgggggcgttcttgagctcccaagccagcaagaaccagccacaggagcacggggaagctccgggaccggaatcctccaagaagctgcggctgtcgtcgattccaccttatggccatggtcacccgcggcttatccccgggctcccagacgagatctcgctgcaaatcctcgcgaggatgcggaggatcggatacctcaaggccaagatggtctcccggagctggaagaccgccatcactggcgcggagctgtactgtcttcggagggagtttggcatggccgaagagtgactctacgtactgatgaaaacggcagatgatcacaagctgatttggcatgcttttgatccggttagcaaccaatggcagaggctgccactcatgcctgggatcagtcatcgaagaggggagtgcaggagtggtgtctcctggatgggattgggagatctggtgagcgccggcatcaggatctccgatgctatcagaggctggtttggtcacaaggatttgttagacagtataccgttctgcggctgcaccattggcaccgttgatggctgcctttatgttttgggcggcttctctagagctttcgcgatgatgtccgtgtggaggtatgaccccattgtcaattcatggcaggaggtgagcccaatgagcaccgggcgtgccttttgcaaggctagtctgttaaacgacaagctgtacgttgttggtggtgtgagcaaaggcaaggatgggttaactccactccaatccgtcgaagtatttgacccagcaaccgggttttgggcagaattgccagatatgacattctccaaagcgcaagctctaccgactgccttcctagttgagctactgaagccgattgctattggcatgacctcatacagagggaagctatatgttcctcagagcctttattcctggcccttctttgttgatgttggtggggagacatttgatcctgaggcaaattcatgggcagaaatgcctgtgggcatgggcgagggttggtctgcaaggcaggctggaacaaaattaagtgctgttgtagatggggacctgtatgccttggagccatcaacttcttctgacagcggtaagataaagatctatgatcctcaggaggatacttggaaggttgctgtaagccaggcacctgttggggactttcccgagtcggaaagtccatacttgcttgtaggatttcttgggaagctccatttgatcatcaaggatgtggacaacacaatcaaaattatgcaaacagcccttctgaagcctacggatgtggcagcctcttcagctggcacaacctgccaaaacccagatgtctccttggagcaggaaacagatgtttggaaaaccattgcaacgaagaatattgcagttgctgaactcgtcagctgccaggttctcagcatctgagttgctctggatcattgtatcaattatgaatatgtttctgccatacatctgatctgttcaggtaactttttggggcttcaaccttaagaacagaggatctgcatcttgtgttacagatgtgatcagtgaactgcagaaagtagtgtgccggcaatttacatatgtatgcgcactttgggtaattcaattgtataagcattttctttaactcttatgtatgtatataacatcacatgagattggtgaaggccgtcgcactttgtccaattccaaaggcaatagtgctgatatctgatcgcatgttcattgttcaaactgctggt

SEQ ID NO: 10945 - protein, 375 aa, Panicum virgatum
  misc_feature: Ceres CLONE 1726103
  misc_feature (74)..(119): Pfam Name: Kelch_1 Pfam Description: Kelch motif
  misc_feature (121)..(170): Pfam Name: Kelch_1 Pfam Description: Kelch motif
MKTADDHKLIWHAFDPVSNQWQRLPLMPGISHRRGECRSGVSWMGLGDLVSAGIRISDAIRGWFGHKDLLDSIPFCGCTIGTVDGCLYVLGGFSRAFAMMSVWRYDPIVNSWQEVSPMSTGRAFCKASLLNDKLYVVGGVSKGKDGLTPLQSVEVFDPATGFWAELPDMTFSKAQALPTAFLVELLKPIAIGMTSYRGKLYVPQSLYSWPFFVDVGGETFDPEANSWAEMPVGMGEGWSARQAGTKLSAVVDGDLYALEPSTSSDSGKIKIYDPQEDTWKVAVSQAPVGDFPESESPYLLVGFLGKLHLIIKDVDNTIKIMQTALLKPTDVAASSAGTTCQNPDVSLEQETDVWKTIATKNIAVAELVSCQVLSI

SEQ ID NO: 10946 - DNA, 888 bp, Panicum virgatum
  misc_feature: Ceres CLONE 1726104
  misc_feature: Encodes the peptide sequence at SEQ ID NO. 10947
aattcgaagttcaaacacactctactccaagctcggctagctgagcagagggtcggacatgaccaagaagctcacctccgccatggccgggaagcaggattttcgcgaggcgcaattcgatgatcaggggaggcacaggcaccagcaggcttcggttcacggaggcggcaagagcgcggcggcggggttcgggggcaggttgatctcccacgagcaggaggacgccatcatcgtcgctgcgctgcggcacgtggtgtccgggtacagcacgccgccgccggaggtcgtcacggtggcgggcggcgaggcgtgcggggtctgcggcatcgacgggtgcctcgggtgcgacttcttcggggcgcccgcggaggcggtgagctcttctggcgcggggcggacggcgccggcggcaggaggggggcagcagcagcagcagcagcagaggccgcggcggcggaggaagcggaacaggtaccgcggcgtgcggcagcggccgtggggcaagtgagcggcggagatccgcgacccgcggcgcgcggcgcgcgtgtggctgggcacgttcgacaccgcggaggcggccgccagggcctacgactccgccgcgctcgagttccgcggcccgcgcgccaggctcaacttcccgggccgcggcgacgccgcctgtgcctccgccgccgcggcggagacgacggcggcgtcgggggagtcggacggggcgggggacgagatgctgtgggaaggcctgcaggacctgatgaagctggacgagacggacctgtggttcgcgccatttgctggagcgggcactagtttctgagagctcgattcgatcttgtactgtcaaccacgtgcacaaattaaagtgtagttactgtcttactgaccact

SEQ ID NO: 10947 - protein, 141 aa, Panicum virgatum
  misc_feature: Ceres CLONE 1726104
  misc_feature: Useful for making plants with modulated biomass
MAGKQDFREAQFDDQGRHRHQQASVHGGGKSAAAGFGGRLISHEQEDAIIVAALRHVVSGYSTPPPEVVTVAGGEACGVCGIDGCLGCDFFGAPAEAVSSSGAGRTAPAAGGGQQQQQQQRPRRRRKRNRYRGVRQRPWGK

SEQ ID NO: 10948 - DNA, 1600 bp, Panicum virgatum
  misc_feature: Ceres CLONE 1726113
  misc_feature: Encodes the peptide sequence at SEQ ID NO. 10949
attagccaatctgagctccaacagctggtttggccagataatggacatcaggacactgtgcccaatcttcatcttcctcctcctcatcctcaaactcatcagggcaaagtcgtcgtcggcgcttcgcctcccgccggggccatggcagctgccgctcgtcggcagcctgcaccacctcctcctgtcgcgcttcatcagcggcctgctgcctcaccaggcactgcgcgagctgtccgcggcgtacgggccgctcatgctgctccgcttcggctccgttccgacgctggtggtctcctccgccgaggccgccagggaggtgatgcggacgcacgacgtcgccttctgcagccgccacctgagcgccaccctcgacatcatcagctgcgacggcaaggacatcatcttctcccactacaacgaccgctggcgcgagctccgcaaggtgtgcatgctcgagctcttcaaccagcgccgcgtgctctccttccgccccgtccgggaggaggaggtggcgcgcctcctccgctccatctccggcgagtgcggcggcggcggccaacccgtcaacctcggcgaggccatctgccgcatgataaacgacatcgtcgtgcgcacggccatcggcgggcggtgcaggtaccgggacgagttcttgcatgagctcgatgaggccgtgcggctcaccggcgggttcaacctggccgacctgtacccgtcctcgcggctcgctcgccggttcagcgccgccgcgagggacatggcaaggtgccagaagaacatctaccggatcatcgaaagcatcatccatgagcgcgcagtcacgcgaatgccggagcgagaggaagaccttctgggtgtcctcttgaggctgcagagggaaggtggcctgcagtttgatctcaccaacgagatagtcagcaccgtcattttcgatatttttgctgccgggagtgaaacatcatccacagtactagtatgggccatgtcagagcttgtaaagaacccacgagtgttgcataaggcgcaggcagaggtgagggagaccttcagaggacaggaaaagttaactgaagacgacatggtcaagctaagctacctccatttggtgatcaaggaggctctacggctgcacgctccggtgccgttcttgctccctcgggagtgccggcagacatgccaggtcatgggctacgatgtgcccaagggagccaaggtgtttgtgaacgtttgggcaatagcaagggacagcaagttctggggcgatggcgaggcgttcaggccggagaggttcgatggtagcagcgttgatttcaggggtaatgacttcgagttcacaccgtttggggcaggcaggagaatctgccctggcatcacgcacgggctggccaacatggagctggtgctcgctagccttctttaccacttcgactgggagctgcctggagaccttgacatgactgaggcctttggtataacgttgagaaggaagtccaagctcatgctgaaagccaaaccttgcattggctttgtaccaaaataagtagctaggttcatctacgctatgaaaaataatatgactatatatcaagctatgttctcc

SEQ ID NO: 10949 - protein, 499 aa, Panicum virgatum
  misc_feature: Ceres CLONE 1726113
  misc_feature (31)..(490): Pfam Name: p450 Pfam Description: Cytochrome P450
  misc_feature: SWISSPROT Homolog: EC 1.14.13.68 4-hydroxyphenylacetaldehyde oxime monooxygenase
MDIRTLCPIFIFLLLILKLIRAKSSSALRLPPGPWQLPLVGSLHHLLLSRFISGLLPHQALRELSAAYGPLMLLRFGSVPTLVVSSAEAAREVMRTHDVAFCSRHLSATLDIISCDGKDIIFSHYNDRWRELRKVCMLELFNQRRVLSFRPVREEEVARLLRSISGECGGGGQPVNLGEAICRMINDIVVRTAIGGRCRYRDEFLHELDEAVRLTGGFNLADLYPSSRLARRFSAAARDMARCQKNIYRIIESIIHERAVTRMPEREEDLLGVLLRLQREGGLQFDLTNEIVSTVIFDIFAAGSETSSTVLVWAMSELVKNPRVLHKAQAEVRETFRGQEKLTEDDMVKLSYLHLVIKEALRLHAPVPFLLPRECRQTCQVMGYDVPKGAKVFVNVWAIARDSKFWGDGEAFRPERFDGSSVDFRGNDFEFTPFGAGRRICPGITHGLANMELVLASLLYHFDWELPGDLDMTEAFGITLRRKSKLMLKAKPCIGFVPK

SEQ ID NO: 10950 - DNA, 900 bp, Panicum virgatum
  misc_feature: Ceres CLONE 1726124
  misc_feature: Encodes the peptide sequence at SEQ ID NO. 10951
actcggcagctccggcgattcactcggattgatccactccccgcgccggcagggaggagatcagacacccatggcgttcgatgccttcaccgacaagaacgccgtcttccgccgtctcaaggccaagccagagaacaagatgtgcttcgactgcaacgccaagaaccccacctgggcctccgtcacctacggcatcttcctctgcctcgactgctccgccgtccaccgcagcctcggagtacacatcaccttcgtcaggtcaacgaaccttgactcatggactccagatcagctcaagatgatggctttcggaggcaacaacagggcacatgctttcttcaaacagcatggatggaatgatggtggcaaagtcgaggcaaagtacacatcaagggctgctgagttgtacaggcagatactttcaaaggaggtcgctaagagtgccactaatgataatgccttaccatcatcgcctgtcgcgtcagagccaccgaagccagtcgatgacttccctgaattcaagctctcagatgcaacggcagagaatttgaatgggaagcaggagctaaagtcgccaaaagcacctccccgttcaccaaaagcacctacccatcccacctttgccacctccgtaaagaaacccattggtgcgaagaaggttggagccaagactggagggcttggtgttcgaaagcttactacaaagccaaatgaaagcctgtatgagcagaaacctgaagagccaaaatctgctgtgcctgccttgacgactacttcaactactaaaagcggtccatccttgcactcgcgttttgaatacgtggagaatgaaccatcagctgactcaagaacagggggatctcatgtgactggccatgtagcaccaccaaaatcatcaga

SEQ ID NO: 10951 - protein, 276 aa, Panicum virgatum
  misc_feature: Ceres CLONE 1726124
  misc_feature (10)..(126): Pfam Name: ArfGap Pfam Description: Putative GTPase activating protein for Arf
MAFDAFTDKNAVFRRLKAKPENKMCFDCNAKNPTWASVTYGIFLCLDCSAVHRSLGVHITFVRSTNLDSWTPDQLKMMAFGGNNRAHAFFKQHGWNDGGKVEAKYTSRAAELYRQILSKEVAKSATNDNALPSSPVASEPPKPVDDFPEFKLSDATAENLNGKQELKSPKAPPRSPKAPTHPTFATSVKKPIGAKKVGAKTGGLGVRKLTTKPNESLYEQKPEEPKSAVPALTTTSTTKSGPSLHSRFEYVENEPSADSRTGGSHVTGHVAPPKSS

SEQ ID NO: 10952 - DNA, 415 bp, Panicum virgatum
  misc_feature: Ceres CLONE 1726124-R
cagaatatctttcccaggcatcccaggatcttttttcactcaaggacatagctgggaggagactggaaagaagctgacatctttggcctccaattttcatcagcgaccctggacagaatgccttttgagcgggttatttggccgagaacttggagcatttcctatctgcaccagaatactgctgccctcatgttttgattgtggtgcatcagacaattcaaagcaattcttgcacagctctgtagaggattcatgttctgccgtttgtatttgaccatgtctgacacatatattttcatttatttgttcacagcaggtgaagcatatactcttttatacattaattaaggtttcttgttatcttggaagaaaaatccatggctgtggtcaatgaaactgagccggatgttttgac

SEQ ID NO: 10953 - DNA, 834 bp, Panicum virgatum
  misc_feature: Ceres CLONE 1726128
  misc_feature: Encodes the peptide sequence at SEQ ID NO. 10954
aagccgagcaccgcagagaaaggcgtcttcgcactcgcctctctccgcgactcaaagcttccccccctcctcccattccccaccgcgccgccgccccacccttccgacgacaccatgagggagtgcatctcgatccacatcggacaggccggtatccaggtcggaaacgcgtgctgggagctctactgcctcgagcatggcattcaggctgatggccagatgcccggtgacaagaccattggaggaggcgatgatgctttcaacaccttcttcagtgagactggggctgggaagcatgtcccccgtgctgtgtttgttgaccttgagcccactgtgattgatgaggtgaggactggcacttaccgccagctcttccaccctgagcagctcatcagcggcaaggaggatgctgccaacaactttgcccgtggtcactacaccattggcaaggagattgttgacctgtgccttgaccgcatcaggaagcttgccgacaactgtactggtctccaaggcttccttgtcttcaacgctgttggtggaggaacggggtctggccttggttccctcctccttgagcgcctgtcggttgactatggcaagaagtccaagcttgggttcactgtatacccatctccccaggtctccacctcagtggttgagccatacaacagtgtcctgtccacccactccctccttgagcacactgatgtttctgtcctgctcgacaatgaggccatctatgacatctgccgtcgctcccttgacattgagcgcccaacctacaccaacctcaacaggcttgtgtctcaggtcatctcatctctgactgcc

SEQ ID NO: 10954 - protein, 239 aa, Panicum virgatum
  misc_feature: Ceres CLONE 1726128
  misc_feature (49)..(239): Pfam Name: Tubulin Pfam Description: Tubulin/FtsZ family, GTPase domain
  misc_feature: Useful for making plants with altered cell wall content and/or composition
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVSVLLDNEAIYDICRRSLDIERPTYTNLNRLVSQVISSLT

SEQ ID NO: 10955 - DNA, 392 bp, Panicum virgatum
  misc_feature: Ceres CLONE 1726128-R
  misc_feature: Encodes the peptide sequence at SEQ ID NO. 10956
gcattgaccacaagtttgacctcatgtacgccaagcgtgccttcgtgcactggtacgtgggtgagggcatggaggagggcgagttctctgaggcccgtgaggaccttgctgcacttgagaaggactacgaggaggttggcgctgagttcgacgagggtgaggaaggcgatgacggtgacgagtactagacgacgatatgcttcctgctattgtgtcagggccgtgtgccgcagttatcccgtgatctgcccgagtggctcgttcttatcctgttctgtgtgtccgtttgaacaatctgtctccgtgtgtcgtttacaacagcttatgttgtaagactttgtttaatcctcctttgtttctggattaatataaatccttctatgtttcgtgtc

SEQ ID NO: 10956 - protein, 61 aa, Panicum virgatum
  misc_feature: Ceres CLONE 1726128-R
  misc_feature: Useful for making plants with altered cell wall content and/or composition
IDHKFDLMYAKRAFVHWYVGEGMEEGEFSEAREDLAALEKDYEEVGAEFDEGEEGDDGDEY

SEQ ID NO: 10957 - DNA, 715 bp, Panicum virgatum
  misc_feature: Ceres CLONE 1726132
  misc_feature: Encodes the peptide sequence at SEQ ID NO. 10958
gccacagcaaagccacgataatggccggagaccagcagcaagaggaagccatggcggcagctcctctccacgttgtggtgttcccatggctggcgttcggccacctcatcccgttcctggagctctccaggcggctggcggcgcggggccacgccgtcaccttcgtctccacgccgaggaacgtcgccaggctcccgccggtgccagagggcctgtccggccaggtccggaccgtggccctgccgctgccggcggtggacgggctgccagagggcgccgagtcgacagccgacgtgccgccggagaaggtcgagctcctcaaggccgcattcgacggcctcgccgcgcccttcgccgacttcctcgccggcggccgggagcaagtggggttcgggaggaggccggactgggttgtgctcgacttcgcgcaccactggctctgccccatcgcggaggaacaccaggttccttgcgcgatgttcctcatcttcacggcgaccacaatcgcgtacagcggctcacgtcgccagaacgtcagccatccccgcgtcacggtcgaggacttcatgcccatgccgaggtggttcccctccccacctaccctcgccttccgccgccacgaggccgcctggatcgccgccgccaaccagctgaacgcgtccggcgtctccgacaccgagcgcatgtggcgtaccgaggagcgctgccgccttct

SEQ ID NO: 10958 - protein, 231 aa, Panicum virgatum
  misc_feature: Ceres CLONE 1726132
  misc_feature: SWISSPROT Homolog: EC 2.4.1.115 Anthocyanidin 3-O-glucosyltransferase
  misc_feature: Useful for making plants with altered carbohydrate content
MAGDQQQEEAMAAAPLHVVVFPWLAFGHLIPFLELSRRLAARGHAVTFVSTPRNVARLPPVPEGLSGQVRTVALPLPAVDGLPEGAESTADVPPEKVELLKAAFDGLAAPFADFLAGGREQVGFGRRPDWVVLDFAHHWLCPIAEEHQVPCAMFLIFTATTIAYSGSRRQNVSHPRVTVEDFMPMPRWFPSPPTLAFRRHEAAWIAAANQLNASGVSDTERMWRTEERCRL

SEQ ID NO: 10959 - DNA, 475 bp, Panicum virgatum
  misc_feature: Ceres CLONE 1726132-R
  misc_feature: Encodes the peptide sequence at SEQ ID NO. 10960
gcactgcgggtggggctccgtcgccgagagcctccggtttggcctcccgctggtgatgctgccgttcatcaccgaccagggcctcatcgcgcggatcatgccggagcggggcgtcggcgtggaggtggcacggcgcgacgacgacggctggttcggcagggacgacgtcgccgaggccgtgaggcgcgtgatggtgggggaggaggggaagacgctcgcgcgcaacgccaggaggctgcgggaggcggtcgtcggcgacgacggtgcccggcaggagcggtacgtcgacgagctcgttgaatgcttccagaggcacaggctcacctagtcgcgcaagtgttccacgagctcggctcgttgaatgccactcaatacaattgcattgcattggtctacgtaccattggctgagatttattttactatcatatggtacattcgtacatacgtattcaacaaaataacagctgtacctc

SEQ ID NO: 10960 - protein, 108 aa, Panicum virgatum
  misc_feature: Ceres CLONE 1726132-R
  misc_feature: SWISSPROT Homolog: EC 2.4.1.236 Flavanone 7-O-glucoside 2''-O-beta-L-rhamnosyltransferase
  misc_feature: Useful for making plants with altered carbohydrate content
HCGWGSVAESLRFGLPLVMLPFITDQGLIARIMPERGVGVEVARRDDDGWFGRDDVAEAVRRVMVGEEGKTLARNARRLREAVVGDDGARQERYVDELVECFQRHRLT

SEQ ID NO: 10961 - DNA, 1784 bp, Panicum virgatum
  misc_feature: Ceres CLONE 1726133
  misc_feature: Encodes the peptide sequence at SEQ ID NO. 10962
acacctccccgactccgccgtcacctccccctccgcctccttcccacgccgcctccgctcgccgcctcagcggtttgaggttcacctgcagccatgggtaaggagaagacccacatcaacatcgtggtcattggccacgtcgactctggcaagtcgaccaccaccggccacctgatctacaagcttggcggtatcgacaagcgtgtgatcgagaggttcgagaaggaagccgctgagatgaacaagcggtccttcaagtacgcgtgggtgcttgacaagctgaaggctgagcgtgagaggggtatcacaatcgatatcgccctgtggaagttcgagaccaccaagtactactgcactgtcattgatgcccccggacaccgtgacttcattaagaacatgatcacgggtacctcccaggctgactgtgctgtacttatcatcgactccaccactggtggttttgaggctggtatctccaaggatggccagacccgtgagcatgctctccttgccttcactcttggagtgaagcagatgatctgctgctgcaacaagatggatgccaccactcccaagtattccaaggcccgttatgatgagatcgtgaaggaagtctcctcctacctgaagaaggtgggatacaaccctgacaagattgccttcgtccccatctctggttttgagggtgacaacatgattgagaggtccacgaaccttgactggtacaaggggccaaccctgcttgaggctcttgaccagaacaacgagcccaagaggccttcagacaagccccttcgtctcccccttcaggatgtgtacaagattggtggtattggaaccgtccctgttgggcgtgttgagactggtatcatcaagcctggtatggttgtgaccttcggtcccagcggcctgactactgaggtcaagtctgtcgagatgcaccacgaggctctccaggaggcccttcctggtgacaatgttggcttcaacgtgaagaacgttgctgtgaaggatctgaagcgtgggtatgtggcctccaactccaaggatgaccctgccaaggaggctgccagcttcacctcccaggtcatcatcatgaaccaccctgggcagattggcaacggttacgccccagtgctggactgccacacctcccacattgctgtcaagttcgccgagcttattaccaagattgacaggcggtctggcaaggagctagagaaggagcccaagttcctcaagaatggtgatgctggtatggtaaagatggttcccacaaagcccatggtggtggagaccttctctgagtaccctcctcttggtcgctttgctgtccgtgacatgaggcaaacggttgctgttggagtcatcaagagtgtggagaagaaggacccaactggcgccaaggttaccaaggctgctgccaagaagaaatgatgtgcctgtggtttattgtgtgtctgctttttgctatagcgccaaggttaccaaggctgctgccaagaagaaatgatgtgcctgtggtttatcgtgtgtctgctttttgctatacctagatgccgtcgtattaacgcataagttttgtctgcatgtcattgctgttatccttgaacatctaaggtctgctggtggtgtgtcatctgtatgtttaggtactgtcttgtcaacttcagcttcggcaaaacttgaatgctctgagatctatatttgcccttctgcgtgttgtcagatgtattgtcaggagtcgtctagttgtctttatacattttgtttcgtgttttctc

SEQ ID NO: 10962 - protein, 447 aa, Panicum virgatum
  misc_feature: Ceres CLONE 1726133
  misc_feature (5)..(226): Pfam Name: GTP_EFTU Pfam Description: Elongation factor Tu GTP binding domain
  misc_feature (322)..(430): Pfam Name: GTP_EFTU_D3 Pfam Description: Elongation factor Tu C-terminal domain
  misc_feature (248)..(315): Pfam Name: GTP_EFTU_D2 Pfam Description: Elongation factor Tu domain 2
  misc_feature: SWISSPROT Homolog: EC 2.7.7.4 Sulfate adenylyltransferase
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQNNEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 10963 - DNA, 1743 bp, Panicum virgatum
  misc_feature: Ceres CLONE 1726140
  misc_feature: Encodes the peptide sequence at SEQ ID NO. 10964
gaacagtgaacagattgctctcactcccagccacccacttctcgccggcatcgaaaataatattccccggcgagcgagtgccgagagcatgagcaccttgccaccgccgccggccatggaggactggctcttctacaccctgacggtgctcctctgcctgctctgctcggtcctgctgcgcgcgcgcgcccgcagctcgtccggggccaagggccacgctgccggcgacgagctcccgcctctcccgccggggccatcgccgctgcctgtgctgggcccgctgctcttcctggcgcgccgcgacctcgatttcgagcccgtgctccgccgcatcgcgtgggagcacggcccggtcttcacctacgcgccgctgggcagggcgctgcccggcatcttcgtcgcctcccgcggcgccgcgcaccgcgcgctcgtgcagcgcggcgcggcgttcgcgtcccgcccgccggtgacggcctcgagcgccctgctcacaagcggcggccgcaacatcagctcggcgccctacggcgccacgtggcgcgcgctgcggcggaacctggcggccggcgtgctcaatccggcgcggctccgggcgttctcgcccgcgaggcgctgggtgctcggcgtcctcgcctcccgcgtccgcgccggcgccggcgccgccggggagcgtcccgtcgccgtgatggagccgttccagtacgccatgttctgcctgctcgtgtacatgtgctttggcgaccgcgtcgaggatgcgcgcgtgcgggacattgaggccacgcagagggagctcctcggcagcttcctcagcttccaggtcttctccttcctcccggcgctcaccaaggtcgtgttccggcggcggtgggagaagcttctctcgctgcggcggcggcaggaggagctcttcctcccgctggttcaggcgaggagggacgccggcgccgacggggactgctacgtggactccatgctaaagctggccatccccgaggacggcggtagggttctcaacgacggcgagatcgtcagcctgtgctccgagttcctcggcgccggcactgacaccacggccaccgcgctgcagtggatcctggcgaacctggtcaagtacccagcgatgcaggacaggctgcgggacgaggtggccggcgtcgttggcgctgccgacggcgaggtgcgggaggaggacctgcaggcgatgccgtacctgaaggccgtggtgctggaggggctccggcgccacccgccgggccactacctgctcccgcacgccgtgcacgaggacacgacgctggacgggtaccgcgtgcccgccggcgcgccgatcaacttagcggtggtcgacatgggtcttgacgaggaggtgtgggacgcgccctcggagttccggccggagcggttccttcccggcggtgaaggggaggacgtggacctcacggggagcaaggagatcaagatgatgccgttcggcgccgggcggagggtctgccccggcatggcgctggcgctgctgcacctcgagtacttcgtggccaacctcgtgagggagttcgagtggcgcgaggccgacggcgaggtggacctcaccgagaagcttgagttcaccgtcgtcatgaagcggccgctcaaggccagagccctgccgctgcggtcgccgccacccgccgtcgccgctgcttgatcgattgttcacttcaattctctctagctagcaaggcaatggattggcaatgaattggc

SEQ ID NO: 10964 - protein, 522 aa, Panicum virgatum
  misc_feature: Ceres CLONE 1726140
  misc_feature (44)..(511): Pfam Name: p450 Pfam Description: Cytochrome P450
  misc_feature: SWISSPROT Homolog: EC 1.14.13.21 Flavonoid 3'-monooxygenase
MEDWLFYTLTVLLCLLCSVLLRARARSSSGAKGHAAGDELPPLPPGPSPLPVLGPLLFLARRDLDFEPVLRRIAWEHGPVFTYAPLGRALPGIFVASRGAAHRALVQRGAAFASRPPVTASSALLTSGGRNISSAPYGATWRALRRNLAAGVLNPARLRAFSPARRWVLGVLASRVRAGAGAAGERPVAVMEPFQYAMFCLLVYMCFGDRVEDARVRDIEATQRELLGSFLSFQVFSFLPALTKVVFRRRWEKLLSLRRRQEELFLPLVQARRDAGADGDCYVDSMLKLAIPEDGGRVLNDGEIVSLCSEFLGAGTDTTATALQWILANLVKYPAMQDRLRDEVAGVVGAADGEVREEDLQAMPYLKAVVLEGLRRHPPGHYLLPHAVHEDTTLDGYRVPAGAPINLAVVDMGLDEEVWDAPSEFRPERFLPGGEGEDVDLTGSKEIKMMPFGAGRRVCPGMALALLHLEYFVANLVREFEWREADGEVDLTEKLEFTVVMKRPLKARALPLRSPPPAVAAA

SEQ ID NO: 10965 - DNA, 2297 bp, Panicum virgatum
  misc_feature: Ceres CLONE 1726145
  misc_feature: Encodes the peptide sequence at SEQ ID NO. 10966
gccacacttgcaaagggaatccccccccctctctctcccaccgccgccgctacgctacgctttcggctcgaccacccccttcctcctcggagccctcccctcggcggcggccgaagaagaagagatggcggagcggctgacccgtatcgcgatcgtcagcgaggacaagtgcaagcccaagaagtgccgccaggagtgcaagaagagctgccccgtcgtcaagaccgggaagctttgcattgaagtgactccggcatcgaaacttgctttcatttctgaggagctgtgcatcggttgtggtatttgtgttaagaaatgcccatttgatgccattgatatcatcaacctcccaaaagatttggaaaaggacaccactcaccgatatgggcccaacacattcaagttgcacaggttgcctgtcccgaggcctggtcaggttttgggccttgttggaacaaatggaattggaaagtcaacagcacttaaaattttggctggcaagctgaaacctaatttgggacgcttcaaaaacccacctgattggcaggaaatccttacacacttccgtgggtctgaacttcagaactacttcacacgcatattggaagataacctcaaggcaatcattaaacctcagtatgttgaccacattccaaaagctgttcaaggaaatgtagggcaagtacttgaacagaaggatgagagggatatgaaagctgagctgtgtgttgaccttgaattaaaccaagttattgaccggaatgttggagacctgtctggtggtgagctccagagatttgcaatagcagttgttgctgtacaaaatgcggaaatttacatgtttgatgagccatcaagttaccttgatgttaagcagaggcttaaagctgcacaagttattaggtccttgcttaggcccaacagctatgtcatcgttgttgaacacgacttgagtgtcttggattacttgtccgacttcatttgctgcttgtatggaaagccaggtgcttatggggtggttaccttgccattctcggttcgagaaggcatcaacattttcttggctggatttgttccaacagaaaatcttcggttccgagatgaatctcttacatttaagattgcagagactcaagaaagtgctgaggagattgagacatatcaacgttacaagtaccctaccatgagcaaaacgcagggaaatttcaagttaactgttgttgagggtgaatttactgattcccagattgtcgtgatgcttggtgaaaatggtacagggaaaactacattcatcagaatgctggctgggttgttgaagcccgacacagtggaaggaacagatattgaaattcctgaattcaatgtgtcgtacaagccccaaaagattagtccaaaatttcagaataccgtgaggcatttgcttcaccagaaaatacgcgattcttatatgcatcctcagttcgtgtctgacgtcatgaaaccactacaaattgagcaactcatggaccaggaggttgttaatttatcaggtggagaacttcaaagagttgctatatgcctctgccttggaaagcctgcagatatctatttgattgatgaaccaagtgcgtatcttgattcagagcagcgtattgttgcctcgaaggttatcaaaagattcattctccacgccaagaaaactgcatttattgttgagcacgatttcatcatggcaacctacttggctgacaaggtcattgtttatgaggggcgaccttctattgactgtacagccaacgcgccacagtctttggtatctggaatgaataagttcttatcgcaccttgacattacctttagaagagacccgaccaactataggccccgtattaacaagctgaactccacgaaggacagggagcagaagtcggctggatcctattactacctagacgactaatgagcgcgtacagaatcttctcaaggagagctttccgttcatgatctttccatgatgtggaaatgcgaggctagattgaagctgccactacatcacggcatgagacttgttgaataattggctgccaggagtcaccagttaacttataaagcagagcatgctgtgttgatagtttgatactgatgtttttttttgttggcttgatctatctatatgacaatggaagatgagatcggtgttaaaaggtgggctttgtcaggggagagtcaatcaccgctagtttctgtttatttgtaccgttgatttgccatcgagcaacttcaatcctcgatttatagatagatgacattgaagattc

SEQ ID NO: 10966 - protein, 604 aa, Panicum virgatum
  misc_feature: Ceres CLONE 1726145
  misc_feature (373)..(543): Pfam Name: ABC_tran Pfam Description: ABC transporter
  misc_feature (103)..(292): Pfam Name: ABC_tran Pfam Description: ABC transporter
  misc_feature (6)..(37): Pfam Name: RLI Pfam Description: Possible metal-binding domain in RNase L inhibitor, RLI
  misc_feature (48)..(71): Pfam Name: Fer4 Pfam Description: 4Fe-4S binding domain
  misc_feature (66)..(284): SWISSPROT Homolog: EC 3.6.3.17 Monosaccharide-transporting ATPase
  misc_feature (356)..(542): SWISSPROT Homolog: EC 3.6.3.20 Glycerol-3-phosphate-transporting ATPase
MAERLTRIAIVSEDKCKPKKCRQECKKSCPVVKTGKLCIEVTPASKLAFISEELCIGCGICVKKCPFDAIDIINLPKDLEKDTTHRYGPNTFKLHRLPVPRPGQVLGLVGTNGIGKSTALKILAGKLKPNLGRFKNPPDWQEILTHFRGSELQNYFTRILEDNLKAIIKPQYVDHIPKAVQGNVGQVLEQKDERDMKAELCVDLELNQVIDRNVGDLSGGELQRFAIAVVAVQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKIAETQESAEEIETYQRYKYPTMSKTQGNFKLTVVEGEFTDSQIVVMLGENGTGKTTFIRMLAGLLKPDTVEGTDIEIPEFNVSYKPQKISPKFQNTVRHLLHQKIRDSYMHPQFVSDVMKPLQIEQLMDQEVVNLSGGELQRVAICLCLGKPADIYLIDEPSAYLDSEQRIVASKVIKRFILHAKKTAFIVEHDFIMATYLADKVIVYEGRPSIDCTANAPQSLVSGMNKFLSHLDITFRRDPTNYRPRINKLNSTKDREQKSAGSYYYLDD

SEQ ID NO: 10967 - DNA, 690 bp, Panicum virgatum
  misc_feature: Ceres CLONE 1726153-R
  misc_feature: Encodes the peptide sequence at SEQ ID NO. 10968
cagagcgtcaaagggttatcgaatctggtgggtatattgaagatggctaccttaatggagttctctctgtgacccgggctcttggtgactgggacatgaaactgccccaaggctcggcatcacccctcattgccgaaccagagatctgctggaccaccctcaccgaggaggatgagttcctgatcattgggtgcgatgggatatgggacgtgatgaccagccaacacgcggtgagcacagtccgcaaggggttgcggcggcacgatgaccccgagaggtgtgctcgggagctggcaatggaggcgaagaggctcgagatctttgacaacctcacggtgatcgtggtctgcttcatatccgagctcagcggcggtccggcgcccctagagccggcatcaaatagtaggctaaggtgctgcaagaccctgtctccggaggcactgtccaagctgaggcgatggctggactccgatcactagatcattctgctgtagaagtgtagaggccgaactctgttttgtgctgcggccatgtaaatatcggtgctgatgttcgtccctctattaaggctgtgcttacatggccagcaattttgtagtgagttcctggcagcgaggcttttcctgctgctgctgttgtttcttcttttgttttactccatttgttggatgtacataccattgttttgtc

SEQ ID NO: 10968 - protein, 158 aa, Panicum virgatum
  misc_feature: Ceres CLONE 1726153-R
  misc_feature: SWISSPROT Homolog: EC 3.1.3.16 Phosphoprotein phosphatase
ERQRVIESGGYIEDGYLNGVLSVTRALGDWDMKLPQGSASPLIAEPEICWTTLTEEDEFLIIGCDGIWDVMTSQHAVSTVRKGLRRHDDPERCARELAMEAKRLEIFDNLTVIVVCFISELSGGPAPLEPASNSRLRCCKTLSPEALSKLRRWLDSDH

SEQ ID NO: 10969 - DNA, 679 bp, Panicum virgatum
  misc_feature: Ceres CLONE 1726153
atttctttcctgaattcccttcccgttcggatcgggtacagttctccgtgtcgtgtccaaattaaaaaaaaaaatcagcttcctccgtgtcgcccttctcgcggattgttgaaaggctgcttctttcggagatttccgcgtgcttctcgtcgagattagtcgaccagtgtttcggatcgagctgcccggggctggagaaattttgaggccaagaagaggtcggaatcggatcgggagttcttcggggtcggggagtgggcggaaaggcgagggatttgggaggagttcgtgtcgccagacgcggtggggggggggggggaacttttgttgagcggcgggttggaggcggagatgggagcccgacctgaggtcatgcatcaggtcgtgccgctgctggaggcaccgttcccccggtgcgtcgaggtcatcaaggaggtggtccccgtggcgcctgtgccggtgcaggtggcggcgtcccccaagtccgtggtgcaggagttgaaaagattttctaatgctggggatagtgtatctgtggaacccccgcagtttgtcccaagcattccatctggtagcttccctgatattggacctaggcggtacatggaagatgaacctattctaattgatgatctttctgctcctcttggtccactgcttttgttctccgcacctaacc

SEQ ID NO: 10970 - DNA, 876 bp, Panicum virgatum
  misc_feature: Ceres CLONE 1726154
  misc_feature: Encodes the peptide sequence at SEQ ID NO. 10971
aggttaaagcgacgccgccgccgcaagccgtccgccttgcccttcttcttccttgaaggcttggtcctcctccttgtatctccaccccacagatccgccgccgccacctctagctagggttgttaggtttcctctgcagcgatggcgatcaagcggaccaaggcggagaagaagcaggcgtacgaccgcaagctgtgcagcctgctcgatgagtacaccaaggtgctcatcgccctcgccgacaacgtcggctccaagcagctccaggacatccgccgcgggctgaggggcgactccgtggtgctcatggggaagaacacgctcatcaggcgctgcatcaaggcctacgccgacaagactgggaaccacaccttcgacccgctcatggacctgctcgtcggcaacgtcggcctcatcttcaccaagggagacctcaaggaggtccgcgaggaggtggccaagtacaaggttggtgctcctgctcgtgttgggctggttgctccagttgatgtcgttgtcccccctggcaacactggcctggatccctcccagacctctttcttccaggtgctcaacatccccacaaagattaacaagggtactgtggaaattattacccctgtggagctgatcaagaagggtgacaaagtgggctcatctgagtctgctcttctcgccaagctgggtatccgcccgttctcatatggtctccagatcaccaatgtctatgaggatgggtcagtctttagccctgaggttcttgacctgactgaggaagaccttattgagaagtttgccactggtgtctccatggttgcctctctgtccctggcgctctcgtaccccacccttgctgctgcgccccacatgtttatc

SEQ ID NO: 10971 - protein, 244 aa, Panicum virgatum
  misc_feature: Ceres CLONE 1726154
  misc_feature: SWISSPROT Homolog: EC 4.2.99.18 DNA-(apurinic or apyrimidinic site) lyase
MAIKRTKAEKKQAYDRKLCSLLDEYTKVLIALADNVGSKQLQDIRRGLRGDSVVLMGKNTLIRRCIKAYADKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLQITNVYEDGSVFSPEVLDLTEEDLIEKFATGVSMVASLSLALSYPTLAAAPHMF

SEQ ID NO: 10972 - DNA, 342 bp, Panicum virgatum
  misc_feature: Ceres CLONE 1726154-R
  misc_feature: Encodes the peptide sequence at SEQ ID NO. 10973
tacccgcatgctgacaagatcaaggagtacctcaaggacccaagcaagtttgctgttgctgcaccggttgctgctgcggactctggtgctgcagctgctcccaaggaagaagagaagaaggcggaagagcctgctgaggagtcggacgacgacatgggtttcagcctgttcgactagagctgctcagatcgtcaagaagctgcaagttttggcatttgtttatgaatcaccaaatgtactgtttaccttattatttagcctgtcagatgaagaactatgttgttcctagtgtaactgacgatatggtattttgtgctaagcatttgtgatgtttttattgct

SEQ ID NO: 10973 - protein, 58 aa, Panicum virgatum
  misc_feature: Ceres CLONE 1726154-R
  misc_feature (1)..(57): Pfam Name: Ribosomal_60s Pfam Description: 60s Acidic ribosomal protein
YPHADKIKEYLKDPSKFAVAAPVAAADSGAAAAPKEEEKKAEEPAEESDDDMGFSLFD

SEQ ID NO: 10974 - DNA, 662 bp, Panicum virgatum
  misc_feature: Ceres CLONE 1726155
  misc_feature: Encodes the peptide sequence at SEQ ID NO. 10975
atgcggcgtttgctgtacggaaaccccgcgccggcgccggcgccgctcccactcctctcgtccccccccccccaaacccccgggcctccttccayttttatcagtacaccgccatggccgccgtgaccgccgcggccgtgtctttgtcgtccttgccggctgctgccaaggcggccgcctcgacgtcgtccccgttgtcatgcggcgtggggtacccgggggggagcgcggcccgggcggtgcgcgtgcaggtgtcgacgacggagaccgctgaggccggggcggcgccggtgaagacggagaagatctccaagaagcaggacgagggtgtggtgaccaacaagtacaggcccaaggagccctacgtggggaggtgcctgctcaacaccaggatcaccggcgacaaggcgccgggggagacgtggcacatggtcttcagcacagaaggcgagatcccttacagagaagggcagtccattggcgtcatcgccgacggcgtcgacaagaacggcaagccgcacaagctcaggctctactccatcgccagcagcgccctcggggatttcggcgactccaagagcgtgtcgctgtgcgtgaagaggctcgtgtacaccaacgatcaaggagagatcgtcaaaggagtctgctccaactacctatgt

SEQ ID NO: 10975 - protein, 182 aa, Panicum virgatum
  misc_feature: Ceres CLONE 1726155
  misc_feature: SWISSPROT Homolog: EC 1.18.1.2 Ferredoxin--NADP(+) reductase
MAAVTAAAVSLSSLPAAAKAAASTSSPLSCGVGYPGGSAARAVRVQVSTTETAEAGAAPVKTEKISKKQDEGVVTNKYRPKEPYVGRCLLNTRITGDKAPGETWHMVFSTEGEIPYREGQSIGVIADGVDKNGKPHKLRLYSIASSALGDFGDSKSVSLCVKRLVYTNDQGEIVKGVCSNYL

SEQ ID NO: 10976 - DNA, 999 bp, Panicum virgatum
  misc_feature: Ceres CLONE 1726155-R
ccccccagctttgccccatttttatctccgagtcctctcccaagtctcctaaccccaaagtggtggagagagagatggttgaaatggatctgttggagaggaacattaagaagggggaggaggtggaggaggcgcgcaaggaagaggagaggaaggaggaggaggagaagaccaaggagtcgtcgcagcaaggccaaggcctcagcctctcactcgccaacggcggctctaggtctggaatgttgccgatgtcgaccccttcagctaatcctgcacagcttacaattttctatggtggatcagtatgtgtgtatgactcagtgccaccagaaaaggctcaagcaatcatgcttattgctgcagcggctgcagcagccaccaaaaccagtgctgccactgctgttaagcctccaatgatgcctgcagccactgttgccccagcagcagtctctcctgtgctcacacggtctccatcactgcagagcacttctgtagcaactgggcaaccacagcctgtttctgaccctagctcaatatgcaagcttcaggctgatcttcccattgccaggaggcactctctccagcgcttcctcgagaaacgtcgtgacaggattgtgaataaggctccatacagccccgccaagtcatctgagggcatggaatcacctgcgatggaggtgaccgccgagggcaaggtgcagtaacttaaaagatagggagccatgacgctcgaaacggtgaaggctgactttgtggaaagggcagggatgtgctggtgccttatgttgaaactcagaaccgtactaataattggaccggaacctctatttttgctgttctgttgtcattgtgctaggttggtttattctaccgtgaattcgtttacccgcataccgaactgctatgctatgatatgtcgtacatcatgccggtcgtatgtctgactatgtatgttacaatgatcgtctagtaatgaaataccatctatattatcctcct

SEQ ID NO: 10977 - DNA, 2078 bp, Panicum virgatum
  misc_feature: Ceres CLONE 1726156
  misc_feature: Encodes the peptide sequence at SEQ ID NO. 10978
gttccccgatcggacccgagccggccggccatggcgattagggctggccgctccgccctcgtcgccctcgccttcctcctcgcggcctccccctgcctccaagccagagtggatcaactttatcatggaagacaggtatccgactggagtaggcaaatcaactttgaactgcaaaatttgtcctcaagtcaaaaggatggccgtcatctcctggcaagtccaaaagagataacacacaggaaattaagggcgaggactgttgtcaggaagaaaatggaagtagtgcagcaggatgatgaagccctagtgaaacttgagaacacaggcatagaacgatcgaaagctgttgattctgctgtgctgggaaaatatagcatatagagacgtgaaaatgaaaatgagaaggcagattcaaggattcgtcagatgagagatcaaatgatcatggctaggatatattctgtgcttgccaaatccagggacaagcttgatctttatcaggaactgctcgcaaggctcaaggaaagccagcgctcccttggggaagctactgctgatgctgaacttccgaagagtgcgttggagagaatgaaagcaatggctcaagttctatcaaaagctagggatttattgtatgattgcaaggctattaccgagcgtttaagagtgatgcttctgtcagctgatgagcaggtccggagcttaaagaagcagagcaccttccttagccagttagcagctaagacaatcccaaatggcatccattgtctatccatgcgcctaacaatagactattaccttctctctccagagaaaagaaagttccctaatagtgagaacttggaaaatcccgagctttatcattatgctcttttctcagacaatgttttggccgcatcagttgtggtcaactcaaccatcatgaatgcgaaggagcctgaaaaacatgtatttcatctggttactgacaagttgaactttggggctatgaacatgtggtttttgctgaatccgcctggggatgcaacaatccatgttgaaaatgttgatgactttaaatggttaaactcctcttactgtcctgttctgaagcagcttgagtctgcagccatgaaagagtactatttcaaggctgatcgtccaaaaacactctctgctgattcctctaatctgaagtatcgaaacccaaaatatctgtccatgctcaaccatctaagattttacctccctcaagtctatcccaagttgaacaaaatccttttcctggatgatgacatagttgtccagagggatctgactggactctgggaggttgatcttaatggaaatgtaaatggggcggtggaaacctgtggagagagctttcatcgatttgacaagtacctcaatttctcaaatccaaatatttctcagaattttgaccctaatgcatgtggttgggcttatggaatgaacatgttcgacctggaagaatggaagaggaaagatattactgggatttaccacaaatggcagaacatgaacgaaaacaggctgctctggaaattgggtacactgccaccaggtcttctaaccttctacaagctgacacaccctctggacaaatcatggcatgtgcttggcctagggtataacccaaccatcgagcgctcagaaatagacaatgccgcagtcatccactacaatgggaacatgaagccctggctggagattgcaatgacaaagtaccgaccttactggacaaaatatatcaattatgaacatccctatattcatggatgcaaggtcagccaatagacaccagctgaaatattcttccgtgatgaacattggagttagatggggctacaaatgaagtcccctgttagtagtataactctgcgacatgttctttatttgtgttattagatttgttagacatccagtgtatgtagttccatcacccatttgtggtgctttgtcccctagtccattgttggttcttgttttacccttctccttttgtcatggaaagaaaagaatgtgatctgtgattctcaatttctcatcagctgataaatgcaatctgcctgaatttg

SEQ ID NO: 10978 - protein, 456 aa, Panicum virgatum
  misc_feature: Ceres CLONE 1726156
  misc_feature (114)..(430): Pfam Name: Glyco_transf_8 Pfam Description: Glycosyl transferase family 8
  misc_feature: Useful for making plants with altered carbohydrate content
  misc_feature: Useful for making plants with altered cell wall content and/or composition
MRDQMIMARIYSVLAKSRDKLDLYQELLARLKESQRSLGEATADAELPKSALERMKAMAQVLSKARDLLYDCKAITERLRVMLLSADEQVRSLKKQSTFLSQLAAKTIPNGIHCLSMRLTIDYYLLSPEKRKFPNSENLENPELYHYALFSDNVLAASVVVNSTIMNAKEPEKHVFHLVTDKLNFGAMNMWFLLNPPGDATIHVENVDDFKWLNSSYCPVLKQLESAAMKEYYFKADRPKTLSADSSNLKYRNPKYLSMLNHLRFYLPQVYPKLNKILFLDDDIVVQRDLTGLWEVDLNGNVNGAVETCGESFHRFDKYLNFSNPNISQNFDPNACGWAYGMNMFDLEEWKRKDITGIYHKWQNMNENRLLWKLGTLPPGLLTFYKLTHPLDKSWHVLGLGYNPTIERSEIDNAAVIHYNGNMKPWLEIAMTKYRPYWTKYINYEHPYIHGCKVSQ

SEQ ID NO: 10979 - DNA, 827 bp, Panicum virgatum
  misc_feature: Ceres CLONE 1726157
  misc_feature: Encodes the peptide sequence at SEQ ID NO. 10980
tgcagcttgcttattgctactagtgttgcagctaggggtttagatgtgaaagaacttgagctggttgtcaattatgatgtccctaaccattatgaggactatgttcatcgtgttgggcgaactgggcgtgctggaagaaagggctttgctgtgacttttatttctgaggaagaggagcggtatgccccagaccttgttaaggccctggagctctcgcagcaagctgttccggaagatctgaaagccctagctgatcggtttatggtgaaggtgaagcagggcacagagcaggcccatggcacaggttacggtggtagtggttttaagtttaatgaggaagaggatgaagccagaaagactgcaaagaaggctcaggcaagggaatatggatacgaagaagacaagtctgattcagattctgatgaggaaggcggggtgcgtaaggcgggaggtgacctggcagcacaagctattgccaatgctcatgctgctgctgctttggttgcaaacaaagctgctagtaatgctaaccagcaagtaccaggaactgcgtcagtccccttgattcctttacttgctgcaactaaccaacaaaatgatgaagccacagctcgtgcacttcaggctgcaatgaacttgcaacaaaatctggcaaggatacaggctcatgcagttccagaacactatgaggctgaacttgagattaacgatttcccacagaatgctcgctggaagatcactcacaaagagacattgactcctattcaggactggactggtgctgctatcactacaaggggaacatatattcctcaaggaaaaattgt

SEQ ID NO: 10980 - protein, 275 aa, Panicum virgatum
  misc_feature: Ceres CLONE 1726157
  misc_feature (1)..(45): Pfam Name: Helicase_C Pfam Description: Helicase conserved C-terminal domain
CSLLIATSVAARGLDVKELELVVNYDVPNHYEDYVHRVGRTGRAGRKGFAVTFISEEEERYAPDLVKALELSQQAVPEDLKALADRFMVKVKQGTEQAHGTGYGGSGFKFNEEEDEARKTAKKAQAREYGYEEDKSDSDSDEEGGVRKAGGDLAAQAIANAHAAAALVANKAASNANQQVPGTASVPLIPLLAATNQQNDEATARALQAAMNLQQNLARIQAHAVPEHYEAELEINDFPQNARWKITHKETLTPIQDWTGAAITTRGTYIPQGKI

SEQ ID NO: 10981 - DNA, 331 bp, Panicum virgatum
  misc_feature: Ceres CLONE 1726157-R
tatttttttgctaacttttttataaggcagctagtgggttggttgctatccacatgattattatgaaatagttttgggggtgtttcgggcaaaatctactgaccaggtttggttacctttggacagaaggcttagaacactggtggtggctggcctgctagtgccaataacgcccaaggaaggcgctcagcttttatggtgcggttttgaaagagatggttgttatggatactgttcttattgttccacttgaaaactgatctgcttgcttatggatattgttccccctttttatgagagacaatacaaagattgtggtgactggtggtcc

SEQ ID NO: 10982 - DNA, 2309 bp, Panicum virgatum
  misc_feature: Ceres CLONE 1726162
  misc_feature: Encodes the peptide sequence at SEQ ID NO. 10983
cctctgcctcgccttcctgccctcttcccaagaagcagagcccaccgcatttccactcggttccccgtgcctccccgcctgcgctaccccagtagccacccctctcggcagttcgattcgccgccaggaccgcggttcggcgtctggatccggcaagctctcgccgacgcgccgcagatccgaacaaatcccagccttcccggtgaactaccccctccagccgcagctctgcgatcgcgatcttcgtctctgttgacactggagctttgcatttgtgtgtggctgtgcaatcaggtgctctagggtcaatttgttttgggtttcttcttcccatcgattcactcgcgctcgcactgccccagtgtgctcactcactctggttgcccggacttcacctcgctgcatcattagcattagaatcgaactccccgtgcgcttgctctactgtctctggccggtggtcacttccatgcgatttttagcgtgctagacgcccgggaccatcaggagctttggtgtcgctgtgggcatggcgttgctgtgagaaatctctagctggggggaaagatgtggaaacagttcctgcacaagctgcctaggaagtcctctgcctccgggaagggcgaccatgccgcaggctctagtccgggacgcaatgatgccgggaacgggagcgggatacagcgcacgagcagctgcccgagcgccgggcctgcccgtccggcgcccggcgtgaagcgcatgtcgtccgcggtgttcccgtcgagcgtggtggctggcattgagccgctcgtgccgttcaaggatgtcccgaacggggagaagccgaacctgtttgtcaccaaggtgagcctgtgctgtgttgtctttgatttctcggaccccaacaagaattcggcggagaaggatttcaaaaggcaggcattggtggatctcgtgggttatgttgattctgctagctcccgcatcacggagccgatggttgttgcctgctgcagaatgtttgctatcaacttgttcagggtgttccctcccaagtgcaggtccagttcatctggcggtggtgagggtgaagaggaggagccaatgtttgaccctgcatggccccatctgcatcttgtgtatgatctcctactgaaatttattggctcctcatctctggatgcaaaggtaggaaagaaatattttgaccacacattcatcgtaaagttgcttgagctcttcgattctgaggacccaagggaaagggactgcttgaaaacaatattgcatcgaatctatggaaaattcatggtgcaccgtcctttcatccgcaaagcagtgagcaatatattctaccattttgtgtttgagactgatcgccataatggtattgctgaactgttggaggtttttggcagtgttattagtgggtttgcattgcctctgaaggaggaacacaaaatctttctttggagggtactaattcctttacacaagccaaaaacagtcggtgtgtatctgcagcagctaacctactgtgtgacccagtttgtagagaaggagccaaagcttgcaagttcggtgatacttggcttgctcagatactggccaataacaaatagtcaaaaagaggtaatgtttctgagtgagattgaagaggtcctggaggcaaccaacatggtcgaattccagaaatgcatggttccattgttccgacgaattgctcactgcatcaataattcccacttccaggttgcagagcgagcactcttcatgtggaacaatgaccacatcgtcagcttggtcgcacaaaaccggcaaatgatcgtgcccattgtcaccccagcattggaagagaatatccagaaccactggaacgtatcggtcctaaacctgacagccaatgtgaagaagatgttgtcagagatggacgaggagctcttttccacctgccttgccaggcataaggaagacggagagaggcaggcgttgctggaacagaagcgaaggctagcatgggagtggctagagtccgtggcggcgttccagccagtgaccggcaacacggccgtcctggtgagccgctaggcatcaggtgtcggagggacgctgcaactccttcctcctgtgttcgcttggtgaaaacggtcctattgctgaacagaacagcactttgtttagttttcgtagaagtagaaatataccatgttttaagccgtgactattcgtcatgggatctctctgtctctctgataggataaaaggcatcatgcatgcctgtttcatgctcgtgcctgtgttatgagcagcgtcattcagctttgttc

SEQ ID NO: 10983 - protein, 500 aa, Panicum virgatum
  misc_feature: Ceres CLONE 1726162
  misc_feature (74)..(486): Pfam Name: B56 Pfam Description: Protein phosphatase 2A regulatory B subunit (B56 family)
MWKQFLHKLPRKSSASGKGDHAAGSSPGRNDAGNGSGIQRTSSCPSAGPARPAPGVKRMSSAVFPSSVVAGIEPLVPFKDVPNGEKPNLFVTKVSLCCVVFDFSDPNKNSAEKDFKRQALVDLVGYVDSASSRITEPMVVACCRMFAINLFRVFPPKCRSSSSGGGEGEEEEPMFDPAWPHLHLVYDLLLKFIGSSSLDAKVGKKYFDHTFIVKLLELFDSEDPRERDCLKTILHRIYGKFMVHRPFIRKAVSNIFYHFVFETDRHNGIAELLEVFGSVISGFALPLKEEHKIFLWRVLIPLHKPKTVGVYLQQLTYCVTQFVEKEPKLASSVILGLLRYWPITNSQKEVMFLSEIEEVLEATNMVEFQKCMVPLFRRIAHCINNSHFQVAERALFMWNNDHIVSLVAQNRQMIVPIVTPALEENIQNHWNVSVLNLTANVKKMLSEMDEELFSTCLARHKEDGERQALLEQKRRLAWEWLESVAAFQPVTGNTAVLVSR

SEQ ID NO: 10984 - DNA, 1283 bp, Panicum virgatum
  misc_feature: Ceres CLONE 1726168
  misc_feature: Encodes the peptide sequence at SEQ ID NO. 10985
gccattgctcacttgctcagctcagcagagcactgtacactacacatccatactgacagctggttcgtctctggctgctgcggtggtagcagcaagaagaggtggctggagctagctagaggggaagacgatcgatcgagcgagagacgacgatggacgtgaacaacgtgctgctggtggtgctggcggcggcgctggcggccatgtggtggcggcggtgctccaagaccggcggcgcggacggcctcccgccggggccgccggggtggccggtggtgggcaacctcttccaggtgatcctgcagcggcggcccttcatgtacgtggtgcgcgacctgcgcgagaagtacgggcccatcttcaccatgcgcatggggcagcgcaccctcgtcgtggtcacctccgcggacctcatccacgaggcgctcgtcaagcagggccccatgttcgccagccgccccgaggacagccccacccgcctcctcttcagcgtcggcaagtgcaccgtcaactccgcgccctacggcccgctctggcgcgcgctccgccgcaacttcgtcgccgagatcgtgtcgccgcaccgggtcaaggccttctcctggatccgggagtgggccgtcaacgcccacctgcgccgcctccgcgccgagtccgccgccgccggcgccgtgcgcgtgatggccagctgccgcctcaccatctgcagcatcctcatctgcatctgcttcggcgccaaggtccccgacgacctcatccgggagatcgaggaggtgctcaaggacgtcatgatgatgaccatgcccaagctcccggacttcttgccgctcctcacgccgctcttcaggaagcagctcgccgaggcccgccgcctgcgccgccgccagctcgactgcctcgtgccgctcgtgcgcgcgcgcagggagttcctccgcgacggcggcaccaggaaggcggcggccgccggcgtcgagatgatgagcgggcccggcgaggcgtacgtggactcgctcttcgacctcgagccgcccggccgcgggaagcgcctcggcgaggaggagctcgtcacactctgctccgaggtcatgagcgccggcaccgacaccagtgccaccgcgctcgagtgggccatgatgcacctcgtcctcgaccccgccgcccaggagcgactctacgacgaggtcgtcggcaaggtcggcaagaccgcccggatcaccgaggccgacgtcgaggccatgccctacctgcaggcggtggtgaaggagacgttccggcggcacccgccg

SEQ ID NO: 10985 - protein, 376 aa, Panicum virgatum
  misc_feature: Ceres CLONE 1726168
  misc_feature (33)..(376): Pfam Name: p450 Pfam Description: Cytochrome P450
  misc_feature (246)..(376): SWISSPROT Homolog: EC 1.14.13.87 Licodione synthase
  misc_feature (41)..(181): SWISSPROT Homolog: EC 1.14.13.89 Isoflavone 2'-hydroxylase
MDVNNVLLVVLAAALAAMWWRRCSKTGGADGLPPGPPGWPVVGNLFQVILQRRPFMYVVRDLREKYGPIFTMRMGQRTLVVVTSADLIHEALVKQGPMFASRPEDSPTRLLFSVGKCTVNSAPYGPLWRALRRNFVAEIVSPHRVKAFSWIREWAVNAHLRRLRAESAAAGAVRVMASCRLTICSILICICFGAKVPDDLIREIEEVLKDVMMMTMPKLPDFLPLLTPLFRKQLAEARRLRRRQLDCLVPLVRARREFLRDGGTRKAAAAGVEMMSGPGEAYVDSLFDLEPPGRGKRLGEEELVTLCSEVMSAGTDTSATALEWAMMHLVLDPAAQERLYDEVVGKVGKTARITEADVEAMPYLQAVVKETFRRHP

SEQ ID NO: 10986 - DNA, 680 bp, Panicum virgatum
  misc_feature: Ceres CLONE 1726168-R
  misc_feature: Encodes the peptide sequence at SEQ ID NO. 10987
tgacggagaacccggcgacgtggccggacccggcggcgtggcgccccgagcggttcctcgacggcggcgagggcttcgacaccgacatcaccggcacccgcgcgctccgcatgatgcccttcggcgccggccgccgcatctgccccgccgccacgctcggcgtgctccacatccagctcatgctcgccaacatggtgcgcgagttccggtgggtgccccccgccggcgagggcccgccggaccccaccgagaccttcgccttcaccgtcgtcatgaagaactcgctccgcgccgccatcgtcgagcgggcgccggccgcggcggcgacggcgtaacgccggcccggccggggcggcgccattgaatttgccacgtacgtgaacgtgtgctgccgcggtgcgtttgtgctgtacgggtcggtaattacggcgggggttaaatttggtgcggcggcggtataaattctccacggtggtcggcggatcgatcctggctgttggttggttgacggacggatggatggatgtgcaagcacgaggctaccataaattctttttttctccttgtagcgtgcctctgttctagtatggatttctattgttttagaattctttttttctttctcgatttgatgaaaagatgtacgtactactaccactaccaatgctctcgatcttctc

SEQ ID NO: 10987 - protein, 110 aa, Panicum virgatum
  misc_feature: Ceres CLONE 1726168-R
  misc_feature: SWISSPROT Homolog: EC 1.14.13.21 Flavonoid 3'-monooxygenase
TENPATWPDPAAWRPERFLDGGEGFDTDITGTRALRMMPFGAGRRICPAATLGVLHIQLMLANMVREFRWVPPAGEGPPDPTETFAFTVVMKNSLRAAIVERAPAAAATA

SEQ ID NO: 10988 - DNA, 2499 bp, Panicum virgatum
  misc_feature: Ceres CLONE 1726171
  misc_feature: Encodes the peptide sequence at SEQ ID NO. 10989
tcccacaccaaaactcactcgaacaggcaatctccacctccccctcctcctccgcccccctcccgcaatctccgccgagctcccacctccgccgcgtcaatgaagccgccgcagtggaccgagctgcagcggttcaacccgggggatctcgtcgaggtggtccccgacgagcccggcgagcaaggggcccactgcgcagccgtcgtcgtggagcacagcacccagccccgcggctacaccgtcgagtacgacgacctcgtcgagcgcgagggctccgaccgcccgctccgggaggtcgtgccggcgcagatcctccgcccgcacccgccgccacgctgcacctactcgggggaggctcccggggagcacgccgccgtcgacgcgttcctcgacggcgcctggtggctcgcggtctacctcggcgtcgtggacgggggcgggaaggtcagggtgtgcttcccggatacgcgggaggtcatgaacttcgacgccgccgacgtccgaccccacttcgagtgggggtggggcggctcttttaggaagcgctccgccttgggcatggagatgaccgtggcagtgccgtacacgaaaggaatgacaattgaagtttccaagttggtagataattttgttgttgcttggttgcctgcatttgttgtgaagactttctggaagagcaacctcttagtggattacactgtttcgaatagtgatggtactgcattgcctgaggagattgttgatgtgaagcacgtcaggccatgcctaccacaggcatcagctattagtttctgcatcaatgataaggttgaagcattccaaggcggtggctggtggctaggggtgatcactgatgttcatccagaattaaaatacacatttaagtcagcacatttaggggtggaagttcagttgagccaaaaattactgaggcctagatatgactgggtttatggtccacggaaacaagaatcagagaatgtcagcagcaatgatgaaaagtttggtggagcttggtttgaggttgcacgcagcaagggtactgcttctcctagcaaaacaacaaccaaataatccctcttggaagagcactactcccaaatccagccctcctcccagagctgctccaataaagaagaggaaacgtcgagctgatggtcatggacgaccggaccttgcgccaagcctggtgaagaaacacaggtctcccaaactcaggccatctgaagaaaacaaactctgcaagtcgtcttccaaggggatatatccagacctccatgaaaagcatctgctcagagatgcccctcgtccagatgagcaggcgaaacctgctccacaacctgagcccactcctgcacctgctcaaaggaggaaaaccattctgaatctgtatgttccaatgattcagcctgcagctgtaccagacgccaccatctcaccccatactcgggcatccgatgttcagaataatgaggcagtacagaatactgttcctgaggtagggacgggaaccaagtccccagccaaatccctgcccactcctgcacctgctcaaaggaggaaaaccattctgaatctgtctcttccaatgattcagcctgcagctgtaccagatgccaccgtctcactccatactcgggcatccgatgttcagaataatgaggcagtacagaatactgttcctgaggtagggacgtgcaccaagtccccagccaaatccctgcccactcccttggataacataatcaaagagctgaaagattgccgagagcaatggcttcaagcccagtcacaactagatcattcagcgactaaggccaaggaaatggagggacaggtggccaaactccgagcagcccatgaagctgatgcacagcaccttcgggaggtgatgaacaagcaggcaagccttgaacaaagactcaagctgaaggacaaggagattgaagacctgaaagagaagctcgttgatttggatgagcagaagtcctgcgttgaagctgagcttccctggggcgctgtgatggccgcttcccatgctcttggagtgctgaaaaatcatgtccctgatctagatattgggatcttaagcaaggggtatgcatgcacgcctgcagaggcccaagctctggccaatcaagttcgtccaatagttgaacccttcatcgagcgtcttgggctgtcggtgagtgttgtggacgcctttgttgggcgtacctatatgtgtagggccaaggaggggtaggcgtcagcaagttgggtgttagtttcgtcagaagatcagcaagaggttaggatagttggaaggcaatcttatcaggtcaggtttgttagggatttgttagtagccggcgttatataagccggggaagtcctggagtctgtaaaaaaaaaaaaaactaagaaggaatttatctcgttgagagcctcttcggagggagaacagggagatatccttgtaaatttcaattaataaagctgatctcgttaagcccgcag

SEQ ID NO: 10989 - protein, 324 aa, Panicum virgatum
  misc_feature: Ceres CLONE 1726171
  misc_feature (12)..(80): Pfam Name: Agenet Pfam Description: Agenet domain
  misc_feature (162)..(227): Pfam Name: Agenet Pfam Description: Agenet domain
MKPPQWTELQRFNPGDLVEVVPDEPGEQGAHCAAVVVEHSTQPRGYTVEYDDLVEREGSDRPLREVVPAQILRPHPPPRCTYSGEAPGEHAAVDAFLDGAWWLAVYLGVVDGGGKVRVCFPDTREVMNFDAADVRPHFEWGWGGSFRKRSALGMEMTVAVPYTKGMTIEVSKLVDNFVVAWLPAFVVKTFWKSNLLVDYTVSNSDGTALPEEIVDVKHVRPCLPQASAISFCINDKVEAFQGGGWWLGVITDVHPELKYTFKSAHLGVEVQLSQKLLRPRYDWVYGPRKQESENVSSNDEKFGGAWFEVARSKGTASPSKTTTK

SEQ ID NO: 10990 - DNA, 656 bp, Panicum virgatum
  misc_feature: Ceres CLONE 1726174-R
  misc_feature: Encodes the peptide sequence at SEQ ID NO. 10991
caaaacctgttgatgaagtgaaagatcattgggttccagatgaggttgccaagaaatgccactcatgtgctgttgattttagtccttttaatcgcaggcatcattgtaggaactgtggtgaaatcttctgtgacaaatgcagtcagggaagaattgctctgacagctgaggataatgctccacttgtccgagtttgtgatagatgcatggctgaggtcacgcaaaggcttagcatggctaaggaagctgccagcagatctgcaaccgtgcaaagtcatgaagatcttgcaagaaaacttaaggaggaaatggagcggaaccgcaagtcttcaggtccggcatctggtggtggtgcatctggtaccagaatgagggaagttgcatgccctacctgcactgtccatcttcaggttcaggttccaacatctggctcagagacagtggagtgcggagtgtgccagcatgccttccttgtcagcgccaattgaaacatggggaggcagtgcatgctatagaaattattccgttgattattcagcttcttttttattctacacataataagcgtgtgttctgtcgacctgtacatgttgacttgattgtgttggtgatcacgataggatatgttatcttttccttgtacatgactggatttt

SEQ ID NO: 10991 - protein, 161 aa, Panicum virgatum
  misc_feature: Ceres CLONE 1726174-R
  misc_feature (8)..(74): Pfam Name: FYVE Pfam Description: FYVE zinc finger
  misc_feature: SWISSPROT Homolog: EC 3.1.3.48 Protein-tyrosine-phosphatase
KPVDEVKDHWVPDEVAKKCHSCAVDFSPFNRRHHCRNCGEIFCDKCSQGRIALTAEDNAPLVRVCDRCMAEVTQRLSMAKEAASRSATVQSHEDLARKLKEEMERNRKSSGPASGGGASGTRMREVACPTCTVHLQVQVPTSGSETVECGVCQHAFLVSAN

SEQ ID NO: 10992 - DNA, 258 bp, Panicum virgatum
  misc_feature: Ceres CLONE 1726174
gcaaacgcgactcaacgaatcggatcaaaccaaattcgccatccacctcgtcggcgccaccggcctcgagcgcctgcccgccgcccgatcggccaccggagatgcagcacgggagcggcgactacgccgcatccggccccgccggccactactacccgcaccagtacgcgcccccgggctccaacccgtatccagccgctaccgacgcaccggcgccgggggcgggggcggggggctggcgctcggggccggtggcgc

SEQ ID NO: 10993 - DNA, 867 bp, Panicum virgatum
  misc_feature: Ceres CLONE 1726175
  misc_feature: Encodes the peptide sequence at SEQ ID NO. 10994
aagtgatcagggcgcgaccctcggccgcagcgcatgagataaattcggagcaccaccgccggctcagtttcgtctggctggctggcttggcatcggccatcggcacccggcaggcggcgggcggcagcagcgcaggatggccacccacgctgctctcgccgcgtcgcgcatccccacaggcacccggctgcacagcagggcggcgtccaggcagagggtggacttcgccgacttctccgggctgaggccgggatcatgctccgtcagcaccgccgccagggaggcgtcattctccgacgtgctcggtgcgcagctcgtcgccagggccaccggagagaacgcggtgagggcgcccgctgaggccaagctcaaggtggcgatcaacgggttcggccgcatcggccggaacttcctccggtgctggcacggccgcaaggactccccgctcgatgtcgtcgtcgtcaacgacagcggaggcgtcaagaacgcgtctcacctcctcaagtacgactcgatgctcggcaccttcaaggccgacgtcaagatcgtcgacgacaccaccatcagcgtcgacggcaagctcatcaccgtcgtctccaacagggacccgctcaagctcccatgggccgagctcggcatcgacattgtcatcgagggtaccggagtcttcgtcgacggcccgggcgccgggaagcacatccaggccggcgcgaagaaggtcatcatcactgctccggccaagggcgccgacatcccgacctacgtcgtcggcgtcaacgagggcgactacgaccacggcgtggccgacatcatcagcaatgcttcctgcacgaccaactgcctcgcggcggtcgtcaaggtcttgga

SEQ ID NO: 10994 - protein, 243 aa, Panicum virgatum
  misc_feature: Ceres CLONE 1726175
  misc_feature (78)..(231): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MATHAALAASRIPTGTRLHSRAASRQRVDFADFSGLRPGSCSVSTAAREASFSDVLGAQLVARATGENAVRAPAEAKLKVAINGFGRIGRNFLRCWHGRKDSPLDVVVVNDSGGVKNASHLLKYDSMLGTFKADVKIVDDTTISVDGKLITVVSNRDPLKLPWAELGIDIVIEGTGVFVDGPGAGKHIQAGAKKVIITAPAKGADIPTYVVGVNEGDYDHGVADIISNASCTTNCLAAVVKVL

SEQ ID NO: 10995 - DNA, 196 bp, Panicum virgatum
  misc_feature: Ceres CLONE 1726175-R
gtttacctaaagaagaacttcaagttttgattcaagcagcatgacttcatgacttcttgtggcagtgattccattatttattcaatcatgtaccataaataacatgacctgcatttgcaagaagatgagaaaatgtaggtttactgtcacttggttaaagatgaaaaaagactttccttgatactttctactgatc

SEQ ID NO: 10996 - DNA, 800 bp, Panicum virgatum
  misc_feature: Ceres CLONE 1726176
  misc_feature: Encodes the peptide sequence at SEQ ID NO. 10997
ttttccgacctataactccccgtgcgctctcgtccgtcgtcttcgcgaggtcgaaccccaaggcgaggcagcgaaaccctgagtcggccggccagtgcgaggggagagagtgcgcgaggcggcggagggcgaaatgaagctcaacgtcaagaccctgaagggcaccagcttcgagatcgaggcgagccccgaggagacggttgctggggtgaagcggatcatcgagacgactcagggacagagcgtctaccccgccgacaaccagttgctcatataccaagggaaaattctcaaggatgacaccactttggaaagcaacaaagttgctgagaacagcttccttgttataatgctgtccaaggctaaggcatcgtcaagtggaccttctaccgctactcctgcaaaagctcctgcaactccggcccaacttgctacgcctgcagcccctgctgcttcagttgcaagatcaacacctcctcaagcgcctgttgccgcggcagtaacggcgcctccaactgcacagccttcacctgctcctgctgctactgctccagctgctacagttgctgcatctgatgctgatgtgtacggtcaggcagcatcaaaccttgtctctggtagcaatctagaacagactatccaacagattcttgacatgggtggcggtacatgggaacgtgatactgttgtccgtgctctacgtgctgcatataataaccctgagagggcaatagactatctatattctggaattcctgagaatgttgaggccccgcctgtggctcgagcacctgcttctg

SEQ ID NO: 10997 - protein, 222 aa, Panicum virgatum
  misc_feature: Ceres CLONE 1726176
  misc_feature (6)..(78): Pfam Name: ubiquitin Pfam Description: Ubiquitin family
  misc_feature (164)..(203): Pfam Name: UBA Pfam Description: UBA/TS-N domain
MKLNVKTLKGTSFEIEASPEETVAGVKRIIETTQGQSVYPADNQLLIYQGKILKDDTTLESNKVAENSFLVIMLSKAKASSSGPSTATPAKAPATPAQLATPAAPAASVARSTPPQAPVAAAVTAPPTAQPSPAPAATAPAATVAASDADVYGQAASNLVSGSNLEQTIQQILDMGGGTWERDTVVRALRAAYNNPERAIDYLYSGIPENVEAPPVARAPAS

SEQ ID NO: 10998 - DNA, 400 bp, Panicum virgatum
  misc_feature: Ceres CLONE 1726176-R
agggaaacatactagggtcaactagcagcagcccatgccacaagcggtgacagttactccggagggaacgggaggctatccagcggctcgaggggatggggttcaatcgtgagcttgtgctggaggttttctttgcgtgcaacaaggacgaggagcttgctgccaactaccctcctggatcacggccatgagtttgacgagccgccccaatagatgctagattggtgatatcgtgggggtggaggaggggaaacccagggagaagcagagcagctcagtgtcttattccttgtggcagttgagaaatacctggtcctctatgcagtgctgctgacaatctttttttttcatatatgtgtctggaatgctttctaagtacatattaattccatatttcgtg

SEQ ID NO: 10999 - DNA, 827 bp, Panicum virgatum
  misc_feature: Ceres CLONE 1726184
  misc_feature: Encodes the peptide sequence at SEQ ID NO. 11000
atgttaccttagtccatagaacaaccgcgccgctaagataggagatgcaaggcactgtgacgatgaccaccttatccctgagacctgcagggcagtgcaatgggagctgcctgctcgcacctgccacaggacggcaaccacgtatttcttggtggcgtcggcagcagaggcaaaccacgctgcatcgccagcaaatgcaacagtgttcagtggcaacattacacaatgataaggttgacgatcgcttgggcaagaatccatgcaattttcatccttctatatggggagatttcttcctacactactacgacgcagcagcttcctccaaacagcagacgtggatggtagaacaagcagatgaagtgaagcaagacgtggcaaaaatagtagcaagttcagttgcttgggaccttcatcataggctacaacttatcgatgcgctggagcgtctgtgcttggatcatttgttcgaagatgacattaatgctgcactgactcaaattaggacagttaatcttactgactgtgatcttcacacggtggctatgtggttttatctgcttcgtaagcacggacacagagtttcaccagatgtgtttgtgaggttcaaagatcaagaggggagctttcttgcgaacaatccagtggagctattgagtctgtataatgctgcacacctcggaacacatggagagataatactaaatgaagccgtagtatttaccagaactcatttagaagcaatattaccctcgctggaaggatcattagcacatgaaaatcaatgtgcacttgagattcccctccctagaagggtcagaatttac

SEQ ID NO: 11000 - protein, 260 aa, Panicum virgatum
  misc_feature: Ceres CLONE 1726184
  misc_feature (80)..(260): Pfam Name: Terpene_synth Pfam Description: Terpene synthase, N-terminal domain
  misc_feature: SWISSPROT Homolog: EC 4.2.3.13 (+)-delta-cadinene synthase
MQGTVTMTTLSLRPAGQCNGSCLLAPATGRQPRISWWRRQQRQTTLHRQQMQQCSVATLHNDKVDDRLGKNPCNFHPSIWGDFFLHYYDAAASSKQQTWMVEQADEVKQDVAKIVASSVAWDLHHRLQLIDALERLCLDHLFEDDINAALTQIRTVNLTDCDLHTVAMWFYLLRKHGHRVSPDVFVRFKDQEGSFLANNPVELLSLYNAAHLGTHGEIILNEAVVFTRTHLEAILPSLEGSLAHENQCALEIPLPRRVRI

SEQ ID NO: 11001 - DNA, 811 bp, Panicum virgatum
  misc_feature: Ceres CLONE 1726196
  misc_feature: Encodes the peptide sequence at SEQ ID NO. 11002
actcgtttcattttcttcgccccgcccgaagccgaggaggagagggtaggggagcagcgggatcgcgcgcgcccgagatctcccggaagttgtggcaacatggggctcaccttcacgaagctcttcagccgcctcttctccaagaaggagatgaggatcctcatggtcggtctcgatgcagctggtaagaccaccatcctctacaagctgaagctcggggagatcgtcaccaccattcccacaatcgggttcaatgtggagactgtcgaatacaagaacattagctttactgtctgggatgtcgggggtcaggacaagatcagaccactgtggaggcactacttccagaacacacaaggtcttatctttgtcgttgatagcaatgacagagatcgtgttgttgaggcaagggatgagctccacaggatgctgaatgaggtaagttatatataaatagttgcattcatgttttttgttatcagttgcatggtcgatcatgtgcagacatctcaaattttcttggacaatggcagtaaaattttgttggagtgttctcctcaagctatgttcaaaatgccaccttagtctattaagtataattaattctagagtagcaatatgcatgatcactgacttctacacgcaaaagttacataatggatttgagttgcgtgcagtatgggcatcctctctagaatcaagatggtaaacaattacgtagtacggagtaccacaacaaagaatttaaattactcgatctgaatggtgggaaacactaaacattttgttctactggagatattacctatag

SEQ ID NO: 11002 - protein, 117 aa, Panicum virgatum
  misc_feature: Ceres CLONE 1726196
  misc_feature (5)..(117): Pfam Name: Arf Pfam Description: ADP-ribosylation factor family
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with altered terpenoid content
MGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEVSYI

SEQ ID NO: 11003 - DNA, 663 bp, Panicum virgatum
  misc_feature: Ceres CLONE 1726196-R
gtcggtatgctcatttaagagtactcattccatggcttaattatccttctaggttcttgtattttgcaattacacttggactatgctgcatgcatcaacaatctatttgaataattactgtaagaaaaagagttattattttgttggcataagctttgagtgttcatccacatggcatttgcaggatgagttgagggatgctgtcttactcgtttttgctaacaagcaagatctgccaaatgcaatgaatgctgctgagataacagataagcttggtctccattccctgcgccaacgccactggtatatccagagcacctgtgctaccacaggagaaggtttgtacgagggtctggactggctctccaacaacattgcaaacaaggcctgattgtacaattctgcggtttcatggattacatgtcgattgcatcttccgcagaaacagacccatgggtcattttgaccttgagacttcagacttcattattatttcgttagaatgtttttcaagtattgtatttctttgctaggcttttcagagagctggttttctgttacattgtgtgattatactctctaaaatcctgttcggatatcaagacactgtaattggccattggcactagatcgtatactgagtaatgcagtttatttcaatgc

SEQ ID NO: 11004 - DNA, 1743 bp, Panicum virgatum
  misc_feature: Ceres CLONE 1726211
  misc_feature: Encodes the peptide sequence at SEQ ID NO. 11005
accaaactctggaacgcgagcacacaagtcatctcctcacctccctcttgtctggctcgcgcgagcggttggtgcgcgacctgagagcaccaggggcggcgagaagatggccggagcagcggcggtcgacgtgccggcgccggcggcggccaacggcggggcgtgctgccacgccgcgaaggggcccgggtacgcgacgccgctggaggccatggagaagggcccgagggagaagctcatctacgtcacctgcgtctacaacggcacaggcattaacaagccagattaccttgcgacggtggatttggatcccaactctcctacatactcccaagtgatccacaggctcccggtgacccacattggcgatgagctgcatcactctggctggaattcttgcagctcctgccacggcgatccatcagcggaacgccgcttcttgatcctgccttcattgctgtcaggtcgtgtgtatgttgttgacactgctacagacccgagagcgccgtccttgcataaggtggtccaggccgaggacattgctgagaagactggacttgggtttcctcacacatcgcattgccttgcatctggtgacattatgatatcttgccttggggacaaggaggggaatgcagccggcaatggcttcctcctgttggattcagagtttaatgtcaaagggcgttgggaaaagccaggtcacagccccttgtttggctatgacttctggtaccagcctcgtcacaagacgatgatcagttcaacatggggagcccctgcagccttcaggacaggtttcaatcttcaacatgtccaggatggtctctacggaaggcatcttcatgtgtatgactggcctggtggtgagctcaagcagacccttgatttaggagacacgggacttcttccccttgaggtgagttttttacatgacccatcaaaggacactggttacgttggatgtgctttgacaagcaacatggttagatttttcaaaactgcagatggatcatggagccacgaggttgctatcgatgtaaaaccactgaaggtccgcaactggattctgccagaaatgccaggattgataactgattttgttatttctcttgatgaccgctatctctacttggtcaattggcttcatggggatatcaggcagtacaacattgaggaccctgccaagcctgtcttggcgggacaagtatgggttggtgggcttcttcagaagggcagcgatgtcgtctatgttactgatgatggccaagaagaacagtataatgtgccccaggtcaaagggcatcgacttagaggtggacctcagatgattcagctgagcttggatggcaagaggatatatgtaaccaactcacttttcagccgttgggatgagcagttctatggtgatgatcttgtcaagaagggctcccacatgctgcagatcgatgttgacactgagaaaggaggactggctatcaaccccaacttcttcgtagattttagcaaggagcctgatggtcctgccttagcccatgagatgagatatcctggtggggactgcacgtctgatatatggatctaaggtcatggattggcataatagtctgctggaggtccttgttgtatgcactgtaattaagatggtattatacagtgtttcatcttgtactgtgactactgccactggaataagccatggtttcatgagagcttgagcctaataaaagatgtctcggttat

SEQ ID NO: 11005 - protein, 492 aa, Panicum virgatum
  misc_feature: Ceres CLONE 1726211
  misc_feature (23)..(492): Pfam Name: SBP56 Pfam Description: 56kDa selenium binding protein (SBP56)
MAGAAAVDVPAPAAANGGACCHAAKGPGYATPLEAMEKGPREKLIYVTCVYNGTGINKPDYLATVDLDPNSPTYSQVIHRLPVTHIGDELHHSGWNSCSSCHGDPSAERRFLILPSLLSGRVYVVDTATDPRAPSLHKVVQAEDIAEKTGLGFPHTSHCLASGDIMISCLGDKEGNAAGNGFLLLDSEFNVKGRWEKPGHSPLFGYDFWYQPRHKTMISSTWGAPAAFRTGFNLQHVQDGLYGRHLHVYDWPGGELKQTLDLGDTGLLPLEVSFLHDPSKDTGYVGCALTSNMVRFFKTADGSWSHEVAIDVKPLKVRNWILPEMPGLITDFVISLDDRYLYLVNWLHGDIRQYNIEDPAKPVLAGQVWVGGLLQKGSDVVYVTDDGQEEQYNVPQVKGHRLRGGPQMIQLSLDGKRIYVTNSLFSRWDEQFYGDDLVKKGSHMLQIDVDTEKGGLAINPNFFVDFSKEPDGPALAHEMRYPGGDCTSDIWI

SEQ ID NO: 11006 - DNA, 1570 bp, Panicum virgatum
  misc_feature: Ceres CLONE 1726216
  misc_feature: Encodes the peptide sequence at SEQ ID NO. 11007
atcaccacccacgttgagacacgagttcctccctcgtccctcccacctgggctcccccgcctccacgccgctccgctacgcgcgcccgccccgcctcgcctagtccgcgtcccctgcctctcttctcctccgtagcctgcctctgcgcattagtggaagccgagctgacaacaatctatcaagagttgcttcgacatggatactggctgtttatcatctatgaacattactggagtgagccaagcaagatcttttgcgggaaaacttcctacccagagatgctttgcaagtagtcaccttgcaagctttgctgtgaaatctcttatcttgaggaataaaggaagaagctcacaccgtagacattctgctttgcagattgtctgcaaggattttccaagacctccgctagaaagcacaataaactatttgaaagctggacagctctcttcattttttaggaacagcgaacgccccagtaaacccttacaggtcgtgattgctggtgcaggattagctggtctttcaacagcaaaatatctggcagatgctggccataaacccatattgcttgaggcaagagatgttttgggtggaaaggtagctgcttggaaggatgaagatggagattggtacgagaccgggcttcatatcttttttggagcttatcccaacatacagaatttatttggcgagcttggtattgaggaccgtttgcaatggaaagaacactccatgatatttgccatgccgaataagccaggagaattcagccggtttgatttcccagaaactttgccagcacctgtaaatggaatatgggccatactgaaaaataatgaaatgcttacctggcctgagaaggtgaagtttgctattggacttctgccagcaatgcttggtggtcaaccttatgttgaagctcaagatggcttgacagtttcagagtggatgaaaaagcagggtgttcctgatcgagtgaatgatgaggtttttattgcgatgtccaaggcactgaatttcataaatcctgatgaactatccatgcagtgcattttgattgctttgaaccgatttcttcaggaaaagcatggttccaaaatggcattcttggatggcaatccacctgaaagactatgtatgcctattgttgatcacattcggtctaggggtggtgaggtccgcctgaattctcgtcttaaaaagatagagctgaatcctgatggaactgtgaaatattttgcacttactgatggaactcaaataactggagatgcttatgtttgtgcagcaccagttgatatcttcaagcttcttgtacctcaagagtggagtgaaatttcttatttcaagaagctggagaagttggtgggagttcctgttatcaatgttcatatatggtttgacagaaagctgaaaaacacatatgaccaccttcttttcagcaggagttcacttttaagtgtctatgcagacatgtcggtaacctgcaaggagtactatgatccaaaccgttcaatgctggagttggtctttgctcctgctgaggaatggattggtcgaagtgacgctg

SEQ ID NO: 11007 - protein, 458 aa, Panicum virgatum
  misc_feature: Ceres CLONE 1726216
  misc_feature (106)..(456): Pfam Name: Amino_oxidase Pfam Description: Flavin containing amine oxidoreductase
  misc_feature: SWISSPROT Homolog: EC 1.14.99.30 Carotene 7,8-desaturase
MDTGCLSSMNITGVSQARSFAGKLPTQRCFASSHLASFAVKSLILRNKGRSSHRRHSALQIVCKDFPRPPLESTINYLKAGQLSSFFRNSERPSKPLQVVIAGAGLAGLSTAKYLADAGHKPILLEARDVLGGKVAAWKDEDGDWYETGLHIFFGAYPNIQNLFGELGIEDRLQWKEHSMIFAMPNKPGEFSRFDFPETLPAPVNGIWAILKNNEMLTWPEKVKFAIGLLPAMLGGQPYVEAQDGLTVSEWMKKQGVPDRVNDEVFIAMSKALNFINPDELSMQCILIALNRFLQEKHGSKMAFLDGNPPERLCMPIVDHIRSRGGEVRLNSRLKKIELNPDGTVKYFALTDGTQITGDAYVCAAPVDIFKLLVPQEWSEISYFKKLEKLVGVPVINVHIWFDRKLKNTYDHLLFSRSSLLSVYADMSVTCKEYYDPNRSMLELVFAPAEEWIGRSDA

SEQ ID NO: 11008 - DNA, 646 bp, Panicum virgatum
  misc_feature: Ceres CLONE 1726216-R
  misc_feature: Encodes the peptide sequence at SEQ ID NO. 11009
gatgaaattgctgctgatcagagtaaagcaaaaattcttaagtatcatgtggtgaagacaccgagatcggtttacaaaacggtcccaaactgtgaaccttgccgacctctccaaaggtcacctatcgaagggttctatctggctggcgattacaccaagcagaaatacttggcttccatggaaggtgcagttttatccgggaagctttgtgcccagtctatagtgcaggattatagcacgctctccctcaggagccagaaaagcctgcaatctgaagaagttccggtcgcatcttagttgtagttcaggctcccagtggtgtgtcatcttatcacctatttcatgggaatccaccaactgctcatgttggaggcacctatggtccattgacaattcccaagagctgaattgtgacagtagttggtatcgtcatatatgtaaaacgacctgcatagcaatttgttagacttttgcaaaaaggaaaagcggaaaagagacctcagatagatattatctttgtagcactttcggttggtgtggcttccatatatccatcccacgtgggaagacttgttcatggggcttcaggtaagcaaagccattggctcaactttattacgtgaggtgtgctgtgttccattcacag

SEQ ID NO: 11009 - protein, 98 aa, Panicum virgatum
  misc_feature: Ceres CLONE 1726216-R
  misc_feature: SWISSPROT Homolog: EC 1.14.99.30 Carotene 7,8-desaturase
DEIAADQSKAKILKYHVVKTPRSVYKTVPNCEPCRPLQRSPIEGFYLAGDYTKQKYLASMEGAVLSGKLCAQSIVQDYSTLSLRSQKSLQSEEVPVAS

SEQ ID NO: 11010 - DNA, 603 bp, Panicum virgatum
  misc_feature: Ceres CLONE 1726217-R
  misc_feature: Encodes the peptide sequence at SEQ ID NO. 11011
atcatgtagtgaagacaccgagatcggtttacaaaacggtcccaaactgtgaaccttgcagacctctccaaaggtcacctatcgaagggttctatctggctggcgattacaccaagcagaaatactgggcttccatggaaggtgcagttttatccgggaagcttcgtgcccagtctatagtgcaggattatagcccgctctccctcaggagccagaaaagcctgcaatctgaagaagttccggtcgcatcttagttgtagttcaggctcccagtggtgtgtcatcttatcacctatttcaggggaatccaccaactgctcatgttggaggcacctatggtccattgacaattcccaagaggtgaattgggacagtagttggtatcgtcatataggtaaaacgtcctgcataccaatttgttagacttttgcaaaaaggaaaagcggaaaagagacctcagatagatattatctttgtagcactttcggttggtgtggcttccatatatccatcccacgtgggaagacttgttcatggggcttcaggtaagcaaagccattggctcaactttattacgtgaggtgtgctgcgttccattcccac

SEQ ID NO: 11011 - protein, 83 aa, Panicum virgatum
  misc_feature: Ceres CLONE 1726217-R
  misc_feature: SWISSPROT Homolog: EC 1.14.99.30 Carotene 7,8-desaturase
HVVKTPRSVYKTVPNCEPCRPLQRSPIEGFYLAGDYTKQKYWASMEGAVLSGKLRAQSIVQDYSPLSLRSQKSLQSEEVPVAS

SEQ ID NO: 11012 - DNA, 811 bp, Panicum virgatum
  misc_feature: Ceres CLONE 1726217
gtttcgcctcgtcccgctccgacgctctccgccccggtcccgccgcccgccgcggccgcctcgccaagaaacacccccgacgcaaggtggagccgctagaaaggggccaggtttcaccgtggaagggtagagaaggcaaatccagggagaaaggagggacgatggcgttcaaggccaaatacaagcagcacctgcgctccagcgctggaaggaccgcagatggcggcggcggcggccatggagcagccggagctacgccgcagaactcgccgcgacaaggacccctccctttgccgcgacgttcaccttcgccgctggatgtcgagtgcaaaatgcctcgatacaatgaacactgcaatcatgattatcataatagtgacactagcagtagaaccaagctatatgtggggagcatttctacagatgctcgagagcaggatcttgaggctgctttcagcatatatgggagagtgcagcgggtctgcaccccgataactatggatttgttgtgttttatgaaccacaggatgcagatgctgcaaggtgtcatcttaacggcaaagaattttttgggagtcgcatcagtgttgagtttgcaaaagagcacaaaatcccccgatacgacaaccaccgtgatcatgatcactatggtcaacaaggtggtaacaccaagttgttcgtgggcaacatttcccgagatatccaggaatatcatattgaaggcctattcagcatatatgggagagtgcgcaacgtgtatctcaagcggaaatttgccttcgttgagttctatgatccccatgatgcatat

SEQ ID NO: 11013 - DNA, 829 bp, Panicum virgatum
  misc_feature: Ceres CLONE 1726220
  misc_feature: Encodes the peptide sequence at SEQ ID NO. 11014
gccaaaaccaccgcaccatggagtcgctgatgacgcttcgcgctcgcgcctcgccgtcgccgctgcagcagcgccggctgccggggcggcagcgggcgacgcccgtccgcgccacggccgccggcgagcccgacctctcggtgcgcgtgaacgggctgcagatgcccaacccgttcgtgatcgggtcggggccgccgggcaccaactacaccgtcatgaagcgcgccttcgacgagggctggggcgccgtcatcgccaagaccgtgtctttggatgctgaaaaagttatcaatgtgactcctcgttatgcaaagcttcgggcggaaccaaatggagctgccatgggacgcatcattggatggcagaacattgaactcatcagtgacaggcctctggagaccatgctgaatgagttcaagcagttgaagaaagaatatcctgacaggatactcattggctcaattatggaggagtacaacaaagctgcatggcatgagcttattgaacgtgttgaagagtctggagtggatgctcttgagattaatttctcatgtccacatggcatgccagagagaaaaatgggtgctgctgtgggacaagactgtgatttgctagaggaagtttgtggttggataaatgagaaggccactgtgcctgtttgggcaaagatgactcctaacattacagatattacacagcctgcaagaatagctcttaagtctggatgcgaaggagtttctgccattaacacaattatgagtgtcatggggattaatctcaaaacgctgcgtccagaaccttgcgtggaaggttattctacacctggggg

SEQ ID NO: 11014 - protein, 270 aa, Panicum virgatum
  misc_feature: Ceres CLONE 1726220
  misc_feature (39)..(269): Pfam Name: DHO_dh Pfam Description: Dihydroorotate dehydrogenase
  misc_feature: SWISSPROT Homolog: EC 1.3.1.2 Dihydropyrimidine dehydrogenase (NADP(+))
MESLMTLRARASPSPLQQRRLPGRQRATPVRATAAGEPDLSVRVNGLQMPNPFVIGSGPPGTNYTVMKRAFDEGWGAVIAKTVSLDAEKVINVTPRYAKLRAEPNGAAMGRIIGWQNIELISDRPLETMLNEFKQLKKEYPDRILIGSIMEEYNKAAWHELIERVEESGVDALEINFSCPHGMPERKMGAAVGQDCDLLEEVCGWINEKATVPVWAKMTPNITDITQPARIALKSGCEGVSAINTIMSVMGINLKTLRPEPCVEGYSTPG

SEQ ID NO: 11015 - DNA, 554 bp, Panicum virgatum
  misc_feature: Ceres CLONE 1726220-R
  misc_feature: Encodes the peptide sequence at SEQ ID NO. 11016
tttctcggtgcagatacagtacaggtatgcaccggcgttatgatgcatggttatccccttgtgaagaagctttgcgcagaattgcaggatttcatgagagagcacaacttttcatcaattgaagagtttcgaggggcctcgctcccgtacttcacaacacacacagatttggttcacaggcaacaggaggctatcaagcagaggaaggccatcaagaagggccttcaatcagacaaggactggacaggggatgggttcgtcaaggagaccgaaagcatggtatccaactgatgcatctccatgataccccccatgaccccatccttcccagcatacttcaacttgtgactaaaccgcgttcatcgtgtttgaggaaacactgtaaaacattttgcttcattctgttaaataaatttagcataccagaatgtcatacccaagcatgtaatcctcatctgtacatggatctgaaccctatagaacaagtcataagaacttcacatgttgttttcagcgtctggtgatttgtgaacgcctgaacggtgacaaccggc

SEQ ID NO: 11016 - protein, 96 aa, Panicum virgatum
  misc_feature: Ceres CLONE 1726220-R
  misc_feature: SWISSPROT Homolog: EC 1.3.3.1 Dihydroorotate oxidase
FLGADTVQVCTGVMMHGYPLVKKLCAELQDFMREHNFSSIEEFRGASLPYFTTHTDLVHRQQEAIKQRKAIKKGLQSDKDWTGDGFVKETESMVSN

SEQ ID NO: 11017 - DNA, 2096 bp, Panicum virgatum
  misc_feature: Ceres CLONE 1726225
  misc_feature: Encodes the peptide sequence at SEQ ID NO. 11018
gagagacccctcttcgcatcccgaggcggcgcctttagttttgggtcggaggagacgcgggggctgacgggcggttggtggaggtgagcagcggcaggcgaggcgagcgcgagcccgagccggagcaggggcaccatgtgcggcatcctcgccgtcctcggcgtcgccgacgtctccctcgccaagcgcgcccgcatcatcgagctctcgcgcaggttacggcatcgaggacctgattggagtggtctacactgccaccaggattgctatcttgcacaccagcagttggctattgttgatcccacatctggagaccagcccttgtacaatgaggacaaatcaattgttgtaacggtgaatggagagatctataaccatgaagaattgaaagctaagttgacaaatcatcaattccaaactggcagtgattgtgaagttatcgcccatctctatgaagaatatggggaagaattcatggatatgttggatggcatgttctcgtttgttcttcttgatacacgtgataaaacctttatcgcagctcgtgatgctattggtatctgccctttatacatgggatggggtcttgatgggtcagtttggttttcttccgagatgaaggcattgagcgacgattgtgaacgcttcataaccttcccacctggacacctgtactccagcaaaacaggtgctctaaggagatggtacaacccaccatggttttcagagagcattccctcaaccccgtacaatgccctcctccttcgagagatgtttgagaagtctgttatcaagaggctgatgtctgatgtgccatttggtgtactcttatctggtggacttgactcttctttggttgcatctgttgcttcacggcacttagaagaaacaaaaggtgccagcccgtggggaaacaaactgcataccttttgtatcggcttgaagggttctcctgatctcaaagctgctagggaagttgctgactacctcaacactgtacatcatgaattccactttacagtgcaggaaggcattgatgccttgaaagaagtcatctaccatattgagacatatgatgttacgacaatcagagcaagtaccccaatgtttttgatgtcacgtaaaatcaaatctttgggggtgaagatggttctttctggagaaggctcagatgaaatttttggtggatacctttactttcataaggcaccaaacaagaaggaattccatgaggaaacatgtcggaagataaaagctctacatttatatgactgtttgagagcaaacaaagcaacttctgcctggggtgttgaggcacgtgttccattccttgacaagagtttcatcaatgtagcaatggacatcgatcctgaatggaagatgataagacgtgaacttggtcggattgaaaagtaggttattcgtaatgcattcgatgatgagaaggggccatatttacctaagcacattctatacaggcaaaaggaacagttcagtgatggtgttgggtatagttggattgatggattgaaggaccatgcaagtcaacatgtctcggattccatgatgatgaatgcttgctttgtttacccagagaacacacccacaacaaaagaagggtactattatagaatgatattcgagaaagtcttcccaaagcccgcggcaaggtcaactgtccctggaggtccaagtgtggcatgcagcaccgccaaagctgttgaatgggatgctgcctggtcgaagaaccttgatccatctggtcgtgctgctctaggtgtacatgatgctgcgtacgaagatactccaggggaagctcctgctgccatcgatccagttacacataacagccttcgtccagctattgacgaaggcctcgtgaaacctgttgcttaagccactgctttctaagcttctgttgtctcataagaaagctcgaacaataaggttgttctctagttattcagcttcttttcagatcatgttgcaagttccttcagtccggccatggagacattctcatgctccatgcctggcatgttcggtttctattgtacacactgcttgtttgttttatgcactgattagaccgctgt

SEQ ID NO: 11018 - protein, 426 aa, Panicum virgatum
  misc_feature: Ceres CLONE 1726225
  misc_feature (209)..(426): Pfam Name: Asn_synthase Pfam Description: Asparagine synthase
  misc_feature (2)..(161): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGILAVLGVADVSLAKRARIIELSRRLRHRGPDWSGLHCHQDCYLAHQQLAIVDPTSGDQPLYNEDKSIVVTVNGEIYNHEELKAKLTNHQFQTGSDCEVIAHLYEEYGEEFMDMLDGMFSFVLLDTRDKTFIAARDAIGICPLYMGWGLDGSVWFSSEMKALSDDCERFITFPPGHLYSSKTGALRRWYNPPWFSESIPSTPYNALLLREMFEKSVIKRLMSDVPFGVLLSGGLDSSLVASVASRHLEETKGASPWGNKLHTFCIGLKGSPDLKAAREVADYLNTVHHEFHFTVQEGIDALKEVIYHIETYDVTTIRASTPMFLMSRKIKSLGVKMVLSGEGSDEIFGGYLYFHKAPNKKEFHEETCRKIKALHLYDCLRANKATSAWGVEARVPFLDKSFINVAMDIDPEWKMIRRELGRIEK

SEQ ID NO: 11019 - DNA, 1947 bp, Panicum virgatum
  misc_feature: Ceres CLONE 1726227
  misc_feature: Encodes the peptide sequence at SEQ ID NO. 11020
aacggccactacccgcctgccccgctgttcttggcgattaacaaatcggattgttatttccggcctgcctcgcagggtagcggctctccgttttgtatggttgtaaagctgccgatcttgtccgtggagtgggtggaggcggcggagctgcggccgcgcggagggtgcttcggcggcggaggagatgaagccggcggcggcgaggagcaagaagggcaggggggtcttctgcaacctcccgctgctgttcctcattggggccatccagttcttggtcatctactcccccgccattgaccgctacatggtgatgatcacgaaagggaagcccgggttcccatcgctgctgctggatggcaggaggggattcaaattgttggaggaggagttcgtgccggagccccgcgtggcgtgcgacttcgcggacccgaggtcggacgtgtgcgagctggagggcgccatccgcatccgcgggagcacgtcggaggtgttcgtggtggccccgggcggcgccggcgcggcgaacgtgacggggctcggcgcgggcatgaacgcgacgagctggacgatccagccgtacacgcgcaagggcgaggcccgcgtgatgcgcagcatcacggagctggcggtgcgggtggtgccccccggcgaggcgccgccgtgcacggtgcggcacgaggtgccggcggtggtgtactccaacggcgggtactgcggcaactactaccacgacttcaacgacaacatcatcccgctgttcatcacggcgcggcacctggtcggcgaggtgcagctgctggtggcgcagaagcagcggtggtggttcgacaagtaccgggagatcgtggacgggctgaccaactacgaggcggtggacctgggcggcgacggcggcggcgaggtgcggtgcttccggcgcgccaccctggggctgcgcagccacaaggagctgagcatcgacccgcgccgcgcgccgcgcaacctgtccatggtggacttgaagcgcttcctgatgtggcggtacgcgctgccgcgggagcacgcgatccggacggaggacgaggaggcggcggcgcggccgcgactgctggtcatcgcccggcggtcggggcggcggttcgtgaacctgccggagatcgtggcgctggcggaggaggtcgggttcgaggtgacgacgtcggacgtgatgtcgtcgtcgtcgtccaagcagcagaagaaggcggctggcgacgaggggcaggcgcgcatggcggaggcgtcggcgctggtgaactcgttcgacgcgatggtggcggtgcacgggtccgggctgacgaacctggtgttcctgccgatgaacgcggtggtggtgcaggtggtgccgctggggcggatggaggggctggccatggacgagtacggggtgccgccgcgggacatgaacatgcggtacctgcagtacaacatcacggcggaggagagcacgctgtcggaggcgttcccgcggacgcacccggtgctcctggaccccacgcccatccacaagcacagctggtcgctcgtcaaggacatctacctcggccagcaggacgtccggctcgacctgcgccgcttccggcccgtcctcgagaaggccatccgcctgctccgctgacaaggcctgaaggccagggccttaactgacactgctgcttgcttgcttgcctgccccggcaacagcggcggctcccatgcgagttgtggctacaggaaggaatgaacaggaagatacagacaccaccaccatgtttcttttctttttctctcttctctcctcttggaatttcatgacacgacaacatgtaaactttcagatgctgtacaaccgatgagtagagagtcgagtactcgagtccccgttgttgctcaaagcaaagcggcgacgattttgtatgacacttgtgtgctacggagtagtacaatgtgagt

SEQ ID NO: 11020 - protein, 482 aa, Panicum virgatum
  misc_feature: Ceres CLONE 1726227
  misc_feature: Useful for making plants with altered carbohydrate content
MKPAAARSKKGRGVFCNLPLLFLIGAIQFLVIYSPAIDRYMVMITKGKPGFPSLLLDGRRGFKLLEEEFVPEPRVACDFADPRSDVCELEGAIRIRGSTSEVFVVAPGGAGAANVTGLGAGMNATSWTIQPYTRKGEARVMRSITELAVRVVPPGEAPPCTVRHEVPAVVYSNGGYCGNYYHDFNDNIIPLFITARHLVGEVQLLVAQKQRWWFDKYREIVDGLTNYEAVDLGGDGGGEVRCFRRATLGLRSHKELSIDPRRAPRNLSMVDLKRFLMWRYALPREHAIRTEDEEAAARPRLLVIARRSGRRFVNLPEIVALAEEVGFEVTTSDVMSSSSSKQQKKAAGDEGQARMAEASALVNSFDAMVAVHGSGLTNLVFLPMNAVVVQVVPLGRMEGLAMDEYGVPPRDMNMRYLQYNITAEESTLSEAFPRTHPVLLDPTPIHKHSWSLVKDIYLGQQDVRLDLRRFRPVLEKAIRLLR

SEQ ID NO: 11021 - DNA, 957 bp, Panicum virgatum
  misc_feature: Ceres CLONE 1726228
  misc_feature: Encodes the peptide sequence at SEQ ID NO. 11022
agttcatcatctccctcccccgtctcgcgctcgcgcacgaacacacgccccccgcacgcgcagtagccattgacgcgtgctcgtagcattccctgcttctgcttccctagtcttctcgaagcttcatcgccatggcggaccagctcagcgacgaccagatagcagagttcaaggaggccttcagcctcttcgacaaggacggcgacggttgcatcaccaccaaggagctggggaccgtgatgcggtccctgggccagaaccccacggaggcggagctgcaggacatgatcgccgaggtggacgccgacgacaacggcaccgtcgacttcccggagttcctgagcctgatggcgcgcaggatgaaggacagcgactcggaggaggagctgaaggaggcgttccgcgtgttcgacaaggaccagaacggcttcatctcggccgccgagctccgccacgtgatggccaacctcggcgagcggctgaccgacgccgaggttgacgagatggtccgcgaggctgacgtggacggcgacgggcacatcaacttcgacgagttcgtcaaggtcatgatggccaaacgaaggagcaagaggacggaggagaagccggcgtgcggcaagaagaagccggcggggccgtccgacgtcggcaagcgcccccagaaatgtgtcatcctgtgagctgcagctccgtgtacccgaccgtgctcaccgtcgtgttcccttcttccggttggcttggcacttggcagcgtgcggatgctcgattcgacaccccatctacctgtgggtgaaccatggagctctgctgcgtcgtactccacccagggtgtgcaaacgtgtaatactatctgctggaagaaataacgctgtaacgtccgtgttgcattgcatatagccatatccacactgtcatggaatttggaaatataacgagcatctccaacagtttttttcc

SEQ ID NO: 11022 - protein, 182 aa, Panicum virgatum
  misc_feature: Ceres CLONE 1726228
  misc_feature (85)..(113): Pfam Name: efhand Pfam Description: EF hand
  misc_feature (12)..(40): Pfam Name: efhand Pfam Description: EF hand
  misc_feature (121)..(149): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Useful for making plants with modulated salt sensitivity
MADQLSDDQIAEFKEAFSLFDKDGDGCITTKELGTVMRSLGQNPTEAELQDMIAEVDADDNGTVDFPEFLSLMARRMKDSDSEEELKEAFRVFDKDQNGFISAAELRHVMANLGERLTDAEVDEMVREADVDGDGHINFDEFVKVMMAKRRSKRTEEKPACGKKKPAGPSDVGKRPQKCVIL

SEQ ID NO: 11023 - DNA, 1933 bp, Panicum virgatum
  misc_feature: Ceres CLONE 1726234
  misc_feature: Encodes the peptide sequence at SEQ ID NO. 11024
gaggggggcgacggcgatggcgcggcattgccagggtcacattgcgcactgcctcggcggcgtcctcgcccgccgcggtggcgccaccgtcgccctggactcaggcggtcgcaggctctctggcgcggagttcgtcgacggcgtgcggaggctggccgcggggctcgtcggcagcggggtgcgccccggcgacgtcgttgccgccgtcgccttcaacagcatccagtacgtcgagctgttcctcgccgtcgcacacgtcggagcaatcatcgcccctctcaactaccgctggagcttcgaggaggcaacgcaggcactggagctcgtggagccaacggcgttcatcttcgacagcgtcttcagctcttgggcgctccgactgacggacagcaacaagtattcgtccattggcctctacctcattctgggggattcttgcagcacaggccatgcagcaaactttggatctgttgatcacatcaagaggagcgtgagaggacctatagcgacagagcccgtaaccgctccaagagatgttgctttgatatgcttcacatctggtactactgggcaaccaaagggtgtagcgataagccatacatctttgatcattcaattcctagcaaagatcgccattgttggctacggtgaggatgatgtctacctgcatacagcacctctgtgccatatcggtgggatctcctcatgcatggccatcctgatggctggaggctgtcatatcctgataccgaaattcgacgccaaatcagcttttgatgccatcaaggaacatggagtaacttctttcatcaccgtccccgcgatcatggctgatctactgtcttatgctcgaaaggagaggatatcaggccctgtgatgacagtgaccaagattctaaatggtggtggtggattgtcagaggaattgatggatggagcttctcaattatttcctcgtgctgctattttctctgcttatgggatgactgaggcctgctcatctctgacattcatggctctcaacaaaccaaaactccaagaacccaagaaccaatcaggcaaccattctgggggcgtttttgttggtaaaccagcaccccatgtcgagatacgaattggcaaggatggtaataaccctagttcttcgccaactggaaacatcttaacgagaggcttgcataccatggttgggtactgggcaaacaacaaggtggattcatcagattgtgtcaggaatggatggctggacactggtgacactggatggatggatagcgccggtaatctatggctcatggggcggcaaaagggccgcatcaaaacgggaggtgaaaatgttttcccagaagaggttgaactggtgctgtcccagcaccctggagtagctagagttgtggtagttggtataccggatagtcgtcttggtgagaaagttattgcttgtgttaacatcaaggatggctggaagtgggttgatgcaagagctgagcaccaaagtgaaagaaaagaagtctctcctcggatccttaatgaccactgcaggatgaaaaaattgagcagatttaaggtaccaaggtcgtattatcagtggaggcagccgttcccagtgaccagtacaggcaaaatcagaagagaggagctcaagagggaaatcttagcaacaatgcaaatacccagcaacttgtagttttttgaggcaaagatcggttgtattatgaaccaaattgtggctcagtttgcttcgaatttaagtcttgggtttatctggtgtctaaatgacgtgttctttttctttttatcttaattttttgagttgtggttgatcatgttagactttgagatgctagacagagagagaacatgcaaatgtgagcgactttgacaactgaaacaatgtcatttctgagcgctcgtaaataaattttgtaggagt

SEQ ID NO: 11024 - protein, 556 aa, Panicum virgatum
  misc_feature: Ceres CLONE 1726234
  misc_feature (35)..(461): Pfam Name: AMP-binding Pfam Description: AMP-binding enzyme
  misc_feature: SWISSPROT Homolog: EC 6.2.1.3 Long-chain-fatty-acid--CoA ligase
MARHCQGHIAHCLGGVLARRGGATVALDSGGRRLSGAEFVDGVRRLAAGLVGSGVRPGDVVAAVAFNSIQYVELFLAVAHVGAIIAPLNYRWSFEEATQALELVEPTAFIFDSVFSSWALRLTDSNKYSSIGLYLILGDSCSTGHAANFGSVDHIKRSVRGPIATEPVTAPRDVALICFTSGTTGQPKGVAISHTSLIIQFLAKIAIVGYGEDDVYLHTAPLCHIGGISSCMAILMAGGCHILIPKFDAKSAFDAIKEHGVTSFITVPAIMADLLSYARKERISGPVMTVTKILNGGGGLSEELMDGASQLFPRAAIFSAYGMTEACSSLTFMALNKPKLQEPKNQSGNHSGGVFVGKPAPHVEIRIGKDGNNPSSSPTGNILTRGLHTMVGYWANNKVDSSDCVRNGWLDTGDTGWMDSAGNLWLMGRQKGRIKTGGENVFPEEVELVLSQHPGVARVVVVGIPDSRLGEKVIACVNIKDGWKWVDARAEHQSERKEVSPRILNDHCRMKKLSRFKVPRSYYQWRQPFPVTSTGKIRREELKREILATMQIPSNL

SEQ ID NO: 11025 - DNA, 333 bp, Panicum virgatum
  misc_feature: Ceres CLONE 1726235
  misc_feature: Encodes the peptide sequence at SEQ ID NO. 11026
acgagcgacagccagtcaccacctacccgaagccgccgcgaccgatcgagccgagcgccccgcccccacgccgcgccgcgccgcgccgccaccgaaaccctagctcctcctcctcctcctcagccatggccaccgtctcgctcacgccgcaggtggtcttctccaccgagtcgggcggcgccctctcctccgccacaatcctccgtttcccgccaaacttcgtgcgccagctcagcaccaaggcccgccgcaactgcagcaacatcggcgtcgcgcagatcgtcgccgcggcgtggtcggactgccccgccggccgcccccactccggcggcg

SEQ ID NO: 11026 - protein, 69 aa, Panicum virgatum
  misc_feature: Ceres CLONE 1726235
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGG

SEQ ID NO: 11027 - DNA, 1620 bp, Panicum virgatum
  misc_feature: Ceres CLONE 1726235-R
  misc_feature: Encodes the peptide sequence at SEQ ID NO. 11028
ctcgcagccagcacgcctctcctccaaaacaacgagttcttcwccttcctggcgcmgttgtcsaccagtcgctgctggcgacgtcatcactrscggcgtgatcaymgcagccgcgaccctccttcccccccgcccctcccccgcgwcgacaacacggccggcgtcgccgcccagcagrcgaccctccgccwctacgacggckgacggctgcacaacggcagcgttgaggackscgcycacctccgccgcctccgcggcggcggaggtcagcgcaatccccaacgctaacgttgcgcagccatccgccgtcgtacaggccgagcgtaacctgctcggctccgacgccagccttgccgtccacgcgggcgagaggctgggaagaaggatcgccacggatgcgatcaccacgccagtagtgaacacgtcggcctactggtttaacaactcgcaagagctaatcgatttcaaggaggggaggcatgctagcttcgagtacgggaggtatgggaacccgaccacagaggcgttggagaagaagatgagcgcactggagaaagctgaatccactgtgtttgtggcgtcggggatgtatgcagctgtcgctatgctcagcgcacttgtcccagctggtgggcacattgtgaccaccactgattgctaccgcaagacaagaatttacatggaaaatgagctccctaagaggggagtttcgatgactgttattaggcctgctgacatggatgctctccaaaatgcattggacaataataatgtatctcttttcttcaccgagactcctacgaatccatttctcagatgcattgatgttgagcttgtcgcaaatatgtgccatagcaagggagctctgctttgcattgacagtacttttgcctcccctatcaatcagaaggcactaactttaggtgctgacctagttattcattctgcaacaaagtacattgctggacacaatgacgttattggaggatgtgtcagtggcagagatgagttagtttccaaagtccgcatttatcaccatgtagttggtggcgttctgaacccgaatgctacctacctgatccttcggggcatgaagacactgcatctccgtgtgcaatgtcaaaataacactgctctgcggatggcccaatttttagaggaacatccaaagattgcacgtgtctactatcctggtttgccgagtcaccctgaacatcacattgccaagacccaaatgactggctttggtggtgttgtcagttttgaggttgctggggattttgacggtacaaggagattcattgattctgttaagataccctatcatgccccttcttttggaggctgtgagagcattatcgatcagcctgccatcatgtcttactgggattcaaaggagcagagggacatatacgggatcaaggacaacctgatcaggttcagcattggagtggaggatttcgaggatctgaagaatgatcttgttcaagcccttgagaaggtctaatcacttgattcgttcactttaatattcatatcagatcacggttgtcctggatcttgagagatctgtgagaatatttgagccgatggctgccaataatttctctccttttgctt

SEQ ID NO: 11028 - protein, 501 aa, Panicum virgatum
  misc_feature: Ceres CLONE 1726235-R
  misc_feature (115)..(499): Pfam Name: Cys_Met_Meta_PP Pfam Description: Cys/Met metabolism PLP-dependent enzyme
  misc_feature: SWISSPROT Homolog: EC 2.5.1.48 Cystathionine gamma-synthase
  misc_feature (19)..(19): Xaa is any aa, unknown, or other
  misc_feature (21)..(21): Xaa is any aa, unknown, or other
  misc_feature (31)..(31): Xaa is any aa, unknown, or other
  misc_feature (35)..(35): Xaa is any aa, unknown, or other
  misc_feature (49)..(49): Xaa is any aa, unknown, or other
  misc_feature (64)..(64): Xaa is any aa, unknown, or other
  misc_feature (78)..(78): Xaa is any aa, unknown, or other
  misc_feature (79)..(79): Xaa is any aa, unknown, or other
SQPARLSSKTTSSSPSWRXCXPVAAGDVITXGVIXAAATLLPPRPSPAXTTRPASPPSRRPSAXTTADGCTTAALRTXXTSAASAAAEVSAIPNANVAQPSAVVQAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMENELPKRGVSMTVIRPADMDALQNALDNNNVSLFFTETPTNPFLRCIDVELVANMCHSKGALLCIDSTFASPINQKALTLGADLVIHSATKYIAGHNDVIGGCVSGRDELVSKVRIYHHVVGGVLNPNATYLILRGMKTLHLRVQCQNNTALRMAQFLEEHPKIARVYYPGLPSHPEHHIAKTQMTGFGGVVSFEVAGDFDGTRRFIDSVKIPYHAPSFGGCESIIDQPAIMSYWDSKEQRDIYGIKDNLIRFSIGVEDFEDLKNDLVQALEKV

SEQ ID NO: 11029 - DNA, 728 bp, Panicum virgatum
  misc_feature: Ceres CLONE 1726236
  misc_feature: Encodes the peptide sequence at SEQ ID NO. 11030
taactttatcgggacaattccaccttccattagcaaagttacgcagctgtcatccttctctcttgcagaaaataacttcaacggtttcatacctcctggcttggggaaccttcaacgtatgtcaacattgaaccttagctataacaatttcgaagggagcatacctgttgagttgggtaatcttataccactcaccaaactagatctttcatcgaacaagcttagtggggaaattcctgaaactttgggcaaatttgcacaaatagagaccattcgaatggatcaaaattttcttacaggaaacattccgaaaagcttcggcaatctaaagagcttgagcatacttaatctttcccataacgatttgtcgggccccatgccaggcttcttaagtgatttagaccttctaactaaactggacctatcttacaacaatttacaaggacaaataccaacatatggtgtatttggtaatgctacaattgtttcactcgatggcaatccgagactgtgtggtggagccacggatttgcataagcctccatgccatgttagatctacaagagcaaggacagtaaactatttgatcaaaatactgatcccaatatttgggttcctgtcactcctgttacttgtctattttctactcgttgacaagaggatttcaagaagagcacatctatcgcagctttcctttggtgagcattttgagaaagttacgttccagg

SEQ ID NO: 11030 - protein, 242 aa, Panicum virgatum
  misc_feature: Ceres CLONE 1726236
  misc_feature: SWISSPROT Homolog: EC 2.7.11.1 Non-specific serine/threonine protein kinase
NFIGTIPPSISKVTQLSSFSLAENNFNGFIPPGLGNLQRMSTLNLSYNNFEGSIPVELGNLIPLTKLDLSSNKLSGEIPETLGKFAQIETIRMDQNFLTGNIPKSFGNLKSLSILNLSHNDLSGPMPGFLSDLDLLTKLDLSYNNLQGQIPTYGVFGNATIVSLDGNPRLCGGATDLHKPPCHVRSTRARTVNYLIKILIPIFGFLSLLLLVYFLLVDKRISRRAHLSQLSFGEHFEKVTFQ

SEQ ID NO: 11031 - DNA, 488 bp, Panicum virgatum
  misc_feature: Ceres CLONE 1726236-R
ttgatgcccatatcgtggaagaatgcaaaaaactttcccaagaaaagaaagtaccagaaaatgaggtctaccggtgcttgttggctattctgcaagtagcactttcttgcacgcgttcattaccatctgaacggtccgatatgaagcaggtagccagcaaaatacatgaaatccagacgtcatatcgtggatggaactataaggagtaagggaaagggtgctcagtatagtgaattagcgttttcattatactactacaattaaatctgtgttttgtatgaatgtgtttaacgcgaccagtgatataaatatactgtacatctgaagaatgctcggttacaaatttattccgaatgaagtaaccctggctttgcttctacgaactacaagcatgaaagccactggcggaacctcatggaggcctaactagatgctggtccctccttctgaccaaaaaaaactttctgatctgctcatatttctcactc

SEQ ID NO: 11032 - DNA, 673 bp, Panicum virgatum
  misc_feature: Ceres CLONE 1726240
  misc_feature: Encodes the peptide sequence at SEQ ID NO. 11033
gcgtctcgtctcgtgttgttcccagaacacaaccaaaatccaaatcatcctcctcgcgagcctcgtcgatccctcacccgcttcaagatgcagatcttcgttaagaccctcaccggcaagaccatcaccctcgaggtagagtcttctgacaccatcgacaatgtcaaggccaagatccaggacaaggagggcattcccccggaccagcaaaggctcatcttcgctggcaagcagctggaggatggccgcactctcgtggactacaacatccagaaggagagcaccctccacctggtgctccgcctgaggggtgggatgcagatcttcgtgaagaccctcactggcaagaccatcacccttgaggtggagagctctgacaccattgacaacgtgaaggccaagatccaggacaaggagggcatccccccagaccagcagcgactgatcttcgccggcaagcagctggaggacggccacacccttgcagactacaacatccagaaggagagcacgctccacttggtgctccgcctgagaggggaagaggatcatcctgatgacccgcctcggctacaccctcaacgaggtcgtggacaccttcgaggtctccccccacggcgcggtcaagatcgaggagaaggacggcatcgactacgccggggacaccgtccac

SEQ ID NO: 11033 - protein, 195 aa, Panicum virgatum
  misc_feature: Ceres CLONE 1726240
  misc_feature (82)..(150): Pfam Name: ubiquitin Pfam Description: Ubiquitin family
  misc_feature (6)..(74): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLVDYNIQKESTLHLVLRLRGGMQIFVKTLTGKTITLEVESSDTIDNVKAKIQDKEGIPPDQQRLIFAGKQLEDGHTLADYNIQKESTLHLVLRLRGEEDHPDDPPRLHPQRGRGHLRGLPPRRGQDRGEGRHRLRRGHRP

SEQ ID NO: 11034 - DNA, 417 bp, Panicum virgatum
  misc_feature: Ceres CLONE 1726240-R
  misc_feature: Encodes the peptide sequence at SEQ ID NO. 11035
ccccattgacaacgtgaaggccaagatccaggacaaggagggcatccccccgrcccagcagcgactgatcttcgctggcaagcagctggaggakggccgaacccttgctaactacaatatccagaaggagtccmccctccatttagtgctccgcctccgtggtggccagtaagccattggtcatccaagctgctgctgtacctgggtcgtctggtctctgccatgaagggcgtcttctttgaagtatctgtgtcgtttgtctaaactgtgtttggttttcatgaactggttgtgtccttgtgttcctgaaacagtcattgcggccgcagttggcttaagcatgaataagtaagactcaaatttgtgctctgtttatacattatgccagttctatataaattctatagcttttgagtt

SEQ ID NO: 11035 - protein, 56 aa, Panicum virgatum
  misc_feature: Ceres CLONE 1726240-R
  misc_feature (1)..(53): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
  misc_feature (18)..(18): Xaa is any aa, unknown, or other
  misc_feature (31)..(31): Xaa is any aa, unknown, or other
  misc_feature (45)..(45): Xaa is any aa, unknown, or other
PIDNVKAKIQDKEGIPPXQQRLIFAGKQLEXGRTLANYNIQKESXLHLVLRLRGGQ

SEQ ID NO: 11036 - DNA, 1972 bp, Panicum virgatum
  misc_feature: Ceres CLONE 1726245
  misc_feature: Encodes the peptide sequence at SEQ ID NO. 11037
acccttcgagccgcgtctcgcctcctcctctgctctccgcaacggacgaaccgccgcgaccggatcaaaagcaggcggcagcaaccgccaacggcggcggcttcttcgagggagtagtgattgggagccggggagcgccgcgatggcgctggacggcggcggcgtctggggaggggtgatcggggcgctggcctacggcgccctggcggtggcggcgctgcggctggtgctgtcgtacaagtcggcggcgcacgcgctgcggcgggcgtggcggtgggcggacgagtgggcgcaggcgtaccagtactacgaggtgccgcgcgtcggcgcggacggcgcggagaacccgctgttccggaaggcggcggcgtacgtggcgtcgctgccgtcgctcgaggacgccgacgccgcctgcgtgctgtcgtcggcggccaagagcaacgacttcgcgctgcagctgggcccgggccacgccgcacgggacgccttcctcggcgcgcgcctcgcctggaccaacgccggcgccggccgcctcgtcctgcgcgtgcgccgccacgaccgcacccgggtgctgcggccctacctgcagcacgtcgagtccgtcgccgacgagatggaggcgcgccgtagggagctgcggctctacgccaacaccggcgccgggggcgcgccgcggtgggcgtccgcgcccttcacccacccggccacgctcgacaccgtggccatggaccccgagctcaaggcccgcgtccgcaccgacctcgagagcttcctcaagggccgcgcctactaccaccggctcggccgcgtctggcgccggagctacctgctctacggcgcgcccggcaccggcaagtccaccttcgccgccgcgatggcgaggttcctcggctacgacgtctacgacatcgacctgtcccgcgacggatgcgacgacctccgcgcgctgctcctggacaccgccccgcggtcactcatcctcgtcgaggacctcgaccggtacctccgcggcggcgacggggagacggcggcggccaggacggctcgggtgctcagcttcatggacgggctctcctcctgctgcggcgaggagcgcgtcatggtgttcaccatgagcggcggcaaggacggcgtggacccggccgtgctgcggccgggccgcctggacgtgcacatccacttcaccatgtgcgacttcgagtccttcaaggcgctggccagcaactacctggggctcaaggaccacaagctgtacccgcaggtggaggaaggcttccacgccggcgcccgcctcagccccgccgagctcggcgagatcatgatcgccaaccgcgggtccccgagccgcgcgctccggaccgtcatcaacgccctgcagcaagtggcgccgccgcccccgcccccgcccccgcagccgcagccggccggcgccgccgcgaggtggtccgggcacctcgactacgctagcgcggcggcgtcagaggcccgcgcggcaggccagtcgtcgccccgcggcgggggcgggttcgccaaggacgcgcccatcagggagttcaagaagctctacggcctgatcaagtacaggagccggaaggatgccggcgtcgtgccggtggacgacatcgcggcatcgccgaacgggcggggcagcgaggccagctctgacaaggaccggaccggtgattaggtattaattatttatctgttgggagcaatttggatttgctctctattttctttttacttttgatgatcatggattctaagtacatcctttctgtttatctgaaatttgagggcctgtgcgttgtacattgtaatctggtagttgctagctaggactttcttcttatctgaaaatttggggctgtacactgtacttactatggtaggatgggcaatttcttcacttggaccaaagaaacgtttcaaaataacattggaatggagaagcaaggaaagtgatcatctc

SEQ ID NO: 11037 - protein, 514 aa, Panicum virgatum
  misc_feature: Ceres CLONE 1726245
  misc_feature (227)..(405): Pfam Name: AAA Pfam Description: ATPase family associated with various cellular activities (AAA)
  misc_feature: SWISSPROT Homolog: EC 3.6.4.3 Microtubule-severing ATPase
MALDGGGVWGGVIGALAYGALAVAALRLVLSYKSAAHALRRAWRWADEWAQAYQYYEVPRVGADGAENPLFRKAAAYVASLPSLEDADAACVLSSAAKSNDFALQLGPGHAARDAFLGARLAWTNAGAGRLVLRVRRHDRTRVLRPYLQHVESVADEMEARRRELRLYANTGAGGAPRWASAPFTHPATLDTVAMDPELKARVRTDLESFLKGRAYYHRLGRVWRRSYLLYGAPGTGKSTFAAAMARFLGYDVYDIDLSRDGCDDLRALLLDTAPRSLILVEDLDRYLRGGDGETAAARTARVLSFMDGLSSCCGEERVMVFTMSGGKDGVDPAVLRPGRLDVHIHFTMCDFESFKALASNYLGLKDHKLYPQVEEGFHAGARLSPAELGEIMIANRGSPSRALRTVINALQQVAPPPPPPPPQPQPAGAAARWSGHLDYASAAASEARAAGQSSPRGGGGFAKDAPIREFKKLYGLIKYRSRKDAGVVPVDDIAASPNGRGSEASSDKDRTGD

SEQ ID NO: 11038 - DNA, 1824 bp, Panicum virgatum
  misc_feature: Ceres CLONE 1726255
  misc_feature: Encodes the peptide sequence at SEQ ID NO. 11039
gggctcgcggcctcgccggacctcctctccgtctcccctgcctccggccgtcaggcggatcgcgtcgtgtcgcctcgccgcagccaagctccccagtcgccacgacgacctaccgttctcctctccagtggacaccttttttgtaccaaattgaagtatactgcccggaatttcattgggcaaactcatgagcacggcggaggaagatggctgttcacggtgcgacctgtgcgatacaaaggtcatacacagcatgacagaactcctgcttcgtggattggccgcagcttcggtggacagcaccaccggcgatatattcaagagcgcatcttctgtagctgtcgctgtgaagaccgagctagaaaattacctacttgtgagaactgaagcacttattcgtgaatctgtggatggaggggaagatcattcggataaattaatcaaggcctccaccaggccgaccgagttcctgtcggacttgatcaatgactttgttgcttccaaaaggaacgtgctgagccacgtgtctggatttttgtccagtgaaagtcgagtgaataaaattaacgattttatgcaaaagatggagatgaagaatgtgtgggcactggacgtaaggaaggctactgcagagactattcttgagagcatagacataaaatgcatttttcattgccctgagagatttgttgagcaggataagctagctgaccacagaagtcagtacaaatttagggtcgtgaactgcaaaaacgatgggtgttcagcttcattttctgctattcatattgaggagcatgactccatctgtccgtttaagcccctgccatgtgatcagctgtgcgaccaacatgttatgcgttgtgagatggacaaacattgtgcaacagtttgccctatgaagcttattaattgccctttttaccaagttggatgtgaaacagcctttccacagggtaatcttgatgatcattgttcaaagttgcttcaaacacatatgttgtatgttctccaagcaactacaagacagaatgctactgttgatgatatgaatcaacggttacaactccttgagaaggctcagtcacttaacgaaatgtctggggctttagatgtcaggtccctcactctgataataaaggagcaagaagcaaagatcaaaaaactagagcgagatatcaaaacacaagacgcaaagggtagatcttgtactcgaagatgctaggatcgtattggtctaaaaaatggtcatttagctgccgtggttgcattctgtgctggaatattccatgatctgaagcctcttgtttgtttggatgcaattccattggtggctttccaccacagcttttttggatgcctccgcaacttcatcgttggcttggctgttttccagctttgggatgtgatcacaagcaccctgtaaaatcttgcaaacttgtttgcactgcacttgtatatgtgcatggcactctgtatgtgattttcatatgcatgttttcacggtgaagatgccatcacaatctcgtcactgtcgtggctatttgactcagatttgaggaaataatcacaagcagcctccaaaatcttgcaaacttctctcctgtactgcaccggcataccagatcatgtcaagaacaaactatcaaatggtgttttctgaaaagaccagtactggtttctttatttaatcttacacaattttaacaatcatcataactagatggttgtgtggtgtggagagactttgagtcatcatattcctatcagattcctaatttgacagagaaattagaattctagaatctaaattattgtccttcc

SEQ ID NO: 11039 - protein, 345 aa, Panicum virgatum
  misc_feature: Ceres CLONE 1726255
  misc_feature (204)..(262): Pfam Name: zf-TRAF Pfam Description: TRAF-type zinc finger
MSTAEEDGCSRCDLCDTKVIHSMTELLLRGLAAASVDSTTGDIFKSASSVAVAVKTELENYLLVRTEALIRESVDGGEDHSDKLIKASTRPTEFLSDLINDFVASKRNVLSHVSGFLSSESRVNKINDFMQKMEMKNVWALDVRKATAETILESIDIKCIFHCPERFVEQDKLADHRSQYKFRVVNCKNDGCSASFSAIHIEEHDSICPFKPLPCDQLCDQHVMRCEMDKHCATVCPMKLINCPFYQVGCETAFPQGNLDDHCSKLLQTHMLYVLQATTRQNATVDDMNQRLQLLEKAQSLNEMSGALDVRSLTLIIKEQEAKIKKLERDIKTQDAKGRSCTRRC

SEQ ID NO: 11040 - DNA, 1529 bp, Panicum virgatum
  misc_feature: Ceres CLONE 1726263
  misc_feature: Encodes the peptide sequence at SEQ ID NO. 11041
actcagcactgcgccactgccgtccactcgagccgaagccagacccgccgcaatggcatcccccgccgcgcgcacggccgtccccccggcgctcctcgcgctcgccgcgcttgtgctcgttctcgtcccggccgcggcggcggcggcgtgctcggcggcggaccgcgacgcgctgctgtcgatccgcgcggcgctgacggaggcgcgcctgggcgtgttctcgtcgtgggcgggcaccgactgctgcgccggctggtacggcgtgggctgcgaccccaccgacggccgcgtcgcggacctctccctccgcggcgaggccgaggacgccgtgatggcccccgcggggcgcccggcgtcgggcgtcatgtccgggtacatctccgacgccgtgtgccggctcggccgcctctcgtcgctcgtcctcgccgactggaagcagatctccgggcccgtcccgtcctgcgtcgccacggacctcccctacctccgcatcctcgagctccccggcaaccacctcaccggcgggatcccgccgtccgtcggcggcctctcccgcctcaccgtgctcaacctcgccgacaacctcctctcgggccccatcccgggctccatcaccaccctcgcctccctcaagcacctcgacctcgccaacaaccagctcaccggccgcgtccccgccgacttcggcaagctcgccatgctcagccgcgcgctgctcaggcggaaccggctgtcgggccccatcccggcgtcggtgtcgtccatgccccggctcgccgacctcgacatgtccgagaaccagctcaccgggtcgatccccgacgggctgggctccggccacgtgctcacctcgctgtacctcggcgcgaaccggctgtcggggagcatcccggcgagcctgctccggaacagcgggctcgggatcctgaacctgagccggaacgacctggatggcgccgtgccggacgtgttcacgccgcgctcctacttcatgctgctggacctgtcccggaatcggctcagcggcggcgtgccgcggtcgctggcctcggcggcctacgtggggcacctggacctgagccacaaccggctgtgcggcgccatcccagccggcccgccgttcgaccacctcgacgccgactcgttctgcggcaacacctgcctctgcggcgggccgctcggcaagtgcacgtgagccggccgtccgactgctctgttaccagccgtgctacgtacagggtgtgtgtggtgtactggtgtaccgtgcacggcgcgtaacaaactttctatgccggtatgcccgtgtgccggcgcacatacggagtgtgtacgtgcgtgctgcgtggttaacctggatggtcgtataggtttgggtatagatggcagtttgccgtgttgtggtgtgatgagagaggaagttaaatgagcgaggggggggagatgtgtgctctttcctcctttggtttcctcgtctttaatttttaatttatctttggttaaactttaaccattaaagtttgggtttgtac

SEQ ID NO: 11041 - protein, 380 aa, Panicum virgatum
  misc_feature: Ceres CLONE 1726263
  misc_feature (34)..(74): Pfam Name: LRRNT_2 Pfam Description: Leucine rich repeat N-terminal domain
  misc_feature: SWISSPROT Homolog: EC 2.7.11.1 Non-specific serine/threonine protein kinase
MASPAARTAVPPALLALAALVLVLVPAAAAAACSAADRDALLSIRAALTEARLGVFSSWAGTDCCAGWYGVGCDPTDGRVADLSLRGEAEDAVMAPAGRPASGVMSGYISDAVCRLGRLSSLVLADWKQISGPVPSCVATDLPYLRILELPGNHLTGGIPPSVGGLSRLTVLNLADNLLSGPIPGSITTLASLKHLDLANNQLTGRVPADFGKLAMLSRALLRRNRLSGPIPASVSSMPRLADLDMSENQLTGSIPDGLGSGHVLTSLYLGANRLSGSIPASLLRNSGLGILNLSRNDLDGAVPDVFTPRSYFMLLDLSRNRLSGGVPRSLASAAYVGHLDLSHNRLCGAIPAGPPFDHLDADSFCGNTCLCGGPLGKCT

SEQ ID NO: 11042 - DNA, 889 bp, Panicum virgatum
  misc_feature: Ceres CLONE 1726264
  misc_feature: Encodes the peptide sequence at SEQ ID NO. 11043
  misc_feature (766)..(766): n is a, c, t, g, unknown, or other
ccccccagagttctttggtggcctagccggatcggatatttggatattatggtgggatgagtcgttcgtcttggccgcctacctcgtccgcctcgttggctccgcaccgctgcatctctctagagacaaaggcaggccgcgtgctcccctgcgtagtccttcgagcaggacaggaggcctctgattctctgagcttgtacaccatctgagcgacgccatgggagaggttgcagacatgtacacccatgacgggaccgtcgacatgaaggggaaccccgccgtgaagaagggcaccggcaactggcgcgcctgcccttacatcctcgcgaatgagtgctgcgagaggctggcgtactatggcatgagcaccaacctggtgaactacatgaagacccgcctcggccaggggaactctgtcgccgccaacaatgtcaccaactggagcggaacgtgctacatcacgccactcatcggcgcattcttggctgacgcctacatggggagatactggaccatcgccagcttcatgatcatctacatcattggcctggcgctgctgacgatggcatcgtcggtgaaggggctggtgccgtcgtgcgacagcagcaggacgtgccacccgacggagtcgcagtcggcggcagtgttcgtggcgctgtacctgatcgcgctgggcacgggcgggatcaagccctgcgtgtcgtcctttggcgccgaccagttcgacgagaacgacgagcgggagcagaagagcaagagctccttncttcactggttctacttctccatcaacatcggcgcgctggtggcgtcgacggtgctggtgtacgtgcagacgcacgtcggctggggctggggcttcggcatccccgccgtggtgatggccatc

SEQ ID NO: 11043 - protein, 223 aa, Panicum virgatum
  misc_feature: Ceres CLONE 1726264
  misc_feature: Useful for making plants with altered carbon content
  misc_feature: Useful for making plants with altered nitrogen content
  misc_feature (183)..(183): Xaa is any aa, unknown, or other
MGEVADMYTHDGTVDMKGNPAVKKGTGNWRACPYILANECCERLAYYGMSTNLVNYMKTRLGQGNSVAANNVTNWSGTCYITPLIGAFLADAYMGRYWTIASFMIIYIIGLALLTMASSVKGLVPSCDSSRTCHPTESQSAAVFVALYLIALGTGGIKPCVSSFGADQFDENDEREQKSKSSXLHWFYFSINIGALVASTVLVYVQTHVGWGWGFGIPAVVMA

SEQ ID NO: 11044 - DNA, 914 bp, Panicum virgatum
  misc_feature: Ceres CLONE 1726267
  misc_feature: Encodes the peptide sequence at SEQ ID NO. 11045
acggcacggcctcaaagaggaagctttccgtggcctggcttttctcgggacgccatggagctgcttcctcttcttcttgccggctccctcctgttcacggtcgcagctcctgcccgggacatcaccagcgtctgcgcctcccaaatcagggatttcccgcaccggaacagctcggggctccacctgatactgcaccacccgcagagcccctgctcgccggcgccgctcccgtcggacctccccttctccaccatcctctcccacgacgatgcgcgcgccgcccacctcgcctcccgcctcgccaccagtaatgacgcgccgctgcgccgcccgacgtcgctccgcaagaaggccgccgccggcgaccacttcggcgactccctggccaccgtgccgctctcgccgggcgcgtccataggcgtggggaactacatcacccagctgggcctcggcacgccggccacctcctacgccatggtcatcgacacgggctcgtcgctcacctggctgcagtgctcgccctgcgtggtgtcctgccaccgccaggccggcccgctcttcgaccccagggcgtccagcacctacgccgccgtgccgtgctcggcgtcgcagtgcgacgagctcgaggccgccacgctcaacccgtccgcctgctccgtctccaacgtctgcgtctaccaggccagctacggcgacagctccttctccgtcggctacctcagcagggacaccgtctccttcggctccagcaggttccccggcttctactacggctgcggccaggacaacgaggggctcttcggccgctcggcggggctcatcggcctcgcgcgcaacaagctctcgctgctctcccagctcgcgcccagcctcggctactccttctcctactgcctcccgacgtcggcgtcgac

SEQ ID NO: 11045 - protein, 286 aa, Panicum virgatum
  misc_feature: Ceres CLONE 1726267
  misc_feature: SWISSPROT Homolog: EC 3.4.23.12 Nepenthesin
MELLPLLLAGSLLFTVAAPARDITSVCASQIRDFPHRNSSGLHLILHHPQSPCSPAPLPSDLPFSTILSHDDARAAHLASRLATSNDAPLRRPTSLRKKAAAGDHFGDSLATVPLSPGASIGVGNYITQLGLGTPATSYAMVIDTGSSLTWLQCSPCVVSCHRQAGPLFDPRASSTYAAVPCSASQCDELEAATLNPSACSVSNVCVYQASYGDSSFSVGYLSRDTVSFGSSRFPGFYYGCGQDNEGLFGRSAGLIGLARNKLSLLSQLAPSLGYSFSYCLPTSAS

SEQ ID NO: 11046 - DNA, 651 bp, Panicum virgatum
  misc_feature: Ceres CLONE 1726267-R
  misc_feature: Encodes the peptide sequence at SEQ ID NO. 11047
tcgccgtcggagtacagcagcctgccgacgatcatcgactcgggcacggtgatcacgcgcctgccgacgagcgtgtactcggcgctgagcgaggcggtggccgcggccatgggcggggcggcgcgcgcccccgcgttctccatcctcgacacgtgcttcgagggccaggcgtcgcggctgcgcgcgccggccgtgggcatggcgttcgctggcggcgcggcgctgaagctgccgacgaggaacatgctcatcgacgtggacgactccaccacgtgcctggcgttcgcgcccacggacagcacggccatcatcggcaacacgcagcagcagacgttcagcgtcgtctacgacgtcgcgcggtccaggatcggcttcgcggccggaggctgcagctgaagggcgaacactacactgcaccgcagcacgcgtggatgtgagcgatgccatggcagggtcagctcaggcttggtaattgattggaaatgcatatacctataattgattggaacgtgctcatcgacatgtaaatttcaagttgatgaaggctattgtgttacaagttaccgaattgtcgattctatgctcctgtaaactgtacatcaattataggtaaaatgagtgtctgaatttatacagctcgttcgaagtgtt

SEQ ID NO: 11047 - protein, 131 aa, Panicum virgatum
  misc_feature: Ceres CLONE 1726267-R
  misc_feature: SWISSPROT Homolog: EC 3.4.23.12 Nepenthesin
SPSEYSSLPTIIDSGTVITRLPTSVYSALSEAVAAAMGGAARAPAFSILDTCFEGQASRLRAPAVGMAFAGGAALKLPTRNMLIDVDDSTTCLAFAPTDSTAIIGNTQQQTFSVVYDVARSRIGFAAGGCS

SEQ ID NO: 11048 - DNA, 1631 bp, Panicum virgatum
  misc_feature: Ceres CLONE 1726269
  misc_feature: Encodes the peptide sequence at SEQ ID NO. 11049
attgtcacgctcgagctcggatcattgacaaagccgccctcccgctcggccgctcagggcctcaggttcatctcctctctgtttctcttctccaacctttcccttctctcccttcaaaaaaaaaacaacatttcccttctctcgaagagaaactcgttcctgatctcctctcgagatcttccttccctggcggcgacgactgggcgagcggcggcccagccctttgccggcgacgagcgcgtcctccagaacaagaattatcgggtgcccatgtcctatgctgggtccgcccctgcagaggaggtgccgaacgaggtgaattcctctcaaaacaatgagcatctgtccgccccaaagtcggcggcagcttcaacaatggctccaagcatgcagagcgaggcccttgagatgcatgttgagggttctggtgctggggagccctcaattgagcagctctacaacaatgtgtgtgagatggagagctcaagtgagggtgggtccccatcacgcgaaagcttaggctcagatggggaggagtcaaggattgactcagaacttcgccaccttgttgccggggagatggaagccatgaaggtcattgaggaggaagaagagaacagaagtgttgccaatgctctcccttcagcagagaatgggaccccagtccgggcacagtcttccaattcgtccaagaagtcaaagaaggcgtcaaaatcacagctcgagtctgatgcctctgttggccccaatggaaaggcatccactgaggaaggcgagagcgagatcagcaaaccaacaagtcgagttggccgtcggcagaaatcaaatgcctatccacggaatggaacagaagatgctggacttgataacccagatcttggaccatttcttctcaaacacgcaagagacttgattgcctcggaaaacccacggcaggcgctgaaatatgctctccgtgccaccaagtcgtttgagaaatgtgctggtggaaaaccgagcttaaacttggtgatgagcttgcatgttgttgcagcaatctactgcaatttgggaaaatatgaagaggcggtaccagtgctgcatcgatccctcgagatccctgtaattgaggaaggtcaggagcatgctcttgcaaaattttctggctgcatgcagttgggggacacctatggcatgctaggtcagactgcactctcactgcaatggtatgcttccgggcttgaaatccagaagcaaacattgggtgagcaagacccaagggttggagagacttgccggtacttagccgaggcccatgtgcaggcactacaacttgatgaagcacaaagattgtgtcagatggcccttgacatacacagggagcacgatgagccagcctcactagaagaaacagctgataggaggctaatgagtctaatttgtgacaccaagggtgaccatgaagctgcactggagcatctagtgatggctagcatggccatggtagccaatggtcaggagacagaggtggcctcagtggattgcagcattggtgatatctatctctccttgggtcggtatgatgaggctgtgttttcttaccagaaagctcttacagtattcaagaccagcaaaggggagaatcatgcaac

SEQ ID NO: 11049 - protein, 453 aa, Panicum virgatum
  misc_feature: Ceres CLONE 1726269
  misc_feature (414)..(447): Pfam Name: TPR_1 Pfam Description: Tetratricopeptide repeat
MSYAGSAPAEEVPNEVNSSQNNEHLSAPKSAAASTMAPSMQSEALEMHVEGSGAGEPSIEQLYNNVCEMESSSEGGSPSRESLGSDGEESRIDSELRHLVAGEMEAMKVIEEEEENRSVANALPSAENGTPVRAQSSNSSKKSKKASKSQLESDASVGPNGKASTEEGESEISKPTSRVGRRQKSNAYPRNGTEDAGLDNPDLGPFLLKHARDLIASENPRQALKYALRATKSFEKCAGGKPSLNLVMSLHVVAAIYCNLGKYEEAVPVLHRSLEIPVIEEGQEHALAKFSGCMQLGDTYGMLGQTALSLQWYASGLEIQKQTLGEQDPRVGETCRYLAEAHVQALQLDEAQRLCQMALDIHREHDEPASLEETADRRLMSLICDTKGDHEAALEHLVMASMAMVANGQETEVASVDCSIGDIYLSLGRYDEAVFSYQKALTVFKTSKGENHA

SEQ ID NO: 11050 - DNA, 685 bp, Panicum virgatum
  misc_feature: Ceres CLONE 1726269-R
catgcgttcaaagatactcaatgaatgaagctgcagaactgttcgaggaagctagaactgctctggaacaagaatatgggccataccatccagatactctaggagtatacagcaatctcgcaggaacttatgatgcaatgggcaggctggatgaggccattgagatcttggaatatgttgttggaatgcgtgaggagaagctgggaaccgctaacccagatgttgacgatgagaagcggagacttggggagctgcttaaggaggctggccgggtgcgaagcaggaaggcgaaatccctggagaatctgctcgagaccaacgcatacactgtcaccaagagaaacacagttgcagcatgactgttctgatgaaaggtgacgattgttactaaggtattcaattggtttgttcgagtggggcaatgggaatagtggtgtttacctatctaaaaatatgaaatgttcaaattgattgctgtaaaggttcaaatgctatcattggttattacttgttcggtgccctttatagttgtgtttgtgaatgcgagcggtgactactgtttctcctttttctacctctggtgtgcgagtttatctggcaaatccgccacgtcagaactattcatagcactgtaactgcattttcttgaatgaaaaaaattaatgcaatagctcacatgatccag

SEQ ID NO: 11051 - DNA, 2069 bp, Panicum virgatum
  misc_feature: Ceres CLONE 1726278
  misc_feature: Encodes the peptide sequence at SEQ ID NO. 11052
actctcacgcacaagctccccgaattctttttaatttttaaacccccgccgcgggagaggaaggagaaaaaaaaaaagaggcaagcaagcgcaaaacccctggtccccaccttctccggccaccaccgcgtttcagatcgggaagggcgccgctcccgccggagaggaggaaccgccgctccatcccctccatttcgaaatcccgttttggcggcctccgccattccagccagccctcctcctccgctacataaccgcctcgatctgttccccatttctctccccctcctcccggaccccacccgccgagccaaaccctaggggcccgcgccgccgacgaggaggatggcggacaaggagaacgcgccggcgccggcgccggccgcggggccccggctcacccgatccgccgccaagcgcgcggccgaggccgccgccggcgccggcagcggcggcccccccgccaagcggaagcgggtggcgctcggggagctcccggcgctcgccgcgaacgccgccgccgtcaagcgcgccccgccgccccgcccggtcaagcccgcgaggggcgccgccaaggccgcccggcccggcaagccggtccccagacccgcacacgcccccgcggctgcggccgacgccggagccgagcgctgcggatcctcctccccgccgcgcgccgccgcgggggccgccgatcccgaccgcgactcctccgcgtccacctcccctccgcgcgccacggccgccgcggaccccgaccgcgactccgcctcctcctcccccccgccgcgcgccgccggggcgggggccgtggcgccccccgacgcgcagctctgcgggtcctacgcctccgacatctacacctacctccgcgccctggaggtggagccgcggcggcggccgagatccgactacatcgaggccgtgcagtcggacgtcacggccaacatgcggaccatcctcgtcgactggctcgtcgaggtcgccgaggagtacaagctcgtcgccgacacgctctacctcgccatctcctacgtcgaccgtttcctctccgccaacttgctcagccgcgacaagttgcagctccttggcgtcgccgccatgctcatcgccgcgaagtacgaagagatcagcccgccgcatgcggaggacttctgctacatcactgacaacacctacaccaaacaggagcttcttaagatggagagtgacatactcaagctgctccagttcgagttgggcaatccaacaatcaagaccttcttgaggttgtacgctgactggatcaaaagttcatattttctgttgtacctcgctatccatctgaacatatcagctagtggaatgcctgacactctgcctctcatttgtctcgctgattccaggcggttcacgagatcagcccatgaagacaaaaagcgctccatcttattaatggagttcttggggagttaccttgctgagctgagtctgctggactatggttgtctccggttcctgccatcaatagttgctgcttcagtgatgtttgttgctaggctgaccattaatcctaatgtcaatccttggaacaagaagttacagaaggtgacgggctacaaggtttctgaactcaaggattgcatcgtatccatacatgacttgcagctcaacaggaagtgttcatcattgatggcaattcgtgacaagtacaagcaacacaagttcaaatttgtgtcgaccctgcttcctcctgtcgtgatccctacttcttactttgaagacttagcggagtagcttggtcatggacccacaccactgtaaggctaacaatctgagctttccttgagctcttagggataggggagaactactgttggtgagctgcttgtcagtgaagtaggtgctgaaagctatttatgtgctcctggttctttaggagttgctagttagtgagaccaggcattcttctgttttgtgaattgtattttttgtatcatatcttaggacatgttgccttggtctgttggccacaaatttgtaatgtttgatatgttggctcgtttcatctgaatctgattgatttcagt

SEQ ID NO: 11052 - protein, 476 aa, Panicum virgatum
  misc_feature: Ceres CLONE 1726278
  misc_feature (170)..(299): Pfam Name: Cyclin_N Pfam Description: Cyclin, N-terminal domain
  misc_feature (340)..(467): Pfam Name: Cyclin_C Pfam Description: Cyclin, C-terminal domain
  misc_feature: Useful for making plants with modulated nitrogen use efficiency
MADKENAPAPAPAAGPRLTRSAAKRAAEAAAGAGSGGPPAKRKRVALGELPALAANAAAVKRAPPPRPVKPARGAAKAARPGKPVPRPAHAPAAAADAGAERCGSSSPPRAAAGAADPDRDSSASTSPPRATAAADPDRDSASSSPPPRAAGAGAVAPPDAQLCGSYASDIYTYLRALEVEPRRRPRSDYIEAVQSDVTANMRTILVDWLVEVAEEYKLVADTLYLAISYVDRFLSANLLSRDKLQLLGVAAMLIAAKYEEISPPHAEDFCYITDNTYTKQELLKMESDILKLLQFELGNPTIKTFLRLYADWIKSSYFLLYLAIHLNISASGMPDTLPLICLADSRRFTRSAHEDKKRSILLMEFLGSYLAELSLLDYGCLRFLPSIVAASVMFVARLTINPNVNPWNKKLQKVTGYKVSELKDCIVSIHDLQLNRKCSSLMAIRDKYKQHKFKFVSTLLPPVVIPTSYFEDLAE

SEQ ID NO: 11053 - DNA, 808 bp, Panicum virgatum
  misc_feature: Ceres CLONE 1726282
  misc_feature: Encodes the peptide sequence at SEQ ID NO. 11054
cgaagcggcgacagagcgcctccctctccctaccacccggtcggctcggcgctcgctcccaccacagaaatctcgccgctgcaggtagaagaagctcgtcctgtttatcatgtcaggaggatcaggggggtcttcaccaccatcaaggcggaccagctttaattctttatctcgagacctagaccttccttcagaacaagggtgtctctctattgttgtacttggggcttctggtgaccttgccaagaagaaaactttcccagcactctaccaccttttcgatcagggatttatacagtctggcgaagtgcatatatttggttatgctagatcaaatctttctgatgacgggttaagagaacgcattcgtggatatctcaaaggagccccggaagaagatctttcagaatttttgcaattgataaaatatgtcagtggttcttatgacaatggggagggatttgagaaattgaacaaggcaatatcagagtatgaggcgtcaagcaaatcagaaagctatcgcaggctcttttatttggcattgcctccatctgtctacccttcagtgtgcaaaatgatcagaacatactgcatgaatccatcttctcaccctggatggactagagtcattgttgagaagccctttggaaaggacttggattctgcagaagaattaagtgcccaacttggggagctattcgaggaacaccaactgtacagaatagaccattacctaggaaaagagttggtccaaaacttgcttgtccttcgttttgccaaccgcttgttcatgcctctttggaactgt

SEQ ID NO: 11054 - protein, 232 aa, Panicum virgatum
  misc_feature: Ceres CLONE 1726282
  misc_feature (36)..(216): Pfam Name: G6PD_N Pfam Description: Glucose-6-phosphate dehydrogenase, NAD binding domain
  misc_feature: SWISSPROT Homolog: EC 1.1.1.49 Glucose-6-phosphate 1-dehydrogenase
MSGGSGGSSPPSRRTSFNSLSRDLDLPSEQGCLSIVVLGASGDLAKKKTFPALYHLFDQGFIQSGEVHIFGYARSNLSDDGLRERIRGYLKGAPEEDLSEFLQLIKYVSGSYDNGEGFEKLNKAISEYEASSKSESYRRLFYLALPPSVYPSVCKMIRTYCMNPSSHPGWTRVIVEKPFGKDLDSAEELSAQLGELFEEHQLYRIDHYLGKELVQNLLVLRFANRLFMPLWN

SEQ ID NO: 11055 - DNA, 704 bp, Panicum virgatum
  misc_feature: Ceres CLONE 1726282-R
  misc_feature: Encodes the peptide sequence at SEQ ID NO. 11056
ttcgggtacacaatgaaagatgggaaggtgttcctttcattcttaaagctggtaaagcattaaactcaaggaaagcagaagttcgggtgcaattcaaggatgttcctggtgacatttttaaatgtaagaagcaaggaagaaatgagtttgttatacgcctccagccatcagaagccatgtacgtgaaactaactgttaagaaacctggtttagagatggctactgaacagagtgagcttgatctgtcatatgggatgcgctaccaaaatgtcaaaattcctgaggcatatgaacgcctcatcttggatacaatacgaggagaccagcagcactttgttcgcagagatgagttaaaggctgcttggcagatcttcactcctttgctgcatgacattgacgatggcaagctgatggctgttccatatcaacctggaagtcgaggccccaaggaagctgatgaattgagcgcgaaagttggttatgtccagacccacggttacatatggataccacccacccttgcatagaagagaaaggtctgtttccatggcctcataggaattgtgtatctaggaagagtgccctacaataaagccacgcatatatatcacccagttttcactgttaccgacaaccacggcattgtaataatgttgtgctgaatattccaactccgatatgaaataaaaatgcatgttcaatcg

SEQ ID NO: 11056 - protein, 174 aa, Panicum virgatum
  misc_feature: Ceres CLONE 1726282-R
  misc_feature (1)..(165): Pfam Name: G6PD_C Pfam Description: Glucose-6-phosphate dehydrogenase, C-terminal domain
  misc_feature: SWISSPROT Homolog: EC 1.1.1.49 Glucose-6-phosphate 1-dehydrogenase
RVHNERWEGVPFILKAGKALNSRKAEVRVQFKDVPGDIFKCKKQGRNEFVIRLQPSEAMYVKLTVKKPGLEMATEQSELDLSYGMRYQNVKIPEAYERLILDTIRGDQQHFVRRDELKAAWQIFTPLLHDIDDGKLMAVPYQPGSRGPKEADELSAKVGYVQTHGYIWIPPTLA

SEQ ID NO: 11057 - DNA, 918 bp, Panicum virgatum
  misc_feature: Ceres CLONE 1726284
  misc_feature: Encodes the peptide sequence at SEQ ID NO. 11058
  misc_feature (810)..(810): n is a, c, t, g, unknown, or other
tctctcggactctctcctcccttgctctcccttccctggtggcggcggcgaccgagcggcggcgtcgtttgtcctgtcttcgcccaaccctttgctggcgacgagcgcatccttcagttttaacaatgaagatgatcgctgcctacctgctcgcggttctgggtggaaacacttccccaactgctgatgacgttaagaacattctggaatcagttggggctgaagctgatgaagagaaactggacttcctgctcacagaactcaaagacaaggacataacagaagtgattgcagctggaagggaaaagttcgcctccgtgccttcaggtggtggtacaattgctgtgggagctccggctgctgcagctggtggtgctgcacctgctgaagaggcaaagaaggaagagaaggttgaagagaaggaggaatcagatgatgatatgggtttcagcttgttcgattaagcactgctgccccgcatatagtttcttctcacgtgtggtctgatacaccggtcggtatccgcaaaataaccatgccgagaactagtatcagtgtgctattttgcttgtgatgatggacatttctagtactcttttttgaacgtgaacatttctagtactgtggtatcatgatatggagtattgagaactactctgtgctatttcgtgtgtgatgatgtacgtgtctagtaccgttggtatggtagcatgtcctcttcaggaaacttgagaagttgaatgttctgcatatgtgaaatttcggaaatgtaagtaccgtaaaaaaaaatgcacagacgacagcgagccnagtgtactactcccagtgaagccgcactagctagccacaccagcagcttgacaagctagctagctagctaggccgcagccatgtcggaggagaagcaccaccacttct

SEQ ID NO: 11058 - protein, 112 aa, Panicum virgatum
  misc_feature: Ceres CLONE 1726284
  misc_feature (17)..(111): Pfam Name: Ribosomal_60s Pfam Description: 60s Acidic ribosomal protein
  misc_feature: Useful for making plants with altered oil content
  misc_feature: Useful for making plants with modulated biomass
MKMIAAYLLAVLGGNTSPTADDVKNILESVGAEADEEKLDFLLTELKDKDITEVIAAGREKFASVPSGGGTIAVGAPAAAAGGAAPAEEAKKEEKVEEKEESDDDMGFSLFD

SEQ ID NO: 11059 - DNA, 632 bp, Panicum virgatum
  misc_feature: Ceres CLONE 1726284-R
ccgtcgccgccggcgccttcgcgctcgtacgtcctcatcgtctggtggtcgccggccggcggccgtgatatgaataataattaacgaacttgactggctgatgctatttgatcctctgctggatttgtgatgatattgttgtttatttgggcagtacgagaagcacgaggcgaagaaggacccggagcacgcgcaccggcacaagatcacggaggagatcgccgccacggcggccgtcggcgccggcggctacgccttccacgagcaccacgagaagaagaaggaccacaaggacgccgaggaggccagcggcgagaagaagcaccaccacctcttcggctgacccgccggcgagcgagctccggcccggccgccgcgcacccgcctgcttgctccaataattgtggccatgatttcgcaataagtcccttccggacccttagcttgcttgcttgtgtgagactgagaggtggggcccgcgcgtcgaggtgtgttccggcctgtacgtgcttgatttttctttgcgtccgtaattgcgttgaataaccgggagcgatgcacgtgtggctcccagtctgtctgtctgtggttgagtgtctgtatcctgatgatcaactcgtggaagtttttac

SEQ ID NO: 11060 - DNA, 2481 bp, Panicum virgatum
  misc_feature: Ceres CLONE 1726294
  misc_feature: Encodes the peptide sequence at SEQ ID NO. 11061
gtatctgcaatctatctgctccacatcagtagcagtagccgtagcagcggggagtcactcatggcggccgcgtcgcacaagcccctgggcgcgatcaccgccggcgacctggccgccgcggcgcccgggacggacgccgccgcgttccacgcggccctccggcgcgcgctcggcgccggcgacgcggaccccgccgccgtgtggggggagctctgccggtccctgctccgcccggacgtccccttcgccatccaccggatgctttactacggctgcttcgccgggctcccgtcccccacgccgcccgcctggacccccgaccccgaggaggcggccttgaccaatgtcggccgcgtcatggaggcgcgggggagggagctcctcggagacgcgtaccaggatcccatcaccagcttcactgacctctacaagttctccaacgagaacccagaggcgtactggaagatggtctttgaggatatgggtgttgagttcagtgtggagccgtcttgcatctggagagagagccatgcgtatcctggtggcgagtggttaccgggcgcagagctgaatgctgccgccaattgcctgacggctaaacctgggagaagctccgaggatgttgccattgtgtggagggatgaaggaaaggattcagaacctctcaacttcataactcttgaggagctgaggaaaaaagtttgccatgtggcaaatgcacttgatgcactggacctgccaaagggatccgcaattgctatcgacatgcctatgaacgtgaatgctgtcgtgatctaccttgcgattgttttagcaggctatgtggttgtctcaattgcagacagcttttctgcaccggcaatatcaacaaggttgaagatatcagaagcaaaagcaattttcactcaggattacatccttcgtgatgacaaggaactgccattgtacagtagagttgtggaggctaaggcccctatggcagttgtgatctctgcaaggggatcattgccaataaagggactgcgtcttaacgacctatcctggcaggatttccttggaagggttaatgataccaaggtggaaagttatgctgctgttaatcaacctgcctacgctttcaccaatatcctattttcgtcagggaccacaggggagcccaaggcaattccatggacacatatgacccccctaaaggcagctgctgatggatggtgtcacatggatattcgtaaaggagatgttgttgcgtggccaacaaatcttggttggatgatgggcccctggcttgtatatgcctccttactcaatggagcttccatggctctgtataacggctccccaaatagttcaggttttgcaaagtttgtacaggattctaaggtgacaatgcttggactggtacccagcatcgctcgtacatggaaaaatactgattgtacagctggatttgactggtcctccatccggtgctttagctcatctggggaggcgtccagtgtggatgactatttatggctgatgggaagagcttgctacaagccagttattgagtattgtggaggcacagagattggtggtggatttgttactggatctttgctgcaacctcaagcgctgtctgcattcagcacacctgccatgggttgcaacttgttcattcttgacagcagcgggaatcccttgccacaagattcagtgggtattggtgaactcgcgcttgatccgattttatttggatcatcaacaactctgctaaacgctgatcatcaggaagtttatttcaacggaatgccagaatggaatgggaaagtcctccgcagacatggagatgaatttgagcgtacttgtgatggatattatagggctcatgggcgcgcagatgacacaatgaatcttggtggcattaaggttagttccatcgagattgagaggatctgcaacagagcaaacgacgccatcctcgaaacagcagctattggggttccgccaataggtggtggccctgaacagctaacgatagccgtcgttttcaaagaccagagcaaacaagtagaggacttgaaccagctgaaactagcgttcaacatggctctgaagaagctgaaccccctcttcaaggtctcttctgttgccgtggttccatcgctccctagaaccgcctcgaacaaggtcatgaggagagtcctgcgcaaggagttcacccaagcagcacaggcgaaaatatcaaaaatctagatacttagaaatatatttcttccctgcaaatgtaccccaccaagaaagagctatacaacaaagtgtgcatatcattatacataggcccttcagaatcaagttgtttacctctagaaaggaggtatgagttgtatctatatttcggaaaaataaatgagctgtatttcctgccaaaggatttcttcacttcgtgccaactctcacacatgaggtgctaataaaacattcatgatatcattttttccg

SEQ ID NO: 11061 - protein, 724 aa, Panicum virgatum
  misc_feature: Ceres CLONE 1726294
  misc_feature (206)..(638): Pfam Name: AMP-binding Pfam Description: AMP-binding enzyme
  misc_feature: SWISSPROT Homolog: EC 6.2.1.1 Acetate--CoA ligase
MAAASHKPLGAITAGDLAAAAPGTDAAAFHAALRRALGAGDADPAAVWGELCRSLLRPDVPFAIHRMLYYGCFAGLPSPTPPAWTPDPEEAALTNVGRVMEARGRELLGDAYQDPITSFTDLYKFSNENPEAYWKMVFEDMGVEFSVEPSCIWRESHAYPGGEWLPGAELNAAANCLTAKPGRSSEDVAIVWRDEGKDSEPLNFITLEELRKKVCHVANALDALDLPKGSAIAIDMPMNVNAVVIYLAIVLAGYVVVSIADSFSAPAISTRLKISEAKAIFTQDYILRDDKELPLYSRVVEAKAPMAVVISARGSLPIKGLRLNDLSWQDFLGRVNDTKVESYAAVNQPAYAFTNILFSSGTTGEPKAIPWTHMTPLKAAADGWCHMDIRKGDVVAWPTNLGWMMGPWLVYASLLNGASMALYNGSPNSSGFAKFVQDSKVTMLGLVPSIARTWKNTDCTAGFDWSSIRCFSSSGEASSVDDYLWLMGRACYKPVIEYCGGTEIGGGFVTGSLLQPQALSAFSTPAMGCNLFILDSSGNPLPQDSVGIGELALDPILFGSSTTLLNADHQEVYFNGMPEWNGKVLRRHGDEFERTCDGYYRAHGRADDTMNLGGIKVSSIEIERICNRANDAILETAAIGVPPIGGGPEQLTIAVVFKDQSKQVEDLNQLKLAFNMALKKLNPLFKVSSVAVVPSLPRTASNKVMRRVLRKEFTQAAQAKISKI

SEQ ID NO: 11062 - DNA, 1628 bp, Panicum virgatum
  misc_feature: Ceres CLONE 1726300
  misc_feature: Encodes the peptide sequence at SEQ ID NO. 11063
agcccacaagactccgccgcagccgcagccatgcgcccgcttatccgaaccgcgcgctgctgtctcctccgcgcgcgtgttcgcgccatggccacgcttcccatggcgccccaggccgccgccgccatctcctcctcctcttccacccgccccatctcctcgtcacggcccaatcgcatcctcctcgcccgcttcttccccgccgcgccggctccgtccggggcgagggggctccggacgtccgcggccgcggaggctgcggccgtcgaggtgggcggcgtcaagatcgcgcgcggcgatgttgttaaggaggatgacccgacaaacaacgtgccagacactatcttttcgaagattggactgcagctgcacaggagggacaaccaccctctagggattctgaagaacactatttatgattactttgacaagaactttgctgggcagtttgacaagtttgatgatctttgccctcttgtctctgtcaagcaaaactttgatgacgtgttggtccctgctgaccatgtaagccggagttacaatgacacatactatgttgatagtcaaactgtcttgagatgtcataccaatgctcatcaagcagagcttctaagggatggtcatacacattttcttgtaacgggggatgtttatcgtagagattctattgattcaactcactatcctgtcttccaccagatggaaggcttccgtgtcttttctccagatgactggtcaggttctggcatggatgggacagcatatgcagctgcagacctcaagaaaacgctggaaggcctggcaagacatctttttggtgctgtcgagatgcgatgggttgacacatactttccgttcaccaatccatcctttgagcttgaaatatattttcaggatgattggttgaaagttttgggatgtggagtcaccgagcaggaaattttgaaaagaaatggcaggacagaccatgtggcatgggcctttggactgggcttagaacgcctcgcaatagtcctttttgacattccagatatacgactcttctggtcaaatgataaacggttcacatcccagttcgcagaaggcaagcttggtgtcaagttcaagccattttcaaagtttccaccatgttacaaggatatgagtttctggatcaatgatgcattcacagagaacaacttatgtgaagttgtcagaggaattgctggagatcttgtagaggaggtaaagctcattgataatttcaccaacaagaaaggcatgacaagtcattgctacagaatagcctataggtccatggaacgttcactcacagatgaggagattaacagcctgcagttgaatgtcagggaaaccgtgaaaaataaattgaatgttgagttgagatagaagggcgctagttcagatgttataccaagaactaatttttgcctgtctttatttgtaaatccattgaaaatgtaattttctttttgtatatggagaaaatggaccatttggttctgtattgatcacgttttcaactctgtcaagggtagagaaaaaagcccctgctcaaattgtagcttgcagccacaatgattaagaagcattgtgcaatgctcagtttcttttttcgcaggtagttc

SEQ ID NO: 11063 - protein, 452 aa, Panicum virgatum
  misc_feature: Ceres CLONE 1726300
  misc_feature (362)..(452): Pfam Name: FDX-ACB Pfam Description: Ferredoxin-fold anticodon binding domain
  misc_feature (98)..(349): Pfam Name: tRNA-synt_2d Pfam Description: tRNA synthetases class II core domain (F)
  misc_feature: SWISSPROT Homolog: EC 6.1.1.20 Phenylalanine--tRNA ligase
MRPLIRTARCCLLRARVRAMATLPMAPQAAAAISSSSSTRPISSSRPNRILLARFFPAAPAPSGARGLRTSAAAEAAAVEVGGVKIARGDVVKEDDPTNNVPDTIFSKIGLQLHRRDNHPLGILKNTIYDYFDKNFAGQFDKFDDLCPLVSVKQNFDDVLVPADHVSRSYNDTYYVDSQTVLRCHTNAHQAELLRDGHTHFLVTGDVYRRDSIDSTHYPVFHQMEGFRVFSPDDWSGSGMDGTAYAAADLKKTLEGLARHLFGAVEMRWVDTYFPFTNPSFELEIYFQDDWLKVLGCGVTEQEILKRNGRTDHVAWAFGLGLERLAIVLFDIPDIRLFWSNDKRFTSQFAEGKLGVKFKPFSKFPPCYKDMSFWINDAFTENNLCEVVRGIAGDLVEEVKLIDNFTNKKGMTSHCYRIAYRSMERSLTDEEINSLQLNVRETVKNKLNVELR

SEQ ID NO: 11064 - DNA, 675 bp, Panicum virgatum
  misc_feature: Ceres CLONE 1726302
  misc_feature: Encodes the peptide sequence at SEQ ID NO. 11065
agcgtcagccaagggcagccagccatgaacgcggcggcctccttcgtcgccgtggcgctggccctggcggccctcgtccccgtctcgctgctgctcctgaaccggctcctctacggcaagctgccgccgggcccccgcccccgccccgtggtgggcaacctcttcgacgtgcagccggtgcgctgccgctgctaccaggagtgggcgcggcggtacgggcccatcatgacggtgtggctggggccggagccgacggtggtggtgtcgacggcggagctcgccagggaggtgctcaagacctacgaccagagcctcgccgaccgcaagcgcgaccgctcctcggagcgcttcagccgcggcggcaaggacctgatctgggccgactacggcccgcactacatcaaggtgcgcaagctctgcaacctcgagctcttcacgccgcgccgcctcgaggcgctcaggcccatccgcgaggacgaggtcaccgccatggtcgactccgtgcacagggccgtcaccgcgccgggcaatgaagggaagccgttggtggtgaagaaccacctctcgatggtggccttcaacaacatcacgcggctggccttcgagaagcggttcgtgaacgcggccggcgacctggacgagcaagggcgcgagttcaagggcatcatcaacgac

SEQ ID NO: 11065 - protein, 216 aa, Panicum virgatum
  misc_feature: Ceres CLONE 1726302
  misc_feature: SWISSPROT Homolog: EC 1.14.13.21 Flavonoid 3'-monooxygenase
  misc_feature: Useful for making plants with altered carbohydrate content
  misc_feature: Useful for making plants with altered lignin content
  misc_feature: The sequence is a functional homolog of SEQ ID NO 4 in US patent 7071376
  misc_feature: The sequence is a functional homolog of SEQ ID NO 6 in US patent 7071376
  misc_feature: Useful for making plants with altered cell wall content and/or composition
MNAAASFVAVALALAALVPVSLLLLNRLLYGKLPPGPRPRPVVGNLFDVQPVRCRCYQEWARRYGPIMTVWLGPEPTVVVSTAELAREVLKTYDQSLADRKRDRSSERFSRGGKDLIWADYGPHYIKVRKLCNLELFTPRRLEALRPIREDEVTAMVDSVHRAVTAPGNEGKPLVVKNHLSMVAFNNITRLAFEKRFVNAAGDLDEQGREFKGIIN

SEQ ID NO: 11066 - DNA, 699 bp, Panicum virgatum
  misc_feature: Ceres CLONE 1726302-R
  misc_feature: Encodes the peptide sequence at SEQ ID NO. 11067
gcggacgccgctcatgctcccgcacaaggccagcgccggcgtcaagatcgccggctacgatgtgcccaagggcgccaacatcatcgtcaacgtgtgggcgctggcgcgcgaccccgaggtctgggaggacccgctcgcgttccggccggagcgcttcctccgggagaacatcgacatcaagggcgccgacttccgcgtgctcccgttcggcgccggccggcgggtgtgccccggcgcgcagctcgggatcaacctggtggcgtccatgctcgggcacatgctgcaccacttcagctggtcgctgccggaggggacccggcccgaggacgtggagatgatggagacgcccggcctcgtcaccttcatggctacgccgctcaaggccgtcgccacgccgcgcctcgacaacgaggagctctacaggcgtgtgccgtccgagatgtgagcgcctgcatatgctggcgcgccgtctgcattttcccggtgtgtactgctcttgtggacgggatcgatcggaaggtgatgatgccgtcgttgcaaatttgtgcgacccgttcgttattattatctcttttctggcgttcttctagttatatgcatgaacgagcatttgtgtgtacttcttcagaccttgcacgcctcgccgatattattatctgtttgtcaggcaggcaggaattcataattaatttgggcacc

SEQ ID NO: 11067 - protein, 147 aa, Panicum virgatum
  misc_feature: Ceres CLONE 1726302-R
  misc_feature: SWISSPROT Homolog: EC 1.14.13.21 Flavonoid 3'-monooxygenase
  misc_feature: Useful for making plants with altered carbohydrate content
  misc_feature: Useful for making plants with altered lignin content
  misc_feature: The sequence is a functional homolog of SEQ ID NO 6 in US patent 7071376
  misc_feature: The sequence is a functional homolog of SEQ ID NO 4 in US patent 7071376
  misc_feature: Useful for making plants with modulated light sensitivity
  misc_feature: Useful for making plants with altered cell wall content and/or composition
RTPLMLPHKASAGVKIAGYDVPKGANIIVNVWALARDPEVWEDPLAFRPERFLRENIDIKGADFRVLPFGAGRRVCPGAQLGINLVASMLGHMLHHFSWSLPEGTRPEDVEMMETPGLVTFMATPLKAVATPRLDNEELYRRVPSEM

SEQ ID NO: 11068 - DNA, 1696 bp, Panicum virgatum
  misc_feature: Ceres CLONE 1726308
  misc_feature: Encodes the peptide sequence at SEQ ID NO. 11069
accgctcgaagccgcgcctgcgccactgcggccgcgccgacacccgcgcccgcccgcacgcttgcggccccagccagagccgccggcggcgagcgcgcgagcggtggaccggtggtaggtggcaaagcaatggtggcgccgggtggaggaggaggaggaggaggctcggcgcggtggccttcggaggaggagttggaaattgtacgaaagaaagttgtggagattagtggaagggatgaacgtgaggttagggtcgctgcttgcccttacagaatttgccctttgggggctcacattgatcatcagggtggaattgtcacagcaatgaccataaattatggagtactccttggttttgtgccctctaatgattccgagattttactccaatctggccaatttgaaggtgttatacgattcagagttgatgacttacaaaagcctattgataacccagagaacataaactgggaaagctatgcaagaggtgctgtttatacactgcagaatagtggatatgatctcaggaagggtatcataggctatatttctggtgtgaaaggtcttgatagctcagggcttagttcttctgcagcggttggcatttcctatttactggctttagaaaatgtaaatgatctggttgtatcatctgtggataacattcagttggacaagtccattgaaaataaatacttgggtcttgaaaatggcattctagatccatctgccattttgttgtcacggtatggttatctcaccttcatggattgcaagaccgcttcaccttcctacgtctacttctcagagctgagtaaaagccagcagcctcagggacatctaccattcaagattttgttggcattttctggcctgcaacataatctgccgaagaagcgtggatataatacacgagttttcgagtgcaaagaggctgcccgtgctcttttgcacgcttcaggctgtgaagaagcatcaaatatacttcgtaatgttgactcggttgtatatgaggcccagaagtgtgtattggaagaaaatctttccaggagagctgagcactacttttctgaaatgaagcgggttgctaagggcagagatgcatgggcttttggaaacctgcaagaacttgggcagctgatctctgcttctggtcgtagctccatactcaactacgaatgcgggagcaaagagatgatacagctgtacgagatcctcctgaaggcccccggcgtcctgggcgcccggttcagcggcgctggcttcaggggctgctgcctggcgatcgtggagagcaaccgcgctgaggaggcggccgcctatgtcgcagccgagtacgagaaggcccagcccgagctggtgtccaggatccccgcggatcgccgcgtgctggtctgcgagcccggggactccgcgcgcgtcatattgcccgacgactgcctccattcgtgatggcgcccttctgacggaggccggcggtgtgaagagggctgctccacgctcgtgtcgtgtgggcgtcggagtgtcaattattgacgacgtatagtatccgagggtgcagggcatccttgtacgtgatgtgctgtccatttgacccattcgtttgtacgtacgatacaataagcgtgacgctcgcgtttgtatcgaacaataagattttcgagtaaaaaaagaggtggaatgcactgtgtagact

SEQ ID NO: 11069 - protein, 440 aa, Panicum virgatum
  misc_feature: Ceres CLONE 1726308
  misc_feature (324)..(405): Pfam Name: GHMP_kinases_C Pfam Description: GHMP kinases C terminal
  misc_feature: SWISSPROT Homolog: EC 2.7.1.6 Galactokinase
MVAPGGGGGGGGSARWPSEEELEIVRKKVVEISGRDEREVRVAACPYRICPLGAHIDHQGGIVTAMTINYGVLLGFVPSNDSEILLQSGQFEGVIRFRVDDLQKPIDNPENINWESYARGAVYTLQNSGYDLRKGIIGYISGVKGLDSSGLSSSAAVGISYLLALENVNDLVVSSVDNIQLDKSIENKYLGLENGILDPSAILLSRYGYLTFMDCKTASPSYVYFSELSKSQQPQGHLPFKILLAFSGLQHNLPKKRGYNTRVFECKEAARALLHASGCEEASNILRNVDSVVYEAQKCVLEENLSRRAEHYFSEMKRVAKGRDAWAFGNLQELGQLISASGRSSILNYECGSKEMIQLYEILLKAPGVLGARFSGAGFRGCCLAIVESNRAEEAAAYVAAEYEKAQPELVSRIPADRRVLVCEPGDSARVILPDDCLHS

SEQ ID NO: 11070 - DNA, 876 bp, Panicum virgatum
  misc_feature: Ceres CLONE 1726311
  misc_feature: Encodes the peptide sequence at SEQ ID NO. 11071
cctgtcgggctcgacaagatgctagtggatgacattggggatgttataataactaatgatggagcaaccatactgaagatgttggaagtcgagcacccagctgccaaggttcttgttgagttggctgagctccaggaccgtgaggtaggagatggaacaacttcagttgtcatcattgccgcagagttgctcaagagaggcaacgatcttgtgaaaaataagatccatccgacctctataatcagtggctacaggcttgctatgcgcaaagcctgcaaatatgtggaggaaaagttggcagtcaaggttgataggcttggaaaagactcccttattaactgcgcaaaaactagcatgtcatcgaaactgattaatagtgacagtgatttctttgcaactatggtcgttgatgcagttcaagcagtgaagactacaaatgccaagggggaagtgaagtatccaatcaagagcatcaatattttgaaagctcatggtaaaagtcagaaggatagttatctgctgaatgggtacgcattaaacacaggccgtgcagctcaaggaatgcctactagagtaactcctgctagaattgcttgtcttgattttaaccttcagaagacaaaaatgcaacttggtgtccaagttcttgtaactgatccaagggaacttgagaagattcgtcaaagagaatctgacataacaaaggagcgaattgagaaaattctcaaggctggagctaatgttgtgttgaccaccaagggaattgatgatatgtccttgaagtactttgtcgaggctggagcaattgcagtaaggcgtgtgcgcaaggaagatttgcgtcatgttgccaaagccaccggtgcaactatgattact

SEQ ID NO: 11071 - protein, 291 aa, Panicum virgatum
  misc_feature: Ceres CLONE 1726311
  misc_feature (1)..(291): Pfam Name: Cpn60_TCP1 Pfam Description: TCP-1/cpn60 chaperonin family
PVGLDKMLVDDIGDVIITNDGATILKMLEVEHPAAKVLVELAELQDREVGDGTTSVVIIAAELLKRGNDLVKNKIHPTSIISGYRLAMRKACKYVEEKLAVKVDRLGKDSLINCAKTSMSSKLINSDSDFFATMVVDAVQAVKTTNAKGEVKYPIKSINILKAHGKSQKDSYLLNGYALNTGRAAQGMPTRVTPARIACLDFNLQKTKMQLGVQVLVTDPRELEKIRQRESDITKERIEKILKAGANVVLTTKGIDDMSLKYFVEAGAIAVRRVRKEDLRHVAKATGATMI

SEQ ID NO: 11072 - DNA, 764 bp, Panicum virgatum
  misc_feature: Ceres CLONE 1726311-R
cagatgatgatgttatcctggtgaaaggcacgaagaacaccagcgcggtgtccataatacttagaggtgcaaatgatttcatgcttgatgagattgaacggtccttgcatgatgccttatgcattgtgaagagaaccctggagtcaaatatggttgttgctggcggtggtgcagtcgaagctgcattgtcagtttacttggagaaccttgccacaaccctgggatctagggaacagttggcaattgctgaatttgctgaatctttgttaatcatacccaaggtactctctgttaatgctgcaaaagatgcaactgagcttgtagcaaaacttagggcatatcatcatactgctcaaacaaaggctgataagcaacatttctcaagcatgggtcttgacctctctaaaggtatcattcgcaacaaccttgagtatggtgtgattgaacccgcgatgagcaaagtaaagattattcagtttgccactgaggcagccatcactatactgaggattgatgacatgatcaagcttaccaaggaagagggtaacgaagaggagtaaccagctcacccgtaggggtagtggactattgtgtgatgattgatagcatgtaatatttgtcttcactttttttgctagctgtggacattttagtagggtgttgtacgagaaccgcaagcggatctgtatcctagtgagttgacgttatttggaaggacggctcacgaatgaatcgagtttttgtgtactgtgggggcaaaacac

SEQ ID NO: 11073 - DNA, 2529 bp, Panicum virgatum
  misc_feature: Ceres CLONE 1726323
  misc_feature: Encodes the peptide sequence at SEQ ID NO. 11074
aacctcagcgatgcgagctgcccagctgcctcgctcctcctcttcctgcgccagctagctgcgttggccacccagtggagagaggaggagcctctatagctagtaggagacaggcggagacagagagggggcggagcagcgcagctagagatcgatagcgtcgtcgtcgtggagcgagatcgatggacagcggcagcggggaggcgtggcgcggggcggtgtctccggcggcgcgctacgcggagtccggcggcgccagtctgacgtgggagaacctcacggcggtgctgccgggcggcggcggccgggccaccaagaagctggtgcaggggctgtacggctacgccgtgcccggccgcgtcgtcgccatcatggggccgtccggctccggcaagtccacgctcctcgactcgctctccgggaggctggccaggaacgtggtcctcaccgggaaggtgctgctcaacggcaagaagaggcggcttgactatggcgtcgtggcgtatgtgactcaagagaacatactcctgggcacgctgacggtccgggagacggtgacctactcggccctgctgcggctgccgtcgagcatgcgcaagtcggaggtgcgccgcatcgtggacgacacgctcgacgagatggggctccgggagtgcgccgaccgccacatcgggacctggcacctccgcggcatcagcggcggcgagaagaagcgcctgagcatcgcgctggagatcctcacccgcccgcgcctcctcttcctggacgagcccaccactgggctcgacagcgccgccgccttctccgtcgtgcagacgctgcgccagctcgccgtcgacggcggccgcaccatcgtctcctccgtgcaccagcccagcagcgaggtcttcgcgctctttgacgacctctgcctcctctccagcggcgagtgcgcctacttcggtgatgccaagctggcaacgcagttctttgcggaaacaggcttcccctgccccagccggaggaatccatccgaccatttcctccggtgtgtcaactccgacttcgatgatgtcgcagccaccatgaaaggatccatgaagctgcgagcagaggcagagcttgatcccctgctgaattactccacgtcagagatcagagaacggctagtggagaagtacaggatctccgattatgccttgatggtcaggaacacaatacacgagataaccaagatcgagggtgtggtggaggaggtgatccgtggcagcgaggcgagctggttcaagcagctgcgcacgctgacgagccggtccttcaccaacatgtcccgggacctcaactactactggctgcgcatcatcatctacatcgtcatggccatctgcctgggcaccatctactacgacgtgggcaccagctacacggccatccaggcgcgcgcctcctgcggcggcttcgtgtccggcttcatgaccttcatgtccatcggcggcttcccgtccttcatagaggagatgaaggtgttcaccctggagcgccagaatggccactacggggtcgccgcctacatcatctccaacttcctgtcctccatgccgttcctgctcaccgtgtcctgggccagcgcctccatcacctactggatggtcaagttccggccggggttcagctacttcgccttcttcgccctcaacctctacggcggcgtctccgtcatcgagagcctcatgatgatcatctctgccctcgtgccgaacttcctcatgggcctcatccttggcgccggcgtcattgggatcatgatgttgacatcaggattcttccggttgcttccggaacttcccaagatcttctggcggtacccggtgtcctacattgtgtatggctcatagggattgaagggagggtacaagaacgacctgatcgggctggagttcgagcccatgatgccggggcagccgaagctcaagggcgagtacatcatcaccgagatgatggggctgagcctggaccactccaagtggctggacctcgccatgatcttcgtcctcctcttcgcctaccgcctcaccttcttcatcgtgctcaaggtcaaggaggccgccgcgccgtacatccgcgtcgcctacacgcgcttcaccgtcaagcgcctggagcggcgcgcgtccttcaggaagacgctggccatgacctcgctgtccaagcggcacaaccagccgcaccccatggccagccaggaggggctcaactcgcccatgccgtactgatcgagctgaggaacacgaagagcagctgggagcggagctggtagcaaatggtagcatcaccggttacttgtggatgtgcttacagatatgtttgttccactgtttaggagttggagcgttcattcacaaagataatacccacgatacagtgttcaaagcattcgtttcactgtaataactctctgaacacgatacgcatacaagatagtgctgtgcctactcgtttttttgttttaccttatgttttgtaaacatttaattcgtgcaatgatcttggcgg

SEQ ID NO: 11074 - protein, 563 aa, Panicum virgatum
  misc_feature: Ceres CLONE 1726323
  misc_feature (58)..(248): Pfam Name: ABC_tran Pfam Description: ABC transporter
  misc_feature (362)..(563): Pfam Name: ABC2_membrane Pfam Description: ABC-2 type transporter
  misc_feature: SWISSPROT Homolog: EC 3.6.3.28 Phosphonate-transporting ATPase
MDSGSGEAWRGAVSPAARYAESGGASLTWENLTAVLPGGGGRATKKLVQGLYGYAVPGRVVAIMGPSGSGKSTLLDSLSGRLARNVVLTGKVLLNGKKRRLDYGVVAYVTQENILLGTLTVRETVTYSALLRLPSSMRKSEVRRIVDDTLDEMGLRECADRHIGTWHLRGISGGEKKRLSIALEILTRPRLLFLDEPTTGLDSAAAFSVVQTLRQLAVDGGRTIVSSVHQPSSEVFALFDDLCLLSSGECAYFGDAKLATQFFAETGFPCPSRRNPSDHFLRCVNSDFDDVAATMKGSMKLRAEAELDPLLNYSTSEIRERLVEKYRISDYALMVRNTIHEITKIEGVVEEVIRGSEASWFKQLRTLTSRSFTNMSRDLNYYWLRIIIYIVMAICLGTIYYDVGTSYTAIQARASCGGFVSGFMTFMSIGGFPSFIEEMKVFTLERQNGHYGVAAYIISNFLSSMPFLLTVSWASASITYWMVKFRPGFSYFAFFALNLYGGVSVIESLMMIISALVPNFLMGLILGAGVIGIMMLTSGFFRLLPELPKIFWRYPVSYIVYGS

SEQ ID NO: 11075 - DNA, 892 bp, Panicum virgatum
  misc_feature: Ceres CLONE 1726329
  misc_feature: Encodes the peptide sequence at SEQ ID NO. 11076
atcctaagaaaggacggagacactcgatcggttcgatcgatcactcgtgtgaacctgatcccagtggcagcctgctgcagagccctagctagctcgctcgctcgctcctggaggtggaagctagctagtagtcttgagcaagagaagctaagacgatggcctctgctaccctgctcaagtcctccttccttcccaagaagtccgaatggggcgccagcaggcaggtcgccgcgcccaggccggtcaccgtgtccatggtcgtcgtccgcgccagcgcctacgccgatgagctcgtcaagacggcgaaaacggtggcgtcgccggggcggggcatcctggccatggacgagtcgaacgcgacgtgcgggaagcggctggcgtccatcgggctggagaacacggaggcgaaccggcaggcgtaccggacgctgctggtgaccgcgccggggctcgggcagtacatctcgggcgccatcctcttcgaggagacgctgtaccagtcggccgtggacgggcgcaagatcgtggacatcctggcggagcagggcatcgtgcccgggatcaaggtcgacaagggcctcgtcccgctcgccggctccaacaacgagtcgtggtgccaggggctcgacggcctcgccgcccgcgaggccgcctactaccaggcgggcgcccgcttcgccaagtggcgcaccgtggtcagcatccccaacgggccctcgaagctcgccgtcaaggaggccgcgtggggcctggcccgctacgcggcaatctcgcaggacaacgggcttgtgccgatcgtggagcctgagatcctcctggacggcgagcacggcatcgagcggaccttcgaggtggcgcagaaggtgtgggccgagaccttctacgccatggc

SEQ ID NO: 11076 - protein, 245 aa, Panicum virgatum
  misc_feature: Ceres CLONE 1726329
  misc_feature (45)..(245): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
MASATLLKSSFLPKKSEWGASRQVAAPRPVTVSMVVVRASAYADELVKTAKTVASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLAAREAAYYQAGARFAKWRTVVSIPNGPSKLAVKEAAWGLARYAAISQDNGLVPIVEPEILLDGEHGIERTFEVAQKVWAETFYAM

SEQ ID NO: 11077 - DNA, 683 bp, Panicum virgatum
  misc_feature: Ceres CLONE 1726329-R
  misc_feature: Encodes the peptide sequence at SEQ ID NO. 11078
gggcagtcggaggtggaggcgacgcagaacctcaacgccatgaaccaggggcccaacccgtggcacgtgtccttctcctacgcgcgggcgctgcagaacacctgcctcaagacgtggggcggcgcgccggagaacgtcaaggcggcgcaggacgcgctgctgctgcgcgccaaggccaactccctcgcgcagctcggcaagtacacctccgacggcgagaccgccgaggccaaggagggaatgttcgtcaagaactacagctactaaataattaatatataatcgatcgccatggacgacgatatatatttatatatatacataatatacactacggattaaagcaaggtaagcgtattctcggtcgccatgatcgcgagagatgctgcatgcgtcactacttaattaattagctatgtatacatataatcatatgatgcatggctatcggagagagattatattgagaagttggccgtcgaggtggttacttaattaatcaattattatcaatgtgcctgaatcttgaatttatttctttcgggtttcatctctagcctatcccaacttgcttgggaaaaaatactatgttgtactgtgttctcctttttcctcactacttgtgtacgttgcccctctccctctgtacaatgaatggataatacacttttattttatgctgg

SEQ ID NO: 11078 - protein, 88 aa, Panicum virgatum
  misc_feature: Ceres CLONE 1726329-R
  misc_feature (1)..(88): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
GQSEVEATQNLNAMNQGPNPWHVSFSYARALQNTCLKTWGGAPENVKAAQDALLLRAKANSLAQLGKYTSDGETAEAKEGMFVKNYSY

SEQ ID NO: 11079 - DNA, 757 bp, Panicum virgatum
  misc_feature: Ceres CLONE 1726334-R
  misc_feature: Encodes the peptide sequence at SEQ ID NO. 11080
cggtgtggagtccttcccgttcaagcccggcaagtaccagatgaagaagttctgcctggagccgacgtccttcaccgtcaaggccgagggcatcgccaagaacgcgccgcccgagttccagaagaccaagctcatgacccgcctcacctacacgctcgacgagatcgagggcccgctcgaggtcggctccgacggcgccctcaagttcgaggagaaggacggcatcgactacgccgccgtcaccgtgcagctcccgggaggcgagcgcgtgcccttcctcttcaccgtcaagcagctcgtcgccaccggcaagcccgagagcttcggcgggcccttcctcgtgccgagctaccgtagctcttccttcctcgaccccaagggccgtggtggctccaccgggtacgacaacgccgtggcgctccccgccggaggcagaggagacgaggaggagctcgtgaaggagaacatcaagaacgccgcatcgtcgacgggcaacatcacattgagcgtgaccaagagcaatccggagaccggcgaggtcatcggcgtcttcgagagcgtgcagccgtcggacaccgacctcggggccaaggcgcccaaggatgtgaagatccaggggatctggtacgcgcagctcgaatcttagacgacgcgaccgtgatccatgggcaagtgtacgatggggaacttttgagagcaaaggaggcggcattgtgtacctactaatgcaaatatatattggctgtcgatttttatt

SEQ ID NO: 11080 - protein, 214 aa, Panicum virgatum
  misc_feature: Ceres CLONE 1726334-R
  misc_feature (1)..(213): Pfam Name: MSP Pfam Description: Manganese-stabilising protein / photosystem II polypeptide
GVESFPFKPGKYQMKKFCLEPTSFTVKAEGIAKNAPPEFQKTKLMTRLTYTLDEIEGPLEVGSDGALKFEEKDGIDYAAVTVQLPGGERVPFLFTVKQLVATGKPESFGGPFLVPSYRSSSFLDPKGRGGSTGYDNAVALPAGGRGDEEELVKENIKNAASSTGNITLSVTKSNPETGEVIGVFESVQPSDTDLGAKAPKDVKIQGIWYAQLES

SEQ ID NO: 11081 - DNA, 851 bp, Panicum virgatum
  misc_feature: Ceres CLONE 1726334
accgaggaggaggacctagcttgccattccacctagacctcacaacgccgatcgagcttgccaagcatcgtcgcgcgcgcgcgcacctcgcctctgccaccgctgctctcgcgacaaagcgggccatcagagaggtagctccaatggcgaccatagccacgatggccatgctcaagcccgccaagatcgttgcgcggtcggcgccgccgccgtccaccagcggcagcggcgtgtcgctgcgcagccttccggcggcggccaagaagaagggaggcctggccgcgtcggcgtcgtccccggccgcggcggcggtggcgggcgccttcttccaggcgctggcgtcgtcggacgcggcgctggcggcgcagcgggtggcggacgtggcggcggcggcggacgcgggcagcgacaaccgcggccagctgctgctcttcgtggtggcgcccgccatcgggtgggtgctctacaacatcctgcagccggcgctgaaccagctgaaccgcatgcgcagccaggcgctcgtcgccggcgctggcctcggcgcggccgccgccgcggggatggcgtgcgcgcccgaggcgtccgcggcgcaggagctcgccgcgctggccgccgccgccgcggcccccgccgacgacaaccggggcctcctcctgctcatcgtcgtcacgcccgccatcggctgggtgctcttcaacatcctccagccggcgctcaaccagctcaaccgcatgcggtccgactgagcgcgccgccgccgcgccatgcgccatgcgccatgcgttcgtgtattaattagtagtaacgtgaaccgtggtctgcgtgccttgtctttcgatctccaaaaacga

SEQ ID NO: 11082 - DNA, 1866 bp, Panicum virgatum
  misc_feature: Ceres CLONE 1726339
  misc_feature: Encodes the peptide sequence at SEQ ID NO. 11083
acgacagtcctccggctcggttgctccgccgctgctaggcgaccagtgatcccagtcatggccgccgccgccgccggcgaattccgcctgagccagcacgtgcacgccgccggagaccccctccgggtaggcacggtgcggtacctcggacccgtcgagggtcattccggagagtgggtcggcgtcgactgggacgatggcaccggggggcggcacgacggctcggtcgccggccgcagatacttcgtcgccgcgggggagcgctcggcctccttcgcgcgccccactgcgctcagcgaagggatctcgctcccggacgcgctccgcctccgctaccgcgtcgaggacttcaccaaggaggaacaggatgaaatgtatgtcttctcaacaagccagaagcgtgtgtcagttgaattcgttggccagaacaaggttcaggagaagctcaagaacttcaacgacctcaacagtgcatcagtctcctacatgggagtaagctcaattggaccaccagatgaactcaagagtttggttccaaacctcaggcttcttgatttaactgggaatctgttctcgcaatggcaagatatatcgactctttgtcaaactctggaatctctagaagttcttaatttgacaaacaataccatggagaatgatatcatagaaagtccaatgctatataatatccgtattttggttctcaacaactgtggagtaacatgggaactggttgaaaaatttaaagtctcatttacacgtctcaacgaactccatctgatgtcgaataagctgaagatgatcatgactccagatggaaaatttgtgcaaggtttcaatacattgcggctcttgaatttggaggacaataatattgattcatgggatgaaattgtgaaattatcttatttaaaatgtttggaacaactccatttgaacaaaaacaggatcaagcatgtaaagtatccatctaatcttccatcatatggacgtcttgatgatgcatctgctgtgccatttgaaaatctgcaagtccttttgttaggttctaatgagatcgaggacttttcttcagttgattctcttaacctcttcccaagtttgagggatgtcaggctttctgataatcctatagccgatcctgccaagggtggtgctcctcgattcgtgcttgttgctcggcttggcaaagttaaaatactaaatggcagtgaggtaagcccacgtgaacggagggaatcagaaatacgatatgttcgccttgttatgggaaaaatgcaatcaaatgaccaagaagagatcaaacggctgcaccctagatttgctgaactgaagacctttcatggtattgaagatgagaaaccaacttcaagcacatcaggcccccaaaagatgtcttcgggtcttataaatatcaccttgaaatgtgtggggccatctatgggtgaaaagcaaccattgacaaagaagctgcctcctacgacaaccgtcgggaagttgaaatcgttgtgcgagagcttctttaaactgaaggacatgagagtgaaactatttgacgaggagggatgccccctaccacaactcctggaggaggacacggcttctctgatggagcttgggatcggttcgggagcaagcatcgttgtggacgaagagagctagccggtcgtcatcagagcaggggagcccggcaactctaccacgcaaactacagttgttttaatgcatgagaagagaggactaggactacagtgctcttgattgtcctgtatattactctttatttatctctgtgagcaaatgtgcacttggtgaatcttgttgtgtatggatggacaaagcatcagcaattcagcgctgtattgt

SEQ ID NO: 11083 - protein, 534 aa, Panicum virgatum
  misc_feature: Ceres CLONE 1726339
  misc_feature (11)..(80): Pfam Name: CAP_GLY Pfam Description: CAP-Gly domain
  misc_feature: SWISSPROT Homolog: EC 3.1.3.16 Phosphoprotein phosphatase
MAAAAAGEFRLSQHVHAAGDPLRVGTVRYLGPVEGHSGEWVGVDWDDGTGGRHDGSVAGRRYFVAAGERSASFARPTALSEGISLPDALRLRYRVEDFTKEEQDEMYVFSTSQKRVSVEFVGQNKVQEKLKNFNDLNSASVSYMGVSSIGPPDELKSLVPNLRLLDLTGNLFSQWQDISTLCQTLESLEVLNLTNNTMENDIIESPMLYNIRILVLNNCGVTWELVEKFKVSFTRLNELHLMSNKLKMIMTPDGKFVQGFNTLRLLNLEDNNIDSWDEIVKLSYLKCLEQLHLNKNRIKHVKYPSNLPSYGRLDDASAVPFENLQVLLLGSNEIEDFSSVDSLNLFPSLRDVRLSDNPIADPAKGGAPRFVLVARLGKVKILNGSEVSPRERRESEIRYVRLVMGKMQSNDQEEIKRLHPRFAELKTFHGIEDEKPTSSTSGPQKMSSGLINITLKCVGPSMGEKQPLTKKLPPTTTVGKLKSLCESFFKLKDMRVKLFDEEGCPLPQLLEEDTASLMELGIGSGASIVVDEES

SEQ ID NO: 11084 - DNA, 882 bp, Panicum virgatum
  misc_feature: Ceres CLONE 1726340
  misc_feature: Encodes the peptide sequence at SEQ ID NO. 11085
aaggcacactcttctactcctctcctgctgcagtcccactcctacactccactcgcagcaagctctagccatggatcccaccaagttccggccgtcgagctcgcacgacggcggcgtgacgacgaccaacgccggcgctcctgtgtggaacgacaacgaggccctgacggtgggcccccgcgggcccatcctgctggaggactaccacctgatcgagaaggtggcccacttcgcccgcgagcgcatcccggagcgcgtcgtccacgcgcgcggcgcctccgccaagggcttcttcgagtgcacccacgacgtgtcggacctcacctgcgccgacttcctccgcggccccggcgcccgcacgccggtgatcgtgcgcttctccacggtgatccacgagcgcggcagcccggagacgatccgcgacccgcgcgggttcgccgtcaagttctacacccgggagggcaactgggacctgctgggcaacaacttccccgtcttcttcatccgcgacggcatcaagttccccgacgtgatccacgccttcaagcccaaccccaggtcgcacgtgcaggagtactggcgcgtcttcgacttcctctcgcaccacccggagagcctccacaccttcttcttcctcttcgacgacgtcggcgtgcccgccgactaccgccacatggagggcttcggcgtcaacacctacaccttcgtcaacaaagccggcaaggccagctacgtcaagttccactggaagcccacctgcggggtgcgctgcatcctcaccgacgaggaggcggcgctcgtcggggggcgcaaccacagccacgccacgcaggacctctacgactccatcgccgcgggcagcttcccggagtggcagctgct

SEQ ID NO: 11085 - protein, 270 aa, Panicum virgatum
  misc_feature: Ceres CLONE 1726340
  misc_feature (18)..(270): Pfam Name: Catalase Pfam Description: Catalase
  misc_feature: SWISSPROT Homolog: EC 1.11.1.6 Catalase
MDPTKFRPSSSHDGGVTTTNAGAPVWNDNEALTVGPRGPILLEDYHLIEKVAHFARERIPERVVHARGASAKGFFECTHDVSDLTCADFLRGPGARTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGVPADYRHMEGFGVNTYTFVNKAGKASYVKFHWKPTCGVRCILTDEEAALVGGRNHSHATQDLYDSIAAGSFPEWQL

SEQ ID NO: 11086 - DNA, 702 bp, Panicum virgatum
  misc_feature: Ceres CLONE 1726340-R
  misc_feature: Encodes the peptide sequence at SEQ ID NO. 11087
ggggatctactactcggacgacaagatgctgcagtgccgggtgttcgcgtacgccgacacgcagcgctaccggctggggcccaactacctgatgctgcccgtgaacgcgccgcggtgcgcgcaccacaacaaccactacgacggcgccatgaacttcatgcaccgggacgaggaggtggactactacccgtccaggcacgcgccgctgcggcaggcgccgccggtgccggtgccgccgaggccgctggcggggaggagggagaaggccaccatcatgaagcccaacgacttccagcagcccggggagaggtaccggtcctgggacgccgacaggcaggagcggttcgtcaggaggttcgccgactcgctggggcacccaaaggtcagccaggagctgagatcgatctggatcgacctgctctcgaagtgcgacgcgtcgctggggaagaagatcgccacccgcctcaacgtcaagccaagcatgtgaagatatatggagtccgtcctctcctctccttatccagcgagcaataacttaacacgagccagcggcaggacaccagagagagatagatagatgttgatcatcatcaggctgcatgcgtgtgtcagtcaagtttattcgttacatctgcatgctatatatattcctatgtatgtcacatatatatgtatatacatacgcatgtactactctactcc

SEQ ID NO: 11087 - protein, 161 aa, Panicum virgatum
  misc_feature: Ceres CLONE 1726340-R
  misc_feature: SWISSPROT Homolog: EC 1.11.1.6 Catalase
GIYYSDDKMLQCRVFAYADTQRYRLGPNYLMLPVNAPRCAHHNNHYDGAMNFMHRDEEVDYYPSRHAPLRQAPPVPVPPRPLAGRREKATIMKPNDFQQPGERYRSWDADRQERFVRRFADSLGHPKVSQELRSIWIDLLSKCDASLGKKIATRLNVKPSM

SEQ ID NO: 11088 - DNA, 606 bp, Panicum virgatum
  misc_feature: Ceres CLONE 1726345-R
  misc_feature: Encodes the peptide sequence at SEQ ID NO. 11089
cgacgccggcaagcataacacgctgctccgcctggccatcgacgacctcctggactcgctgaagcccaaggagagcctggtgatccggcagcggttcgggctcgacggccgggggaagcgcacgctcagcgagatcgccggcaacctcaacatctctcgggagatggtccgcaagtacgagctcaagaccctgatgaagctcaagcaccccacgcgggtggactacctgcgcaggtacatgtgagctcagcattcggaccgtgccaccaccatagcatcaggtgtagagcatgttctacaagaaaaatcagagtggttactctgctgtatataatttctacccctccgctactctgcactgcactgtgcacgctataggctacagaatccatccatcactacactgaagtgaaatctgtccgtcttgtaatagaagacgacatgtacatatacacttatacaggaacggtgtgtgggggagtcctgactcctgatgagaagtgagttcattcgagtgaggttgtattgcagacctcgcatgcaattcttatattgtactctatggatatggtacatgacgcaagaaactaagaaagtcgagcatcc

SEQ ID NO: 11089 - protein, 80 aa, Panicum virgatum
  misc_feature: Ceres CLONE 1726345-R
  misc_feature (16)..(69): Pfam Name: Sigma70_r4 Pfam Description: Sigma-70, region 4
DAGKHNTLLRLAIDDLLDSLKPKESLVIRQRFGLDGRGKRTLSEIAGNLNISREMVRKYELKTLMKLKHPTRVDYLRRYM

SEQ ID NO: 11090 - DNA, 635 bp, Panicum virgatum
  misc_feature: Ceres CLONE 1726345
attccgatccgtccacgccattgcatcgctcgcgcggccggcacggtccagctagcaacgacgacccgagctgagcgcctgtgcgccacaagaagcttctctactctacatcgaggcagcagctaggccggcgcgcaccatgacgtccaccgtgaccacgcccagccggccgctcgccgccgggtgccggcgcgcggccgggccgcggcggtccggccccgccgtgctctcgctcaagggccagcggcggcgggcgccgtccacgagctgctcggcggtcgcgtcgcccgagaagcggcgcgcggcggccaagctccccccgccgcagcggccgtcgagggccgcggcggcggcggagaaggaggaaggggagaggacggactacaacgaggtggcggccgcgctggagagcatctacaagctcagccccgccgtggtcgaggagaagcacggcgacgacgagggcaagaggaagaacaggaagaagaggaagggcggagtgggcaggaacacggtgatcgtgaggagccggcggaggaggcgcgggaggaggatggacctggggaagagggtggagatgaagagcagggagggcgacgccgggggggggcgggacgacgaggagggggagtgcg

SEQ ID NO: 11091 - DNA, 728 bp, Panicum virgatum
  misc_feature: Ceres CLONE 1726348-R
  misc_feature: Encodes the peptide sequence at SEQ ID NO. 11092
gccactggggcgggcatcaaagagcttgctctggtgagctgtgacgtggtgaacgggagcccgggttactgacatttctcagccaaagcatggggcgtcttcgtcgccttgacttgtcttacaatgagacactgagtgacaaggtgatcggtgccatgctgtcatcctgccggaatctcatcgacatcagactcagggggtgccggggcctaacaggggcctccttggtctcacttctcaggcactgtgggcagacgctggagatccttgacatctcccgctgtcctagcattgcagtaggcaatgtcgaattctttgttcagcgcgccactcggttgaatcatatgatcatcgaggagagtgcgatatcagaggaattaaaggcaattgctcagaagaaaggcatgaagatcggctcattattgccttatgaaggaccattctgaagtcaggtaaaacccttcagaatgcaactcatccgcacttgatttcggtgtgatgttactctaatgttggaataaggtgctgctggtttgcacttgcgtgcgcaactttataactgcagtggaatgtatataccatgtcttatttgttactacttgtagtattagttatcaccgtactcttgtcatgacaaaccttttggtgccttccatgtaaattgagggccaaaaatgtgccgttgtatatcttcaaacaattgccattgaaataataaaagaaatctc

SEQ ID NO: 11092 - protein, 118 aa, Panicum virgatum
  misc_feature: Ceres CLONE 1726348-R
  misc_feature: SWISSPROT Homolog: EC 1.14.11.27 [Histone H3]-lysine-36 demethylase
MGRLRRLDLSYNETLSDKVIGAMLSSCRNLIDIRLRGCRGLTGASLVSLLRHCGQTLEILDISRCPSIAVGNVEFFVQRATRLNHMIIEESAISEELKAIAQKKGMKIGSLLPYEGPF

SEQ ID NO: 11093 - DNA, 868 bp, Panicum virgatum
  misc_feature: Ceres CLONE 1726348
aatcttgcggccacaagcaaagcagagcaaagctaccactcatcattcccctccaccctcctcccgccccacccgcgcggccggcaaatccgatggcttgactggccccccagcgccccgacggcgcccacaagctcccgccacgccgccgccgtcctcggcggcggcggcggcggctgccggcgccttggctgctacgccggcacggacgccgcgctctgcgacgacctgctgcaggaggtgttccgcctcttgccgcccgccgccgcgccggccgtgtccctagtttcccggcgctggctctcgctccttaggacctccacatcgtccctgaccctccgcctgccggtctcctccgacgccgcggcggcggcgaccctcgccgcgctgctgtcgcactacccgttcctctccgccctgaccgtcgtctccgctgctactccggcccgggacgccgacgccgtgctgctcgctgtcgcggccgcgccggccgccgccaggttctccacgctccggctcttgcccgattcggcggtctccgccgccgcgctgctcgccgtctgccctgccctttccggcctgacgtcgctccacctcaccgccgtccgccccctgtcgttccgctggctcgagctcctgccgcgcctcaagtcgttcgccctcgtcaactccgccgccagcgttgactgcgctggctcaagctcggacgaggccgacggcggggaagccgaggccgaggccgcacgggcgctgcagctggaaaggctgtcgctttgcggcatccgctccaccgaccgagggcttggatggctgtggcggcggtgcgggagcctcaagtggctgcagctgcgcgcctgcgacggcactg

SEQ ID NO: 11094 - DNA, 2062 bp, Panicum virgatum
  misc_feature: Ceres CLONE 1726358
  misc_feature: Encodes the peptide sequence at SEQ ID NO. 11095
gtgttggtgcggcggcgcccggaacaaaacccttcccttctcccagatctcctcccactctccctcacactccaaaccctaacttcgcccagcccccaaccatggcgtcgatgatgcaaccgcagatcatcctgctcaaggagggcacggacacgtcgcaggggcgcgcgcaggtggtgagcaacatcaacgcgtgcacggcggtggcggacaccgtgcggaccacgctggggccccggggcatggacaagctcatccacgacgacaagggcggcgtcaccatctccaacgacggcgccaccatcatgcgcctcctcgacatcgtgcaccccgcggccaagatcctcgtcgacatcgccaagtcacaggactccgaggttggtgataggacaactactgtggtgcttctagctgcagagttcttgaaggaagcaaaaccttatgttgaggatggagtgcacccccacagtctaatccgcagctataggactgcgggcaatatggcaattcaaagggttaaagaactggcagttagcattgaagggaaaagcctggaagagaagaaatcattgctagccaagtgtgctgccacaacattgtcatcaaaacttataggcggtgaaaaggaattctttgcttctatggttgtggatgctgtccttgccattggcaatgatgacaggcttaatcttatcgggattaaaaaggttcctggaggtaccatgagagattctttcctggtgaatggtgttgcattcaagaagacattttcatatgctggatttgagcaacaaccaaagaagttcctaaatccaaagattcttttgttgaacattgaactagaattaaaatctgagaaggaaaatgcagagatcagattatcagatcccctacaataccaatcaattgttgatgctgaatggaacattatttatgacaaactggataaatgtgtaaaaagcggggcaaagatagttctatcccggctagctattggtgatcttgcaacacagtattttgcagatcgagacattttctgtgccggtcgtgttacagaagaggatttgcaacgtgtggctgcagcaaccggtggaatggttcaaacttctgtaaataatgtcatcgatgaggtacttggttcttgtgaggtatttgaagaaaaacaagtaggtaatgaaagattcaacatatttagtggctgcccttccgggcagacagcaaccattgtcctccgtggtggcgcagaccagttcatcgaggaagctgaacgaagtctccatgacgccatcatgattgtgaggagagctcttaagaactctacagttgtaccgggtggtggtgctattgatatggaaataagcaaatatctcaggcagcatgcacggaccattgctgggaagtctcagttctttgttaattcgtttgctaaagcccttgaggttatcccacgacaactttgtgataatgctggatttgacgcaactgatgtgcttaataagctcaggcagaagcatgcatctggtgaaggtgctaattatggtgtagacataaacactggcggaattactgattcctttgctaactttgtgtgggaacctgctgttgtaaagatcaatgctataaatgccgcaactgaagcttcgtgccttattctaagcgtcgacgaaactgtgaaaaacccaaagtcggagagtgcacaaggtgaggctgcagctggtgcaatggctggtcgtggtggaggggcaatgcgaggccgtggtgggaggggcatgcgcaggcggtaaaccgagtcactccaaccctgtagcttcatgttttaatcacctgtgggtcagatcttgtgccattctgcactcgtaacgtgtgttttcagacactgcgtgtgtaatgtttgttttagaagcagtggtagcccttttgtttcagagtagcagagatacgccaagcatttatcaggtatctgctgccgtgttgtgatatactagcaggtcggagccttcgatcgtttgtttgctccgaattttttgatgcaagaatgtagcctcttgttattcttcttgtc

SEQ ID NO: 11095 - protein, 560 aa, Panicum virgatum
  misc_feature: Ceres CLONE 1726358
  misc_feature (35)..(528): Pfam Name: Cpn60_TCP1 Pfam Description: TCP-1/cpn60 chaperonin family
  misc_feature: SWISSPROT Homolog: EC 2.7.1.68 1-phosphatidylinositol-4-phosphate 5-kinase
MASMMQPQIILLKEGTDTSQGRAQVVSNINACTAVADTVRTTLGPRGMDKLIHDDKGGVTISNDGATIMRLLDIVHPAAKILVDIAKSQDSEVGDRTTTVVLLAAEFLKEAKPYVEDGVHPHSLIRSYRTAGNMAIQRVKELAVSIEGKSLEEKKSLLAKCAATTLSSKLIGGEKEFFASMVVDAVLAIGNDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVTEEDLQRVAAATGGMVQTSVNNVIDEVLGSCEVFEEKQVGNERFNIFSGCPSGQTATIVLRGGADQFIEEAERSLHDAIMIVRRALKNSTVVPGGGAIDMEISKYLRQHARTIAGKSQFFVNSFAKALEVIPRQLCDNAGFDATDVLNKLRQKHASGEGANYGVDINTGGITDSFANFVWEPAVVKINAINAATEASCLILSVDETVKNPKSESAQGEAAAGAMAGRGGGAMRGRGGRGMRRR

SEQ ID NO: 11096 - DNA, 1605 bp, Panicum virgatum
  misc_feature: Ceres CLONE 1726359
  misc_feature: Encodes the peptide sequence at SEQ ID NO. 11097
agaactccgaatcgaatcaagctaggcattcgccagcaagcaagccgctagcatcaagctactagatcgcggcggggaagctcctcgcctcccctatcggcccgctccggcgggggagaagagtcctcccgctgcggccgggacgcccggttacttcgcgccgccagaccgggcggcggcttccgcggggaccgctccttagctcctggcgcggcggaggtcgtggcgtccggcgacatgagcagccacgcggccgggaccagcaacggcggatccggggatgcggccgccgcgggcgcggcccggaggaacacccggatgcccaagtactccaagttcacacagcaggagctgccagcttgtaagccaattcttactccaaaatgggttgtctcggtgttctttatcgtcggtgtcatctttattcccatcggtgttgtttcactgctagctgcacaagatgttgttgagatcattgatcggtacgatgaggcatatgtgccagtcaacatgactgataacaagcttgcttacatccagaatgaaaccatatccaaagaatgcataaggaatctaacggttacgaaggatatgaagcaaccaatatttgtgtactatgaactcgataacttctaccagaaccataggaggtacgtgaagagccgaaatgatgcacagctaagagataagcgtaaagctaaccagacatctgcttgtgaacctgagaagaccacggctaatggacaaccaattgttccttgtggtctcattgcttggagcttgtttaatgatacgtatagtttcactcgtggtaatgagaacttgacagtggacaagaaagatatttcctggaagagtgatagggagcacaaattcggcaaagatgtctttccaagcaacttccagaatggtgcacttaaaggtggggcaacacttaacgcatcgatcccgttgagcgagcaagaggacctcatcgtttggatgaggactgcagcacttcctactttcagaaagttgtatggaaggatatactttgacctcaaggagaatgacacgataacagtgaggctgagtaacaactacaatacatatagcttcggcggcaagaaaaagctggtcctatctactgcaacttggctcggagggaagaatgattttcttggctttgcataccttgtagttggttcgctctgcatgttcctggcattcgcattcaccttgctgtacgtcataaaaccaaggaaactgggagaccacaactacttgtcctggaacagacaccctgcaggccgctaggtgctaagatgctttggaaccccacagcacgtaaagtggtccaactactaggaaatgtaacttgtatgaaatgcaatacccaaaccagaaattgccgctgagcataagcaagtttttttaggctagaacttgatgtaaattgtttgcaaagggatctacgtgactacgttgttttctttcgttgtttcttgtgtacttagggctgcatgtagcagtgatcacgagaatacctattgatccctaatgccctgtttcgtggtatgcgtgctcaaaactattccctatgtattcatataccgtgtgatgttc

SEQ ID NO: 11097 - protein, 352 aa, Panicum virgatum
  misc_feature: Ceres CLONE 1726359
  misc_feature (69)..(341): Pfam Name: CDC50 Pfam Description: LEM3 (ligand-effect modulator 3) family / CDC50 family
  misc_feature: Useful for making plants with modulated nitrogen use efficiency
MSSHAAGTSNGGSGDAAAAGAARRNTRMPKYSKFTQQELPACKPILTPKWVVSVFFIVGVIFIPIGVVSLLAAQDVVEIIDRYDEAYVPVNMTDNKLAYIQNETISKECIRNLTVTKDMKQPIFVYYELDNFYQNHRRYVKSRNDAQLRDKRKANQTSACEPEKTTANGQPIVPCGLIAWSLFNDTYSFTRGNENLTVDKKDISWKSDREHKFGKDVFPSNFQNGALKGGATLNASIPLSEQEDLIVWMRTAALPTFRKLYGRIYFDLKENDTITVRLSNNYNTYSFGGKKKLVLSTATWLGGKNDFLGFAYLVVGSLCMFLAFAFTLLYVIKPRKLGDHNYLSWNRHPAGR

SEQ ID NO: 11098 - DNA, 725 bp, Panicum virgatum
  misc_feature: Ceres CLONE 1726367-R
  misc_feature: Encodes the peptide sequence at SEQ ID NO. 11099
cctccgcaacatccgcaacgggttcgccgtcatcggctccgacgccgcgctctacaacgacacggccaccgtcgacgtcgtcgactcctactccggcctgctcagcaacttcttcgggccatacttccggcaggacttcgccgacgccatggtgcgcatgggcagcatcggcgtcgtcaccggcggcgccggcgaggtcaggaaggtttgctccaagttcaactgaccggttgatcgatgctgcatgctgcaccatagatcctccgatccttcattcattgcgccagctggcccatccgtggacaacaagcacggtggggtttggttgggtgctttcatggcggtgtccttcaattcgttcatcactagtacgtacatcctatagatctcactgggggaaagaaacaaggaaactcgtcaagttgcttctgttgtatatgctcaccaaaatgaaaactgcacaagattcagaaaagcgatttgcttcgctttaaaatctgttcagatttcattttcaagtggcatatatggctacggaatatatgtagggtataagatagcttgttcttgtgtttatatacaaattaaattaatgtatatgttattagtgattttgtttttttcttctggggaattcattcgtcgttgtgttgactgtaaaaagtgtcgaattcttcattgcaagaggtgtcaaatattgtgatgatttctcctctgccttaatt

SEQ ID NO: 11099 - protein, 74 aa, Panicum virgatum
  misc_feature: Ceres CLONE 1726367-R
  misc_feature: SWISSPROT Homolog: EC 1.11.1.7 Peroxidase
  misc_feature: Useful for making plants with altered cell wall content and/or composition
LRNIRNGFAVIGSDAALYNDTATVDVVDSYSGLLSNFFGPYFRQDFADAMVRMGSIGVVTGGAGEVRKVCSKFN

SEQ ID NO: 11100 - DNA, 870 bp, Panicum virgatum
  misc_feature: Ceres CLONE 1726367
aacgacctctcctccgtcctcactcccactctcgacctgtcgacaatgccgataaggtgtagcagcagcgtcggtggcagcgtgccgggcttggccatggcggcggcggcgtcatcggctcgctggtagtagcggcagtgctcgccggcgtcgcggacggccagctcgcaggtggggttctactccagctcctgcccgggcgccgagtccaccgtcgcctccgtcgtccggcaggccggctccgccgaccccaccatcctgccggcgctcctccgcctccagttccacgactgcttcgtccgggggtgcgacgggtcggtcctcatcaagggcggcggcggcagcgccgaggtggacaacagcaagcaccagggcctccgcgggctcgagatcatcgagggcgccaagacccagctcgaggcccagtgccccggcgtcgtctcctgcgccgacatcgtcgccctcgccgcccgcgacgccgtcgcattcaccggcgggccgtcgttcgacgtgccgacggggcggcgcgacgggaaggtgtcgaacctgcgcgacgcggacgcgctgccggacgtgcacgacggcatcggcgcgctgcgctccaagttccgcgccaacgggctggacgaaaaggacctggtcctcctcacggcggcgcacacggtgggcacgacggcgtgcttcttcctgcaggaccggctgtacaacttcccgctccccggcggcggccggggcgccgacccgaccatcccgccggggttcctgtcggagctcaagtcccggtgcgcgccgggggacttcaacacgcgcctgccgctggaccgcggcagcggcggcgtcttcgacacctccatcctccgcacatccgca

SEQ ID NO: 11101 - DNA, 1864 bp, Panicum virgatum
  misc_feature: Ceres CLONE 1726381
  misc_feature: Encodes the peptide sequence at SEQ ID NO. 11102
agaaacacaagcaacctcccctctctcccccctgctccgttcgtccaccccctcccgccagcccgtcgcccgatttcacatggctcagcgtctccacggccaatccgacctcaccgacggcgattgcctccgtttctccgcttccaattccagctccagctccagctcttcctcccggttcctcctcgccgcccccgccgacgacggctccctctgtcgggcccgccgctgacctcttctccgctgcgtctgcgcccgacccccgggcggttctttggctcttttgcttcttggcccgccccagccttcgccatgggcaagaagagtaagaggagcaaaggaggccgaggaggaggtgatggtgccgatgaccagcttgacggcggcagcgatgccgacagcgtggcctcgatgtcgacggcgctgtccgaccttcagcttgcgcaggccaccgagcatgtcagctcccaggaattcgttcttgacaagtacatcgacgacctctacgagaagaggggatccaccagagagaaagcacttggtgctcttgttgatgcttttgaaagttttgtgcttcttggtttagtggaaaataagtatgtcacactactgagccagttcaccaattcaattaaaaagggatctacaaaggaggcgtgtctagcttgtcgtgccataggcttactgtcaattacactaggtgctggaagtagctcacacgaaataatggatgagtcggaaccacagcttttgagaatcctccaaacttggcccgatgcaccaaagatgatatctgcacttgattgcttagctgttatcacatttgttggtgcaactgatcttgctgaaacccagctatctatgagagccatctgggatgtgatccacccaaaatcaggatcaaatgttggcattatcagaaaaccgaagcctcctttattagcagctgctgtatctgcatgggcttttcttttgacaactgttggttcatctagaagaagtactgattcttggaaagagtcaattacatttctcactagtcttctagaaacagaggatcgtgttgtgcggattgctgctggtgaaacattagctctatgttttgagctaaaactgcttgatgtttccactagagaagaatctgatgttgatagtgacatcagagagaccagtggctctaagaaccaacttttcttgaatatgcaagcattgaaagccaaaatatctggtctggtctataatctctctatggaggctgggggcagaggtgctgacaagaaaaatcttaatgatcagagagacttgttccaacaaatctcatattttatcaagagtgatgagttccctgaagaatcacttaggatttcaggcaagaatggcattttaggagttacatcatggcgtgaatcaatacagttgaactatttgaggcggtttcttgggcgaggattcctgaagcatgcacaggacaatgatttgctgcatgatatatttgatatcaaaattgatcgtgttgaaaacatgtcaaccaccaaaaagaaaatgtttagatctgaggaagagaaaggaagagctctaaagttgaataaagaacgtcgtctcgcccaggagaggaagcaaaacatcttgaacgagcaatacgggtagaactagaacctttcctcctgcctggagttctgcatagtcgaactactaccagattgttgagtgttgtgtatggtattatgcattgattgagtgtattgctcagtattgtgataggtattacagtacaactgcatactgagaaacacttgtacagcgtgatatttgaaattgtttgttcgaaacactcagttttatagaaagtgttgcgttgactatc

SEQ ID NO: 11102 - protein, 444 aa, Panicum virgatum
  misc_feature: Ceres CLONE 1726381
  misc_feature (26)..(340): Pfam Name: IFRD Pfam Description: Interferon-related developmental regulator (IFRD)
MGKKSKRSKGGRGGGDGADDQLDGGSDADSVASMSTALSDLQLAQATEHVSSQEFVLDKYIDDLYEKRGSTREKALGALVDAFESFVLLGLVENKYVTLLSQFTNSIKKGSTKEACLACRAIGLLSITLGAGSSSHEIMDESEPQLLRILQTWPDAPKMISALDCLAVITFVGATDLAETQLSMRAIWDVIHPKSGSNVGIIRKPKPPLLAAAVSAWAFLLTTVGSSRRSTDSWKESITFLTSLLETEDRVVRIAAGETLALCFELKLLDVSTREESDVDSDIRETSGSKNQLFLNMQALKAKISGLVYNLSMEAGGRGADKKNLNDQRDLFQQISYFIKSDEFPEESLRISGKNGILGVTSWRESIQLNYLRRFLGRGFLKHAQDNDLLHDIFDIKIDRVENMSTTKKKMFRSEEEKGRALKLNKERRLAQERKQNILNEQYG

SEQ ID NO: 11103 - DNA, 802 bp, Panicum virgatum
  misc_feature: Ceres CLONE 1726384
  misc_feature: Encodes the peptide sequence at SEQ ID NO. 11104
aagccgagcaacgcagagaaaggcgtcttcgtactcgcctctctccgcgactcgaagctttccccccaacccccaacccaccgccgccgccccacccttccgtcgacaccatgagggagtgcatctcgatccacatcggtcaggccggtatccaggtcggaaacgcgtgctgggagctctactgcctcgagcatggcattcaggctgatggccagatgcctggtgacaagaccattggaggaggtgatgatgctttcaacaccttcttcagtgagactggcgctgggaagcacgtcccccgtgctgtatttgttgaccttgagcccactgtgattgatgaagtgaggactggcacttaccgccagctcttccaccctgagcagctcatcagtggcaaggaggatgctgccaacaacttcgcccgtggtcactacaccattggcaaggagattgttgacctgtgccttgaccgcatcaggaagcttgccgacaactgtactggtctccagggcttccttgtcttcaacgctgttggtggaggaacaggctctggtcttggttccctcctccttgagcgcctgtctgttgactatggcaagaagtccaagctcgggttcactgtgtacccatctccccaggtctccacttcagtggttgagccatacaacagtgtcctgtccacccattccctcctggagcacactgatgttgctatcctgctcgacaatgaggccatctatgacatctgccgtcgctccctcgacattgagcgcccaacctacactaacctcaacaggcttgt

SEQ ID NO: 11104 - protein, 230 aa, Panicum virgatum
  misc_feature: Ceres CLONE 1726384
  misc_feature (49)..(230): Pfam Name: Tubulin Pfam Description: Tubulin/FtsZ family, GTPase domain
  misc_feature: Useful for making plants with altered cell wall content and/or composition
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAILLDNEAIYDICRRSLDIERPTYTNLNRL

SEQ ID NO: 11105 - DNA, 677 bp, Panicum virgatum
  misc_feature: Ceres CLONE 1726384-R
  misc_feature: Encodes the peptide sequence at SEQ ID NO. 11106
cgccttcgagccttcctccatgatggccaagtgcgacccgcgccatggcaagtacatggcctgctgcctcatgtaccgtggtgatgtggtgcccaaggatgtgaatgctgccgtcgcaaccatcaagaccaagcgcaccatccagtttgttgactggtgccctactgggttcaagtgtggcatcaactaccagccacccagtgtggtgcccggcggtgacctcgccaaggtgcagcgtgctgtgtgcatgatctccaactccaccagtgtggttgaggtgttctcccgcattgaccacaagttcgacctcatgtacgccaagcgtgccttcgtgcactggtatgttggtgagggcatggaggagggtgagttctctgaggcccgtgaggaccttgctgcccttgagaaggactacgaggaggttggcgctgagttcgacgagggcgaggaaggcgatgagggtgatgagtactagatgatatgcttcctgctgctgtgtcaggcatgtgtgctgcagttatcctgtgatctgcccgaggggctcgtgcttatcctgttatgtgtgtcggtttgaacaatctgcttccgtgtgtcgtttacaacatcttgtgttgtaagacttggtttaatcctgcttcgtttctggattactataaatccttttatgtttcgtgtcc

SEQ ID NO: 11106 - protein, 157 aa, Panicum virgatum
  misc_feature: Ceres CLONE 1726384-R
  misc_feature (1)..(99): Pfam Name: Tubulin_C Pfam Description: Tubulin/FtsZ family, C-terminal domain
  misc_feature: Useful for making plants with altered cell wall content and/or composition
AFEPSSMMAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDEGEEGDEGDEY

SEQ ID NO: 11107 - DNA, 2118 bp, Panicum virgatum
  misc_feature: Ceres CLONE 1726390
  misc_feature: Encodes the peptide sequence at SEQ ID NO. 11108
acaagctcgctctgctctgctctgctccactccgcactcctccgcactggagtcgagttgagcgcacgctccccgcactcgcattcccaccgaccactagccttcgctaagcaaaccccctagatctccactccgcgccatggggtgcttccagtccaaggtggcggggcccctgccacccaacgacgccgccgcgctccccgccgacaacccggcagatcccgaggcggcgaacggcggcgcggatggcggcgacgccgacgacgacaaggaggcggtgaagcgcgcggtgcccgtgttccgggagttcgcgctggccgagctgcgcgccgccaccaagggattcagcgcagacctcatcgtctctgagagcggcgagaaggcgcccaacgtcgtctaccgcgggcgattcgacggcggccgcctcatcgccgtcaagcgcttctcgcgcctctcctggcccgacccgcagcagttcctcgcggaggcggcgggcgtggggaaggtgcgccacaagcgcctcgtcaaccttattggctgctgcgccgagggtgacgagaggctgctcgtcgccgagtacatgccaaacgacaccctctccaagcatctcttccactgggataagcagccattgccatgggaaatgcggttgagggtagcatatttcattgcgcaagcactcgaccattgcaatgcagagaaccggaagatctatcatgacttgaatgcatatagagtactttttgacgaggaaggtgatcctcgcttgtcaagttttggcctgatgaagaacagccgtgatggaaaaagttatagtaccaacttggcttacactccaccagagtttctacgaacaggcagagtaattcccgagagtgtgatatatagctatggaactgtcctgttggatcttttgagcgggaagcacatccctcctagtcatgcactagatttgataaggggaaagaatatactgttgctgatggattcctccttagaagggcagtatgctaatgaagatgcttcgaaattggtcgatcttgcatcaaagtgtctgcaatttgaagctagggatagaccaaacataaagtatctattgtcttctgttggtcctcttcagaagcaaaaggaggtagcatcacatgtcttgatgggtattacaaaagccgcatcagtattgccagctattctctctccacttgggaaggcctgctctgttatggatcttacagcagtgcatgatatattgcttaaaacaggttataaagatgatgagggtgcagaaaacgagttatcctttcaagaatggacccagcaagttcaagagatgctaaacacaaaaaagttcggtgacatagcatttagagacaaggattttaagactgcaattgattactactccaagctagttgcaatgatgtcagcaccttcagccacagtttttgctaggcgcagtttttcctacttgatgaatgagcaggcagaacttgccctccgggacgctatgcaggcccaggtctgcatgcctgagtggcctacagccttctatcttcaatcccttgctctgtcaaagcttggcatggaaactgatgcccaagacatgctcaatgatggagccacatttgaggctaagaagcaaaacagctggcgcagttagggatcaaagtcgctgcttccccataccattgccttccgtaacaaaaaggtacaatgggtgtcctccaaattgttcactgggacatctgttgaactgctaggagtgggattgaaatgcactgttttatcgtgcctcgtgcaatctcccccggagtggcgatgttgtggcctgtaagggaagataaaaggcagaagcatgcaatgcatattctctccctgatgagttagcgctttgtgttactgagtgatggcatgaggatctgctgatcgttgcaattgcagtgctctagagagaagattgctgtaattaaggtggggtgcttgctaacaatttcttcttctcctcgtttccattgaaatctttgggccccaggcgacatgagtggtgtgaaaaaaggcgggtacattgtgattagctaaggagaataaactagagccgtctgaattacattcatttcgacc

SEQ ID NO: 11108 - protein, 505 aa, Panicum virgatum
  misc_feature: Ceres CLONE 1726390
  misc_feature (85)..(323): Pfam Name: Pkinase Pfam Description: Protein kinase domain
  misc_feature: SWISSPROT Homolog: EC 2.7.11.1 Non-specific serine/threonine protein kinase
MGCFQSKVAGPLPPNDAAALPADNPADPEAANGGADGGDADDDKEAVKRAVPVFREFALAELRAATKGFSADLIVSESGEKAPNVVYRGRFDGGRLIAVKRFSRLSWPDPQQFLAEAAGVGKVRHKRLVNLIGCCAEGDERLLVAEYMPNDTLSKHLFHWDKQPLPWEMRLRVAYFIAQALDHCNAENRKIYHDLNAYRVLFDEEGDPRLSSFGLMKNSRDGKSYSTNLAYTPPEFLRTGRVIPESVIYSYGTVLLDLLSGKHIPPSHALDLIRGKNILLLMDSSLEGQYANEDASKLVDLASKCLQFEARDRPNIKYLLSSVGPLQKQKEVASHVLMGITKAASVLPAILSPLGKACSVMDLTAVHDILLKTGYKDDEGAENELSFQEWTQQVQEMLNTKKFGDIAFRDKDFKTAIDYYSKLVAMMSAPSATVFARRSFSYLMNEQAELALRDAMQAQVCMPEWPTAFYLQSLALSKLGMETDAQDMLNDGATFEAKKQNSWRS

SEQ ID NO: 11109 - DNA, 1506 bp, Panicum virgatum
  misc_feature: Ceres CLONE 1726400
  misc_feature: Encodes the peptide sequence at SEQ ID NO. 11110
atcattcatcagcgcaatcgatcgatcacacggctgcgaatcgcgagagagcttggcgaatacaatggcaatgcacgggatgaggaagaaggcctcgccgtcgccgtcgccgtcgccgtcgccgtcgtcggcggcggcggtggtcatggccctggtcctgtcgtcggcggtggcggcggtctgcggccagccgcagacggcggggaagcagacggcggcgaacaacccgcggctgcagcgggcgtacgtggcgctgcaggcgctgaagcgcgccatcacggaggaccccaagaacctgacgcgcgggtggtgcggccccgacgtgtgcgcctacttcggcgtgttctgcgcgccggcgccggatgacccgcacgcgctcaccgtcgccgggctggacctgaaccacggcgacctcgcgggcacgttcccggaggagctgggcctgctgtcggacctcgcgctgctgcacctcaactccaaccgcttcgccggcgggctgccggagtcgctgcccaagctgcacctcctccacgagctggacgtcagcaacaaccgcctctccggcgggttcccgcagcacatcctctgcctgcccaacgtcaagtacgtcgacctccggttcaacaacctgtgcgggcccgtgccgccggccatcttcgacaagccgctcgacgcgctcttcctcaacgacaaccacttcgaattcgagctgccggagaacctcggcaactcgccggcgtcggtcgtcgtgctcgccaacctgcgcctgcgcggctgcatcccgcagagcgtcggccgcatggccggcacgctcaacgagctcgtcatcctcaacgccggcctccgctcctgcatcccgcaggaggtcggctggctcctagagctcaccgtgctcgacctcagcttcaaccagctccagggcatgctgccggagtccatggccggcatgcacaagctcgagcagctcgacgtcgcgcacaacgagctctggggccacatcccggagggcatctgcgcgctgcccagcctccgcaacttcacctactcgtacaactacttctgcacggagccgcagcgctgcctcgacatccgccgcatcgacgaccgccagaactgcatcgccggccgccccgaccagcgccccggcgaccagtgcctcgccttcctccaccgcccgccgccgcgctgcgacgagcacggctgcttcggcccgccgcactactaggcggccagctcctcgatcgcgcgcgccgggtgggagggagagggagagagacagccggcgccgcccggccgcgccgccgcggccgcgacttgtaaaatccgttgcttggtggtgggatttgagtggagggtaaaattggtaaacagaaacgaccgtatatattatacactgtaatttttcctcttcttcttttctctttctttttcacaggagtggtattggagtatatgttggaactgtagagagacatgatagtgcattgattattacagtgttaattc

SEQ ID NO: 11110 - protein, 386 aa, Panicum virgatum
  misc_feature: Ceres CLONE 1726400
  misc_feature: SWISSPROT Homolog: EC 2.7.11.1 Non-specific serine/threonine protein kinase
MAMHGMRKKASPSPSPSPSPSSAAAVVMALVLSSAVAAVCGQPQTAGKQTAANNPRLQRAYVALQALKRAITEDPKNLTRGWCGPDVCAYFGVFCAPAPDDPHALTVAGLDLNHGDLAGTFPEELGLLSDLALLHLNSNRFAGGLPESLPKLHLLHELDVSNNRLSGGFPQHILCLPNVKYVDLRFNNLCGPVPPAIFDKPLDALFLNDNHFEFELPENLGNSPASVVVLANLRLRGCIPQSVGRMAGTLNELVILNAGLRSCIPQEVGWLLELTVLDLSFNQLQGMLPESMAGMHKLEQLDVAHNELWGHIPEGICALPSLRNFTYSYNYFCTEPQRCLDIRRIDDRQNCIAGRPDQRPGDQCLAFLHRPPPRCDEHGCFGPPHY

SEQ ID NO: 11111 - DNA, 2086 bp, Panicum virgatum
  misc_feature: Ceres CLONE 1726404
  misc_feature: Encodes the peptide sequence at SEQ ID NO. 11112
acctgaaagaaaacctccccgccgcctaagcaaaatcctccccttctctcggctcccgatctcgtcgtccttcgtcgccgccagcgaatccaccgggcgataggggggacgacgccgtctcgcgaccagagctttccgagatcgcccgcgctttctcttcttcccttttcgactctctttgattgaattgtctgctgcgtgtgccgatcttgaaaaaaaaatctatttgatttcctagttgaatcgttggtctcgctttggtttcttgttctttggtactagatagaatcgttgcggtagggtacccttgcgtgaatcctgtttctcgctcgtggtggtagtattagatcccttatactagctgcggtgtgctttgtgtttcctggttcgtgttgcttctggtgaaagatctagcccatggacgcaggatccaattccatctcgtcgcagaggagcggcagccggcgcgcggcgccaccgcggcctgtgctccaggaggccgggtcgaggccgtacatgccgccactcagctcggggccccgcaacccgtcggccaagtgctacggcgacagattcatcccggagcggtcggcgatggacatggacttggcgcactacctgctgacggagccgaggaagggcaaggagaacccggtggcggcgtcccctgccaaggaggcgtaccggaagctgctggccgagaagctgctcaacaaccgcaccaggatcctcgccttctggaacaagccgccggaacctgagaacatgctcacggatctccgttctgatgcggtccaagccaagccggcgaagcagcgccgacacattccccagtcttcagagaggactctggatgctccagacctcgttgacgattactacctcaacctgctagactggggaagcagcaatgtgctgtccattgcgctgggcagcacggtgtacctctgggatgcctctagtggatctacgtccgagcttgttaccgttgatgatgactatagtcctgtcacaagcgttagctgggctcctgatggccggcacattgccgtaggcctaaactcctctgatgtccagctttgggagaccacctcgaaccgactgctgaggacacttcgacgtgtgcacgaattgagggtcggttctctggcatggaacaacagcatcctgacaactggtggcatggacggcaagatcgtgaacaatgatgtgaggatcaggaacaatgttgtgcagacatatcatgggcatgagcaggaggtgtgtgggctcaaatggtcaggatcagggcagcaactggccagtggtggaaatgacaaccttctacacatctgggatgtgtccatgtcatcctctgtacagtctgctgggcgtacccaatggttgcacaggcttcaggatcacttggctgccgtgaaggcactggcatggtgcccattccagagcaacctgctggcttctggcggtggtgggggtgatcgctgcatcaagttctggaacacccacactggtgcatgcctcaactctgttgacactggatcgcaagtgtgcgcgctgctctggaacaagaatgagagggagctgctgagctcacacgggttcactcagaatcagctcaccttgtggaagtacccgtcgatggttaagatggccgaactcaatggccatacctcccgcgtcctgttcatggctcagagccctgatggatgcactgtggcatctgctgcagcagatgagacattgaggttctggaatgtgtttggaactcctgaagcggcgcctaaggctgcagccaaggcttcccacactgggatcttcaacagtttcaaccacatccgatgaagaaatgacattattgttctaaagaagaccttccagagactccagacctgttgataggaatgtgccctttaatataccaccaaaacaccatcgagctgatgttccacaaaagagatcatcatacactatagcaataatcttgtgttgacatgtgtacatctgttgactatttcgggttactagcgttgtaatcagatttacattacatttctctttggtatgctggtaacgctggttgctggtc

SEQ ID NO: 11112 - protein, 474 aa, Panicum virgatum
  misc_feature: Ceres CLONE 1726404
  misc_feature (269)..(307): Pfam Name: WD40 Pfam Description: WD domain, G-beta repeat
  misc_feature (408)..(446): Pfam Name: WD40 Pfam Description: WD domain, G-beta repeat
  misc_feature: SWISSPROT Homolog: EC 2.3.1.48 Histone acetyltransferase
  misc_feature: Useful for making plants with modulated biomass
MDAGSNSISSQRSGSRRAAPPRPVLQEAGSRPYMPPLSSGPRNPSAKCYGDRFIPERSAMDMDLAHYLLTEPRKGKENPVAASPAKEAYRKLLAEKLLNNRTRILAFWNKPPEPENMLTDLRSDAVQAKPAKQRRHIPQSSERTLDAPDLVDDYYLNLLDWGSSNVLSIALGSTVYLWDASSGSTSELVTVDDDYSPVTSVSWAPDGRHIAVGLNSSDVQLWETTSNRLLRTLRRVHELRVGSLAWNNSILTTGGMDGKIVNNDVRIRNNVVQTYHGHEQEVCGLKWSGSGQQLASGGNDNLLHIWDVSMSSSVQSAGRTQWLHRLQDHLAAVKALAWCPFQSNLLASGGGGGDRCIKFWNTHTGACLNSVDTGSQVCALLWNKNERELLSSHGFTQNQLTLWKYPSMVKMAELNGHTSRVLFMAQSPDGCTVASAAADETLRFWNVFGTPEAAPKAAAKASHTGIFNSFNHIR

SEQ ID NO: 11113 - DNA, 1940 bp, Panicum virgatum
  misc_feature: Ceres CLONE 1726405
  misc_feature: Encodes the peptide sequence at SEQ ID NO. 11114
aatccagcagcctcactcctctctctttctcccagtcccgagccgccgctcctcatggcgattcagtcggcagctagcgcgcagctgcccgcgcagcccacccagctccagcaccccgcgttcgagcagcagcagcaccaccacgcgcacgcggaggtggacgtcccccacgcgcccccgcctgcgccggccgaggtggcggcgtccaccacggcgtgggtggacggcatcatccgcgacatcatcggcatcagcggcggcgccggggtctccatcacgcagctcatccacaacgtccgcgagatcatccacccctgcaaccccggcctcgcctccctcctcgagccccgcctccgctccctcctcaacgccgaccccgccccgccgccgctcccgcatcctcccgccctcctgcacggcagcaccccgcccgccgccgccccaacagtgccccccgctctccctccccctcccccgcttccggttccagacaagcgccgccacgagccgcagcaggaggagccgaacccgtcgccgcagtcgcccaaggctccgacggcggaggagaccgccgcggcagccgccgccgcggctgccggggccgccaaggagcggaaggaagagcagcggcggaagcagcgcgacgaggagggcctccacctgctgacgctgctgctgcagtgcgccgagtcggtgaacgcggacaacctcgacgacgcgcacctgacgctgctggagatcgcggagctcgccacgcccttcggcacctccacgcagcgcgtcgccgcctacttcgcggaggccatgtccgcgcgcctcgtcagctcgtgcctcggcctgtacgcgccgctaccggcggcgtcccccgcggcggcgcgcctgcacggccgcgtcgccgccgcgttccaggtgttcaacggcatcagccccctggtgaagttctcgcacttcacggcgaaccaggccatccaggaggcattcgagcgggaggagcgcgtccacatcatagacctcgacatcatgcaggggctgcactggccgggcctcttccacatcctcgcctcccgccccggcggcccgcccagggtcaggctcaccggcctcggcgcgtccatggaggcgctcgaggccacgggggagcgcctctccgacttcgccgacacgctcggcctgccattcgagttctgcgccgtcgcggagaaggccggcaatgtcgacccggagaagctgggcgtcacgcggcgcgaggccgtcgccgtccactggctccaccactcgctctacgacgtcaccggcaacgactccaacacgctctggctcatccaaaggctggcccccaaggtggtgacaatggtggagcaggacctcagccactcgggctccctcctggcgtgcttcgtggaggccatccactactactcggcgctgttcgactcgctggacgcgagctacggcaaggacagcccggagcggcacgtcgtggagcagcagctcctatcgagggagatctgcaacgtgctcgccgtgggcgggctggcgcgcaccggcgacgtcaagttcgggagctggcgcgagaagctcgcacagtcggggttccactcggtgtcgctcgcctgcagcgcggcggcgcaggcgtcgctgctgctcagcatgttcccctccttcgggtacacgctcgtcgaggagaatggtgctctcaagcttgagtggaaggatctttgcctgctcactgcatctgcttggcgcccgattcagaccccatgccgttaaatttgagagcaaatttacagagctaaagaattactattcctactggatcttacatggggttcttgcccagatcttttacctgtttagctagctgctcaatttaatcggttcagagattgggaaaattgaaacatttctgatcactagttgctagatctcttcacaatgat

SEQ ID NO: 11114 - protein, 571 aa, Panicum virgatum
  misc_feature: Ceres CLONE 1726405
  misc_feature (177)..(474): Pfam Name: GRAS Pfam Description: GRAS family transcription factor
  misc_feature: The sequence is a functional homolog of SEQ ID NO 431 in the 11/479,226 US patent application
  misc_feature: The sequence is a functional homolog of SEQ ID NO 438 in the 11/435,388 US patent application
MAIQSAASAQLPAQPTQLQHPAFEQQQHHHAHAEVDVPHAPPPAPAEVAASTTAWVDGIIRDIIGISGGAGVSITQLIHNVREIIHPCNPGLASLLEPRLRSLLNADPAPPPLPHPPALLHGSTPPAAAPTVPPALPPPPPLPVPDKRRHEPQQEEPNPSPQSPKAPTAEETAAAAAAAAAGAAKERKEEQRRKQRDEEGLHLLTLLLQCAESVNADNLDDAHLTLLEIAELATPFGTSTQRVAAYFAEAMSARLVSSCLGLYAPLPAASPAAARLHGRVAAAFQVFNGISPLVKFSHFTANQAIQEAFEREERVHIIDLDIMQGLHWPGLFHILASRPGGPPRVRLTGLGASMEALEATGERLSDFADTLGLPFEFCAVAEKAGNVDPEKLGVTRREAVAVHWLHHSLYDVTGNDSNTLWLIQRLAPKVVTMVEQDLSHSGSLLACFVEAIHYYSALFDSLDASYGKDSPERHVVEQQLLSREICNVLAVGGLARTGDVKFGSWREKLAQSGFHSVSLACSAAAQASLLLSMFPSFGYTLVEENGALKLEWKDLCLLTASAWRPIQTPCR

SEQ ID NO: 11115 - DNA, 2102 bp, Panicum virgatum
  misc_feature: Ceres CLONE 1726406
  misc_feature: Encodes the peptide sequence at SEQ ID NO. 11116
agcaaccaaacggaccctttcttcctgtgcctagcagggccaaccaaaatactaggcctggatactggatagggtgctcaactgtggcaggcagctcgggttcggccccagttctcttctatccctgttcctgctatccttcactctccccccattcggccttcgtctgccattactgcaaggcaggagctgcgtctgtatgggtctgcagatgatacaaggcaggccctgctcctcgtgctgtccatcgtcctcgtcgtcttcctcctcgtggatgatggcgacccatcccccgaaacagtctccccatccattagggggaaggccaatttcttctgaatcccttgcagcactggccttgcatctcgtgctaaaacgccgcaaataccatggcctggacattgcgaccgcttttgcatcttcatccagtgtgcttcagatcacagagaataagtcaagcagcttgacgaaacccaaggcagaaaggaaggtccttgatgactctcttgacagaaatttacagtatgactggatggatgaagagacgttattctggctggacaggaattacacaaatagcaatctacagtatggcttgttaatggaaaatcttcaggcattggagactagttttagtttggctggcaaagacttgaaaatgctggaaaaggatatccttgtacatattgaacatcttggagctctgggatcgtttaacacgtctatgtccagggccaccctagacaccctaacacagatctcacatgaaccagatttctctctgcttgacaaagtcatcaagtttgacccagagactcctctgaaggagcaagatgctgaagtaatcgttcggagtggcaagcgtcaagagaggaaacagaaaagaatgagagcatcagaaaaggcctccaggatatctgtgaaggtaaatccaagaagatcgaagaaatcacgcaagtctagtagcagtcagtttatatccgagtggaaaaattatccgggccgaagaaggaccattgtacgtgaacaatcatcattgttagttaccatcaaggaatgtgcgaaccttgagaagatcagagaggacatgataaaggaggggcaggaggtgagctatcagaggtgggcagaggcagctggacttgatgaggcagagctgaagagcaggctgcattcgggttactgctgccgagagaggttgatagtgaccaccgagtggctcgtccggtacattgcaagaacatacaccggaatggggacggctttcgacgatctacttcaggctgggaagatgggcgtccttgatggtgccgagaagttcgacagccggaaggggtgcaagttctccacatacgtcaagtactggatcaggaaagggatgctagctctgctcgccgaaaattcaggagtcaccctgctgccggcaagaatggagtgcatcatccgcaaggtgaaggaggcgcggcgcgcgatccggtacagccaagggaggaacccttcggattcagagatcgccgccgtggtcggcgtgtccgtggccaacgtcaggctggcgcgcaagtgctctcacaaggtcctctcactctactcggagatcgggatcggtcagaatgcaaagttcacggaggtgatcccggacccatctctggaggctgccgacgaggccatcttccaggcgcagctgagggagaggctgctggtggtgctggacaggctgccggcgcgggaagggcacgtgctgaagctgcggcacgggctggaggacggcaggtgcatgtcgctggagcagatcggccgcatctaccgcgtgtccaaggagtggatcaggaagatcgagaagtcggcgatggccaagctcaggaaccaggacgtgcaacgcgagctcgacgacttctgcagcttctagatgcttccgtgtgagctataagctgtgcacggtagcatgtacagtttaatttccaggcaattcacgctaccagattgaagctgtatatatcacacttctttttttatttttttgattgaggcgacacatacacaccctcagtattcattgtactagcataagcagcttcctggatatatcacacttaatactacag

SEQ ID NO: 11116 - protein, 542 aa, Panicum virgatum
  misc_feature: Ceres CLONE 1726406
  misc_feature (476)..(529): Pfam Name: Sigma70_r4 Pfam Description: Sigma-70, region 4
  misc_feature (382)..(464): Pfam Name: Sigma70_r3 Pfam Description: Sigma-70 region 3
  misc_feature (308)..(378): Pfam Name: Sigma70_r2 Pfam Description: Sigma-70 region 2
MATHPPKQSPHPLGGRPISSESLAALALHLVLKRRKYHGLDIATAFASSSSVLQITENKSSSLTKPKAERKVLDDSLDRNLQYDWMDEETLFWLDRNYTNSNLQYGLLMENLQALETSFSLAGKDLKMLEKDILVHIEHLGALGSFNTSMSRATLDTLTQISHEPDFSLLDKVIKFDPETPLKEQDAEVIVRSGKRQERKQKRMRASEKASRISVKVNPRRSKKSRKSSSSQFISEWKNYPGRRRTIVREQSSLLVTIKECANLEKIREDMIKEGQEVSYQRWAEAAGLDEAELKSRLHSGYCCRERLIVTTEWLVRYIARTYTGMGTAFDDLLQAGKMGVLDGAEKFDSRKGCKFSTYVKYWIRKGMLALLAENSGVTLLPARMECIIRKVKEARRAIRYSQGRNPSDSEIAAVVGVSVANVRLARKCSHKVLSLYSEIGIGQNAKFTEVIPDPSLEAADEAIFQAQLRERLLVVLDRLPAREGHVLKLRHGLEDGRCMSLEQIGRIYRVSKEWIRKIEKSAMAKLRNQDVQRELDDFCSF

SEQ ID NO: 11117 - DNA, 502 bp, Panicum virgatum
  misc_feature: Ceres CLONE 1726408
  misc_feature: Encodes the peptide sequence at SEQ ID NO. 11118
aaccatacttaagcagctaaaaacctctagcctgatagcaaaaaatggctctggatgcttctcccctgatgagtcacgctgcgcatcgtcctggcctaataagccacatacgactctgtggtggcaatttgtcatggctcgagaagagtaagacaaggtgtgaccttataaatgttcatcactagcctggagcgcccagccggtacaatatttaacaccttcggaaatcccacggatgcactgattcactcacaagttcgtctttggctccgcctcttcaggataccaaattgaaggtgcttggactgagcctggcaaggggccatacacttgggactacttctgccacacttaccccgacaggataattgatggaaccactgccgatgttgcagtcaactcctaccatatgtatgaagaggatgtcaagttgctgaagcacatgggcgtggacgcctatacgttctcaatctctagatcgacaatactgcgtcaggagacg

SEQ ID NO: 11118 - protein, 30 aa, Panicum virgatum
  misc_feature: Ceres CLONE 1726408
  misc_feature: Useful for making plants with altered cell wall content and/or composition
  misc_feature: Useful for making plants with altered carbohydrate content
MYEEDVKLLKHMGVDAYTFSISRSTILRQE

SEQ ID NO: 11119 - DNA, 730 bp, Panicum virgatum
  misc_feature: Ceres CLONE 1726408-R
gcgcagcggtcgggctgaacgggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggaggacaatttcacacaggaaacagctatgaccatgattacgccaagcgcgctcactggccgtcgttacaa

SEQ ID NO: 11120 - DNA, 874 bp, Panicum virgatum
  misc_feature: Ceres CLONE 1726410
  misc_feature: Encodes the peptide sequence at SEQ ID NO. 11121
ctcctcaaagtcccaggctccctcccccaactccctctccttgctcgcttgctcgctctccatggacgctccaggaagctgcacgcctcctgcacgctaagtgcgtgatcagagaagctgctgccaagctttaccagttgaccctgaaccaaacaggagctacctgctagctccgggtaccagcagcagctagcgagcgagcaggtgtactactagctagctagctaagtgagctagctcgttagctgcgcgtagcttgattggttggctagcggtgtagcggtggtagtagcgttaggtagctggtaacttttttgggcatggagagcacgccggtgctggtgaggcacgccggcggcgtggcggcgctgcggcagctgccgccggggttccggttccgccccacggacgaggagctggtggtgcagtacctccgccgcaaggccttgggcgtgccgctccccgccgccgtcatccccgtcgtccgcgacctctacagcctcgacccctgggacatccctgccgccgctgatgcgagcgagggggagaagtacttcttcgcggtccggccggcgggcgtcggcggcggatgcagcggcaagctgggcggcgctaggacggcgaccgcgagcgggcggtggaagccggcggggaaggagaagccggtggtcctgccccggccctgcggcggcgggagcctcctcgtcggcgtgaagcgggcgatgacgttcgcgccccggcggaagaagaaggcgtcgtcggctgccctggccgccggctgggtcatgcacgagtaccgcctcgccgcgccgctgcacaagaacttcacggccaggacggtcttctcgtggcagagctgggtgaccttcgtctc

SEQ ID NO: 11121 - protein, 184 aa, Panicum virgatum
  misc_feature: Ceres CLONE 1726410
  misc_feature (20)..(162): Pfam Name: NAM Pfam Description: No apical meristem (NAM) protein
MESTPVLVRHAGGVAALRQLPPGFRFRPTDEELVVQYLRRKALGVPLPAAVIPVVRDLYSLDPWDIPAAADASEGEKYFFAVRPAGVGGGCSGKLGGARTATASGRWKPAGKEKPVVLPRPCGGGSLLVGVKRAMTFAPRRKKKASSAALAAGWVMHEYRLAAPLHKNFTARTVFSWQSWVTFV

SEQ ID NO: 11122 - DNA, 615 bp, Panicum virgatum
  misc_feature: Ceres CLONE 1726410-R
tccagaggagcagcaacagcaacaggccgaaacggcgagcgacgcctgccggcggccacgccgccgccgcgtcgccgtcgtcgtcgtcgaccgccagctgcgtcacggacggctcggaccaggaggaggtcagcagctagctacctcgcggccggccggccacaagaaccacaaggtctgcacagctgctgctagctgtacgtgcctctcgaagagaggcttggatcggagctgagttagcctatagccttaggcttaaaccaggaaacgaaaacgacctgccgcccttgcttaattttcttgattgctccaacaatttcttgtcactttagttccttctctgtatctctctctttccctccctttgtataatgtaatgcagtgtaatctagtgagaggaagcaggcagtaccggatcattaacaaacaagttaaacaggttcaggaagcttctagttgaggttttcagaagccagatgtgtcgtatctcgtaggaaactatgcatggagtacatgtatactatgcatgtagcagctgcagaagtggcctctgcatgtggccaatttgtaactcgcaagttaattttttatttttttaatacgatttttttaccg

SEQ ID NO: 11123 - DNA, 944 bp, Panicum virgatum
  misc_feature: Ceres CLONE 1726411
  misc_feature: Encodes the peptide sequence at SEQ ID NO. 11124
agtgcgtggttcccagcaggtcgccacctctcggagagagagagacagagagagagggaccaataagcaggagggtctaggcgtctagctagctgagccatggccaaggctcacgttctggtgctgccgatgccgtgccagggccacgtcacgccgctcatggagctctcccaccgcctggtcgaccacggcatcgaggtcaccttcgtcaacaccgaggtggaccacgcgatggtggtcaccgcgctgcgggcgtccggcggcgaggcggcgctgggcggcggcatccgcctggcgtccatcccggatgggctggccggcgacgaggaccgcaaggacctcaacaagctcatcgacgcctacacgcgccacatgccgggccacctggagcggctcatcgccgacctggaggccgccgggcggcccagggtcaagtggctcgtcggcgacgtcaacatgggctggtccttcgaggtcgccaggaagttcggcatccgggtcgtgtccttctggccggcggccacggcgtgcctcgccatcatgctcaagatccccgagctgatcgaggacggactcatcgacgacaagggcttgccacggcggcaggagatgttccagctcgccccggggatgccggcgctgcacacgtcgcagctgtcgtggaacaacgccggcgcgccggagggccagcacatcatcttcgacctggtcacccggaacaacaaactcaacgacctcgccgatatgacggtgggcaactccttccacgaggccgaggccggcgcgttcaagctcttccccggcatcctgcccatcgggccgctgttcgccgacggggagctccggaagcccgtcggcagcttcctgccggaggacgagcggtgcgtcaagtggctcgacgcgcagccgaacggttccgtcgtgtacgtgggcttcggcagcat

SEQ ID NO: 11124 - protein, 281 aa, Panicum virgatum
  misc_feature: Ceres CLONE 1726411
  misc_feature: SWISSPROT Homolog: EC 2.4.1.218 Hydroquinone glucosyltransferase
  misc_feature: Useful for making plants with altered carbohydrate content
MAKAHVLVLPMPCQGHVTPLMELSHRLVDHGIEVTFVNTEVDHAMVVTALRASGGEAALGGGIRLASIPDGLAGDEDRKDLNKLIDAYTRHMPGHLERLIADLEAAGRPRVKWLVGDVNMGWSFEVARKFGIRVVSFWPAATACLAIMLKIPELIEDGLIDDKGLPRRQEMFQLAPGMPALHTSQLSWNNAGAPEGQHIIFDLVTRNNKLNDLADMTVGNSFHEAEAGAFKLFPGILPIGPLFADGELRKPVGSFLPEDERCVKWLDAQPNGSVVYVGFGS

SEQ ID NO: 11125 - DNA, 699 bp, Panicum virgatum
  misc_feature: Ceres CLONE 1726411-R
  misc_feature: Encodes the peptide sequence at SEQ ID NO. 11126
ggggggggggggcgggacttcacccccggcctcaccaaggggtggctcgccgagttccaccagtgggtcgccggcagaggcatgttcgtcagctggtgctcccagcagcaggtcctggcgcaccgcgcaggggggtgcttcgtatcacactgcgggtggaactcgactatggagggattgcggaacggggtgccgttcctgtgctggccctacttctgcgaccagtacctgaaccgaagctacatcaccggcgtgtggaggaccggcctggcggcgtcccccaacgcggagggggtcgtgaccaaggaggagctgaggagcaaggtggagcaggtcgtcggcgacggcgagatcagggagagggcgcggctgttcagggacgcggctcgccggtgcgtcggcgaaggggggtcctcgcacgagaactttaaaaagcttgtggacctgctacgcgagtgagtagttggcctgggaaccccagcctgatctacagtcctatgatgtgttcctggtgttctattgtgtttgggcagtccccaatttgtgcaagagttcatagaaaacggctgcactatgggattacgaacagatcaattgcattatccgactaattaatcagtgtagctcatgtattcaacctgataagagcagggctaatagattttgcccgcggggggggggggagagcagcgccatgtc

SEQ ID NO: 11126 - protein, 152 aa, Panicum virgatum
  misc_feature: Ceres CLONE 1726411-R
  misc_feature: SWISSPROT Homolog: EC 2.4.1.195 N-hydroxythioamide S-beta-glucosyltransferase
  misc_feature: Useful for making plants with altered carbohydrate content
GGGGRDFTPGLTKGWLAEFHQWVAGRGMFVSWCSQQQVLAHRAGGCFVSHCGWNSTMEGLRNGVPFLCWPYFCDQYLNRSYITGVWRTGLAASPNAEGVVTKEELRSKVEQVVGDGEIRERARLFRDAARRCVGEGGSSHENFKKLVDLLRE

SEQ ID NO: 11127 - DNA, 898 bp, Panicum virgatum
  misc_feature: Ceres CLONE 1726416
  misc_feature: Encodes the peptide sequence at SEQ ID NO. 11128
accagccgccgccatgtcgaagcgagggagaggaggctcggcggggaacaagttccgcatgtcgctgggtctgccggtggcggcgacggtgaactgcgctgacaacactggcgccaagaacctctacatcatctccgtcaagggcatcaaggggcggctcaaccgtctcccgtccgcctgcgtcggcgacatggtcatggccaccgtgaagaaggggaagcccgacctcaggaagaaggtcatgcccgccgtcatcgtccgccagcgcaagccgtggcgccgcaaggacggtgtctacatgtacttcgaaggtagcatcccgttctcacctcatccgtaattgcttagaatcaagggtcgtcgttgagcttagaccagtgttcaactcacttgtcataattctgccaatacatgcctagtatctagtttagagctgaaattattttcttttgacgggagggccgcgaggctccctagctttttctggagcagaagtcatagtatctgcacattccaaagcaaacgtcatagattaagccttcggacgttgaggatttccaatgaaaggctactctttcatggagataatccgttagagggcggcctcatattccattgccttgtttagcggcgttgctggcatgaaaatttgggactggccatgaggcgcatattttactcatactacctttagtgcttaagagtcatgtgttgtatgctgttattcatttgctcgtcaatatctttttggtggcagttgctgcttcatagttgttttttatgttggaaattgagactgttaagtttgacggatggacgtccaggtccttcagctttattgtggagcaaacagcacatgttcgcatattcccaagcaacgtcataaatgagccttttg

SEQ ID NO: 11128 - protein, 108 aa, Panicum virgatum
  misc_feature: Ceres CLONE 1726416
  misc_feature (19)..(107): Pfam Name: Ribosomal_L14 Pfam Description: Ribosomal protein L14p/L23e
  misc_feature: Useful for making plants with modulated biomass
  misc_feature: Useful for making plants with modulated heat sensitivity
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVYMYFEGSIPFSPHP

SEQ ID NO: 11129 - DNA, 2482 bp, Panicum virgatum
  misc_feature: Ceres CLONE 1726419
  misc_feature: Encodes the peptide sequence at SEQ ID NO. 11130
cgcgcatgcactagagagagagagagagagcgagcgaggaggcggtggcgggatcatcatcgacgatgcagcacctggtgcaggtggaggaggggagggaggcggcggacggggcgccctcggcggggccgacgtaccggtgcgccgcggggggcaagggcggcgcgacgcccgccgtgccggggctcgactgctgctgggacatattccgtttgtccgtcgagaagtgccccgacaacaagatgctcggccgccgcgaaattgtcgacgggaaggctggcaactacacgtggctgacctacaaggaggtttacgacaccgtgatcaaggtcggggctgcgatccggagctgtggcgtcggcaaggtgcagacgtttgctctgattattgctctgcggccttccataccgagaagctggaactgttcctcgtttgttccatacttccattattctctgtaagtttgtgttgatgggctgttgagatgacccatgcctgattgtctgtagggtggccggtgcggcatctatggggccaattcgcctgagtgggttatcagtatgcaggcctgcaatgcccatggcatctactgtgttccattgtatgacacgcttggtgctggggcagtagaatttgtgttgtgccatgcagaggtacagattgcttttgttgaggaaaataagattggagagatactcaagacatttcccaatgcaaccaaatttttgaagacaattgtgagcttcggtaaggtcaatcccgagcacaaggaaaaagttgaagagaatggcttatccatctactcttgggaagagtttctgcaactgggcggtgaagagaagtttgaactcccaccaaaggaaaaggatgacatatgcacaataatgtatactagtggcacaactggtgatcctaagggagtattaatctccaacaagagcatcattaccattgtttcagcagtagatgagttccttagcaactcaggcgaggagcttcgtgaggatgatgtttacatatcttaccttccgcttgctcatatctttgaccgagtgattgaggaagtgttcattcaccatggtgcttcaattggattttggcgtggggatgttaaactcttggttgaagacattggtgaactcaaaccaacagtattctgtgctgttccacgtgttctggacaggatttatggaggattgcaagataaaatcacaactggtggtttcttgaagaagaccttgttcaatgttgcttacaaatacaaacaaggtaatatgttgaaaggaagcaagcatgaagaggctgctgcagtgtttgacaaactggtcttcaccaaggtgaaacggggactaggtggcagggttcggctgattctatccggtgctgctcccctgtctagacatgttgaggagtatctgcgtgtggtgacatgctcccatgttctccagggatatggactcacagagacctgtgctgggtcctttgtttccctaccgaacaacatgtccatgctgggtaccgtcggccctccgctcccatacgtcgaagtacgcctggaatctgtcgctgagatgggttacgacgcattgtccagcgagacgcctcgtggggagatttgtataagaggggacaccctgttctcagggtactacaagcgagaggacctaaccaaggaaatcatggtcgatggttggttccatacaggagacattggtgagtggcagcctgatgggagcatgaagatcatcgaccgcaagaagaacatctttaagctctcacagggagagtatgttgcggtcgagaatctggagaacatctttggtcagactcccggtgttgattcggtttgggtgtatggcaacagcttcgaatcgagcctcgttgcagtggtgaaccccaataagcaggctctggagcgatgggcagagtcgaacggggtaactggagagtttgctgcgatttgtgaagacccgaaagccaaagagttcatcttgggagaactaaccaagatgggtaaagaaaagaagctcaaaggcttcgagctcatccgggctgttcatctggacccggtgccgttcgacatggatcgcgacctcattaccccgacgtacaagaagaagcggccgcagctgctgaaatactaccagagcgtcattgatggcatgtatcagagcatgaagtattaggctcttgtcgactcgtggcagcacggcacggggaatcgaatggacctctagctagcgacgtcagcaaactttacgtgaatttggcgtacattatgttagcttgtcattgaaaaaactatacaaatgttccgcaaacaaaaaaagagttacacacatgatagtagctaagtttattattttttatcatttttctccttaattttggcgtatacagtggagctgttttgagtgaaccagtgtagtgttttatttttttcgaacggagagaacttatattaaactaacagagtatgttt

SEQ ID NO: 11130 - protein, 541 aa, Panicum virgatum
  misc_feature: Ceres CLONE 1726419
  misc_feature (1)..(431): Pfam Name: AMP-binding Pfam Description: AMP-binding enzyme
  misc_feature: SWISSPROT Homolog: EC 6.2.1.3 Long-chain-fatty-acid--CoA ligase
MQACNAHGIYCVPLYDTLGAGAVEFVLCHAEVQIAFVEENKIGEILKTFPNATKFLKTIVSFGKVNPEHKEKVEENGLSIYSWEEFLQLGGEEKFELPPKEKDDICTIMYTSGTTGDPKGVLISNKSIITIVSAVDEFLSNSGEELREDDVYISYLPLAHIFDRVIEEVFIHHGASIGFWRGDVKLLVEDIGELKPTVFCAVPRVLDRIYGGLQDKITTGGFLKKTLFNVAYKYKQGNMLKGSKHEEAAAVFDKLVFTKVKRGLGGRVRLILSGAAPLSRHVEEYLRVVTCSHVLQGYGLTETCAGSFVSLPNNMSMLGTVGPPLPYVEVRLESVAEMGYDALSSETPRGEICIRGDTLFSGYYKREDLTKEIMVDGWFHTGDIGEWQPDGSMKIIDRKKNIFKLSQGEYVAVENLENIFGQTPGVDSVWVYGNSFESSLVAVVNPNKQALERWAESNGVTGEFAAICEDPKAKEFILGELTKMGKEKKLKGFELIRAVHLDPVPFDMDRDLITPTYKKKRPQLLKYYQSVIDGMYQSMKY

SEQ ID NO: 11131 - DNA, 865 bp, Panicum virgatum
  misc_feature: Ceres CLONE 1726426
  misc_feature: Encodes the peptide sequence at SEQ ID NO. 11132
actagctttccccttctctgcagtccgggaagcacacggcggaagcaagggagttcagggaccatggggcagaagcatcttctgttgctcacttgtttttgggtcctgtcatgtgccttgctgcttcatgcatcctccgatgggctgctaagaatcaacctcaacaagaagagactggacaagggagctttgacagctgcaaaattagctaggcatgagagtcgccttcggagaaggttctatggttctcaccagtctctcggcgcctcaagcgatgacatagttcctttggacaactacctggacactcaatactttggagagattggcattggcacgccaccacagaacttcactgtgatatttgacactggaagctctaacttgtggattccctcctcgaaatgctatttctcgatagcatgctacttacaccacagatacaggtcagccaagtcgaacacttacaaaaagaacggggaaacttgcacaataacatatggttctgggcaaattgctggcttcttcagtgaagacaatgtgttggtcggcagccttattgtaaaaaatcagaagttcattgagactacccgtgaaaccagccctacctttatcattggaaagtttgacggaattcttggcctcggatttcctgaaatttctgtgggaggagcacctccaatttggcagagcatgaaagaacaaaagctggtcgaaaaggatgttttctcgttctggcttaaccgtgatcctgatgcatctgctggaggtgaacttgtctttggcggtgttgacccaaagcactacaagggaagccacacatatgtcccctgtactcgcaaaggctactggcagtttgacatgg

SEQ ID NO: 11132 - protein, 267 aa, Panicum virgatum
  misc_feature: Ceres CLONE 1726426
  misc_feature (83)..(267): Pfam Name: Asp Pfam Description: Eukaryotic aspartyl protease
  misc_feature: SWISSPROT Homolog: EC 3.4.23.40 Phytepsin
MGQKHLLLLTCFWVLSCALLLHASSDGLLRINLNKKRLDKGALTAAKLARHESRLRRRFYGSHQSLGASSDDIVPLDNYLDTQYFGEIGIGTPPQNFTVIFDTGSSNLWIPSSKCYFSIACYLHHRYRSAKSNTYKKNGETCTITYGSGQIAGFFSEDNVLVGSLIVKNQKFIETTRETSPTFIIGKFDGILGLGFPEISVGGAPPIWQSMKEQKLVEKDVFSFWLNRDPDASAGGELVFGGVDPKHYKGSHTYVPCTRKGYWQFDM

SEQ ID NO: 11133 - DNA, 711 bp, Panicum virgatum
  misc_feature: Ceres CLONE 1726426-R
  misc_feature: Encodes the peptide sequence at SEQ ID NO. 11134
agatgatccttgagttgctcatagcgcagactagtccacaaaaggtctgcactcagatcggtctctgtgtatttgatggtactcattctgtcagcaacccaattgaatcagttgtcgagaaacaaaagcaaggttctgatcttttctgtactgcttgtgagatggctgttgtctggatacagaatcaactccgagaaaacaagacgaaagagctcattttgaactatgcgaatcagctctgtgagctcctccccagccccaatggtgaatcaactgtcgactgccatcagatctcaaagatgccaaaccttgcattcaccatagcaaacaagaccttcaccttaacaccagagcagtacgttgtgaagctggagcaagcaggtcaaaccatgtgtatcagtgggttcatggcattcgacgtaccgcctcctcgtggtccactctggatccttggggatgttttcatgggcgcgtaccacaccgttttcgacttcggcgagaacaggatcggcttcgccaagtctgcctgaggactggagcccctcacagtagtggcatctcctgtttatcctcccagtattgtacatatggcataagctgcaaagtttagtagtgtatgcacgcagaagcctttggggctatccgactaatatgcctgtatgtgtttgcaaatggagctaagctatttataaagctccgggacatgcatgt

SEQ ID NO: 11134 - protein, 175 aa, Panicum virgatum
  misc_feature: Ceres CLONE 1726426-R
  misc_feature (46)..(84): Pfam Name: SapB_1 Pfam Description: Saposin-like type B, region 1
  misc_feature: SWISSPROT Homolog: EC 3.4.23.40 Phytepsin
MILELLIAQTSPQKVCTQIGLCVFDGTHSVSNPIESVVEKQKQGSDLFCTACEMAVVWIQNQLRENKTKELILNYANQLCELLPSPNGESTVDCHQISKMPNLAFTIANKTFTLTPEQYVVKLEQAGQTMCISGFMAFDVPPPRGPLWILGDVFMGAYHTVFDFGENRIGFAKSA

SEQ ID NO: 11135 - DNA, 2220 bp, Panicum virgatum
  misc_feature: Ceres CLONE 1726434
  misc_feature: Encodes the peptide sequence at SEQ ID NO. 11136
agatctctcatggcacggcgaggcagcacgctggcagcacggcgggtcggcggcggggggcggctaagctagatctggacggaggggtagcagcctctaggcgtgttccacgtctccggtcagcagctgatgtacatcagaaaattcggaggcgagacaaaggaaggacggcatagaattttctaatccccatctagtcttaggaataggattagggaattagcacctcatctactggcacgacgaaaggtcggtcacaggctcagcctacctccgtgtctcgctcactctcctcctcaaccactcaacgggctctggatcgttgacgcctgacgccgtcccgcacacgcaagccaggcctccaccggcgccggcggcatggacaggctcggcgcgaacccggccaacgcgtgcccgctcacgccgctgggcttcctggaccgcgcggcgaccgtgttcggcgactgcccctccgtcgtctaccacgacgccgtcttcacctggtcccagacgcaccgccgatgcctccgcctcgcctccgcgctcgcctccctcggcatctcccgcggcgacgtcgtgtccgtgctgctgcccaacgtgccggccatgtacgagatgcacttcggcgtgcccatgagcggcgccgtgctcaacaccatcaacacccgcctcgacgcgcgcaccgtcgccgtcctgctccgccactccggctccaagctcgtcttcgtcgacccggcgtcgttgcagctcatcggcgacgcgctcaagcagctcccgcccgggcatccggcgccgcgcgtcatccccgtcgaggatccccacgaggaggacttccccgccgccccgcccgggaccttgacgtacgagaggcttctcgagaagggcgacccggagttcgcgtggatacggccggccagcgaatgggccccgatgatactgaactacacctccggcacgacgtcggcgcccaagggcgtcgtgcactgccaccgcggcatcttcttggtcgccgttgactcgctcgtggcgtgggctgtgccgccgcagccgacatacctgtggacgctgcccatgttccacgccaacggatggtgcttcccgtgggggatggctgccgtgggcggcaccaacgtgtgcctccgccgtgtcgacgccgccgaggtctacgccaccatcgcgcgccgcggggtgaaccacctctgcggcgcgcccgtcgtgctcaacatgctggccaacgcccccgagggggtgcggcggccgctcccggggaaagtgcgcatcttgaccgccggcgcgccgccgccggccgccgtgctgcaccgcacggagtccatcggcttcgaggtctcccacgggtacgggctaaccgagaccgctggtctagtcgtgtgctgcgcgtggaaggggtgggagtggaacaagctcccggcgtcggagcgcgcccggctcaaggcgaggcagggcgtgcgcacgccgggcatggccgaggtggacatcatcgacggcgagaccgggcgcagcgttccccgcgacgggtccacgatgggcgagatcgtgctccgcggcgggtgcatcatgctgggctacctgaacgacgacaaggcgaccaaggcggcgatccgagacgacgggtggttctacacgggggacgtgggcgtgatgcatccggacgggtacatggagatccgcgaccggtccaaggacgtgatcatcagcggcggcgagaacatcagcagcgtggaggtggagtccgtgctgtacaaccacccggcggtgaacgaggcggcggtggtggcgcggccggacgagttctggggcgagacgccgtgcgcgttcctgagcctcaaggagggatcggcgggcgcggtgaccgcggccagtgtcgccgcgtggtgccgggagcgcatgccgcactacatggtgcccaagacggtggtgttccgccccgagctgcccaagacatccacggggaagatccagaagtacgtgctccggaaccttgccaaggagatgggaccaacaagcaagggccgcagcaggatgtagtgagtgcctactagagctgttgtcgtcttgcttggtatggacatgtgcgctgaagcatgggcttgacatgtagtagagcatcatcttgagatcagcaagccctctcgtcgatcctgttggtgtaacagatttgtctcctttttatctttgtgctgaatagacatgattgatgcc

SEQ ID NO: 11136 - protein, 555 aa, Panicum virgatum
  misc_feature: Ceres CLONE 1726434
  misc_feature (41)..(471): Pfam Name: AMP-binding Pfam Description: AMP-binding enzyme
  misc_feature: SWISSPROT Homolog: EC 6.2.1.3 Long-chain-fatty-acid--CoA ligase
MDRLGANPANACPLTPLGFLDRAATVFGDCPSVVYHDAVFTWSQTHRRCLRLASALASLGISRGDVVSVLLPNVPAMYEMHFGVPMSGAVLNTINTRLDARTVAVLLRHSGSKLVFVDPASLQLIGDALKQLPPGHPAPRVIPVEDPHEEDFPAAPPGTLTYERLLEKGDPEFAWIRPASEWAPMILNYTSGTTSAPKGVVHCHRGIFLVAVDSLVAWAVPPQPTYLWTLPMFHANGWCFPWGMAAVGGTNVCLRRVDAAEVYATIARRGVNHLCGAPVVLNMLANAPEGVRRPLPGKVRILTAGAPPPAAVLHRTESIGFEVSHGYGLTETAGLVVCCAWKGWEWNKLPASERARLKARQGVRTPGMAEVDIIDGETGRSVPRDGSTMGEIVLRGGCIMLGYLNDDKATKAAIRDDGWFYTGDVGVMHPDGYMEIRDRSKDVIISGGENISSVEVESVLYNHPAVNEAAVVARPDEFWGETPCAFLSLKEGSAGAVTAASVAAWCRERMPHYMVPKTVVFRPELPKTSTGKIQKYVLRNLAKEMGPTSKGRSRM

SEQ ID NO: 11137 - DNA, 998 bp, Panicum virgatum
  misc_feature: Ceres CLONE 1726438
  misc_feature: Encodes the peptide sequence at SEQ ID NO. 11138
gacaacgatccatccattcatatttggctctgcctcagagtctcagacccgagacaagctagctatggcggcgagcggacggagcagggaggagcggtggagcctggccggcaagacggcgctcgtcaccggaggaagcaaggggatcgggcgcgcgatcgtggaggagctcgcggggttcagggtgcgcgtccacacctgcgcccgcggcgactccgacctgcaggagtgcctgcgccggtgggccgccgacggccgcctcgcgcgcgtcacggggaccgcctgcgacgtcgcggcgcgcgccgaccgggagcggctcgtggccgctgcgcgggaggagctgggcggccggctggacatcctcrtcaacaacgcagggcagaccatgttccggcccgccacggagaccacggcggaggactacgcgcgcctcatggccaccaacctcgagtcctgcttccacctcgcgcagctcgcgcatccactcctcgtcgtggcggcgtcgtcaggcggcggcgactccagcagcgtcgtcaacgtctcctccatcggcgggattgtctcctacccggcgctgtccgtgtactcggcgaccaagggcgccatgaaccagctcacccgcagcctcgccgtcgagtgggcgaaggacaacgtgcgcgtcaactgcgtcgcgccgggtggcgtccggaccgacatcgccagcagcagcggcctcaagctggacccggaggtggcgcggaagatgggcgaggcggaggtggcgcgggttcccctgcgccgcatcggcgagccggaggagatcgcgtcgcttgtcgttttcctctgcaygccggccgcctcctacatcaccgggcaggtcatctgcgccgmcggtggccgcaccatagccccctastacgccttgctagctgttagctgcgtcgacggcgcttgaattggctggcatgattaaactcctcggttcttactctcttttttctaataataaattaattatc

SEQ ID NO: 11138 - protein, 289 aa, Panicum virgatum
  misc_feature: Ceres CLONE 1726438
  misc_feature (17)..(193): Pfam Name: adh_short Pfam Description: short chain dehydrogenase
  misc_feature: SWISSPROT Homolog: EC 1.1.1.206 Tropine dehydrogenase
  misc_feature (101)..(101): Xaa is any aa, unknown, or other
  misc_feature (255)..(255): Xaa is any aa, unknown, or other
  misc_feature (269)..(269): Xaa is any aa, unknown, or other
  misc_feature (277)..(277): Xaa is any aa, unknown, or other
MAASGRSREERWSLAGKTALVTGGSKGIGRAIVEELAGFRVRVHTCARGDSDLQECLRRWAADGRLARVTGTACDVAARADRERLVAAAREELGGRLDILXNNAGQTMFRPATETTAEDYARLMATNLESCFHLAQLAHPLLVVAASSGGGDSSSVVNVSSIGGIVSYPALSVYSATKGAMNQLTRSLAVEWAKDNVRVNCVAPGGVRTDIASSSGLKLDPEVARKMGEAEVARVPLRRIGEPEEIASLVVFLCXPAASYITGQVICAXGGRTIAPXYALLAVSCVDGA

SEQ ID NO: 11139 - DNA, 811 bp, Panicum virgatum
  misc_feature: Ceres CLONE 1726448
  misc_feature: Encodes the peptide sequence at SEQ ID NO. 11140
acaccaatcatcgccggcctcgattctctccggtcactgcctagtcagcgttcttcttcttgttgtttccttccgtagatcgatcacgatcagcacgtgagttccgagcgatggcgaagccgagcgtgggagtctcggaggtgggcgtcttggctgcgccggcgcaggcggcgtgcccctgcccggggacgctgttcccgtacccgccgccgcgcggcgccgggatcgccgcctccgtgcggcgcaagtgcctgcaggtggagctcggcgccggggcgggcggcgcgtggggcgccctcgagtccatgcgcgcgtcgtcgcccacgcacgccaaggccgcggcggcggcccccgccgccggcgtggacgtggacgacgagcgcgcggcgtggatggcgcggcacccgtcggcgctgggcaagttcgaggagatcgtggcggcgtccgagggcaagcgcatcgtggtgttcctggactacgacggcaccctgtcgcccatcgtcgacgaccccgacgccgccttcatgagcgagacgatgaggatggccgtgcgcagcgtcgccaagcacttcccgacggcgatcgtcagcggccggtgccgcgacaaggtgttcgagttcgtgaagctggcggagctctactacgcggggagccacggcatggacatcaagggcccggccaaggccgcctcttcccggcacacaaaggccaaggcgaagggagtcctgttccagccggcgagcgagttcctgccgatgatcgaggaggtgcacgagcgcctggccgaggcgacgcgctgcatccccggggg

SEQ ID NO: 11140 - protein, 233 aa, Panicum virgatum
  misc_feature: Ceres CLONE 1726448
  misc_feature: Useful for making plants with modulated drought sensitivity
  misc_feature: The sequence is a functional homolog of SEQ ID NO 16 in US patent 7214858
  misc_feature: Useful for making plants with modulated flowering time
  misc_feature: Useful for making plants with modulated low light sensitivity
  misc_feature: Useful for making plants with modulated water use efficiency
MAKPSVGVSEVGVLAAPAQAACPCPGTLFPYPPPRGAGIAASVRRKCLQVELGAGAGGAWGALESMRASSPTHAKAAAAAPAAGVDVDDERAAWMARHPSALGKFEEIVAASEGKRIVVFLDYDGTLSPIVDDPDAAFMSETMRMAVRSVAKHFPTAIVSGRCRDKVFEFVKLAELYYAGSHGMDIKGPAKAASSRHTKAKAKGVLFQPASEFLPMIEEVHERLAEATRCIPG

SEQ ID NO: 11141 - DNA, 586 bp, Panicum virgatum
  misc_feature: Ceres CLONE 1726448-R
  misc_feature: Encodes the peptide sequence at SEQ ID NO. 11142
gttacccgaagctgcggctgacgcaggggcgggtggtgctggaggtgaggccgggcatcaagtgggacaagggcagggcgctcgagttcctgctcgagtcgctgggcttggccgactgcgccagcgtcctgcccgtctacatcggcgacgaccgcaccgacgaggacgccttcaaggccctgcggcggcgcgggcagggcgtgggcatcctcgtgtccaagcaccccaaggagacggccgcctcctactcgctccgggagcccgccgaggtcatggacttcctgctgcgcctcgtccagtggaagcggctctccagggcgagcctcaggcacaggctcctgcaatgaccactttttttcgctcttgtaccctagaagcctggacaatgctaccactgattgtcagttttttttttttttgcgagggctgattgttagttgtaccatctcgtggagtacgcgagagctcgatctgtttttatctctattcttcttgtttcccgagggcccgatcgaacgggtgtatgatgacaaggaatgtacattatgtagatgacgatattataaatatacatactccctccgtt

SEQ ID NO: 11142 - protein, 114 aa, Panicum virgatum
  misc_feature: Ceres CLONE 1726448-R
  misc_feature: SWISSPROT Homolog: EC 3.1.3.12 Trehalose-phosphatase
  misc_feature: Useful for making plants with modulated flowering time
  misc_feature: Useful for making plants with modulated low light sensitivity
  misc_feature: Useful for making plants with modulated drought sensitivity
  misc_feature: The sequence is a functional homolog of SEQ ID NO 16 in US patent 7214858
  misc_feature: Useful for making plants with modulated water use efficiency
YPKLRLTQGRVVLEVRPGIKWDKGRALEFLLESLGLADCASVLPVYIGDDRTDEDAFKALRRRGQGVGILVSKHPKETAASYSLREPAEVMDFLLRLVQWKRLSRASLRHRLLQ

SEQ ID NO: 11143 - DNA, 949 bp, Panicum virgatum
  misc_feature: Ceres CLONE 1726451
  misc_feature: Encodes the peptide sequence at SEQ ID NO. 11144
  misc_feature (758)..(758): n is a, c, t, g, unknown, or other
aagcagtccctctcgaaatccagcatcgccttctccgccgccgccgctcgatctagacccagaaggttctccccggagccctttcggcgatggcgatgatccagtccgtgaaggcgcgccagatcttcgacagccgtggcaaccccaccgttgaggtcgatgtgtgctgctcagatggaacattcgcgcgtgctgctgttcccagtggtgcatcaactggtgtttatgaagctctggagttgagggatggtggatctgactacctcggcaagggagtttccaaggctgttaacaatgtgaactctatcattggacctgctcttgttggcaaggaccctacggcacagactgagattgacaactttatggttcagcagcttgatggcactaagaatgagtggggatggtgcaagcaaaatcttggtgctaatgccatcttggctgtgtcactagctgtttgcaaagctggagcttgtatcaagaaaattcctctttaccagcacattgccaatcttgctggcaacaagcaattagttttgcctgtccccgcatttaatgtcatcaatggtggttcccatgctggaaacaagcttgctatgcaggagttcatgatcctgccaactggagctgcctcattcaaggaggctatgaagatgggtgttgaagtttaccacaacctgaagtctgttatcaagaagaagtatgggcaggatgccaccaatgttggtgatgagggtggttttgctccgaacattcangaaaacaaggaaggacttgagctgctaaagactgctattgagaaggccggatacaccggaaaggttgtcattgggatggatgttgctgcttctgaattttctacatgacaggacaagacatatgaccctcacttcaaggaggagaaacatgatggttcacagaagatatctggagacagcttgaagaacgt

SEQ ID NO: 11144 - protein, 258 aa, Panicum virgatum
  misc_feature: Ceres CLONE 1726451
  misc_feature (3)..(139): Pfam Name: Enolase_N Pfam Description: Enolase, N-terminal domain
  misc_feature (147)..(258): Pfam Name: Enolase_C Pfam Description: Enolase, C-terminal TIM barrel domain
  misc_feature: SWISSPROT Homolog: EC 4.2.1.11 Phosphopyruvate hydratase
  misc_feature (223)..(223): Xaa is any aa, unknown, or other
MAMIQSVKARQIFDSRGNPTVEVDVCCSDGTFARAAVPSGASTGVYEALELRDGGSDYLGKGVSKAVNNVNSIIGPALVGKDPTAQTEIDNFMVQQLDGTKNEWGWCKQNLGANAILAVSLAVCKAGACIKKIPLYQHIANLAGNKQLVLPVPAFNVINGGSHAGNKLAMQEFMILPTGAASFKEAMKMGVEVYHNLKSVIKKKYGQDATNVGDEGGFAPNIXENKEGLELLKTAIEKAGYTGKVVIGMDVAASEFST

SEQ ID NO: 11145 - DNA, 745 bp, Panicum virgatum
  misc_feature: Ceres CLONE 1726451-R
  misc_feature: Encodes the peptide sequence at SEQ ID NO. 11146
acgtatacaagtcatttgtgagtgagtaccccatggtctcgattgaagacccatttgatcaggatgactgggttcactatgccaagatgactgaagaaattggagagcaagtacagattgttggtgatgaccttcttgtcaccaacccaactagggttgcaaaggctatcaaggagaagtcatgcaatgctcttctgcttaaggttaaccaaattggatctgttactgagagtattgaggcagtgaagatgtcaaagcatgctggctggggtgtgatgaccagtcacaggagcggtgagactgaggatacatttattgctgatttggcggttggtttggccacgggtcagatcaagactggagctccctgccggtctgagcgtcttgccaagtacaatcagcttcttaggatcgaggaagagcttggtgctgccgctgtctatgctggcgccaagttccgcgcacctgtggagccctactaagctagagcgatgctggaggccgaccatcttgtttaagttttgtgaagaaggttactgcaccctccaccctccaccatatagaacctctggtctggattgaacttgctaaagttgtgatcgagcaataagttcccacttagttttgggagacggacatgtaacaaaaaaactccagtttttggtttttctatgttgagcctgaacatgcttgatcataatgtaggccgctgtttgttttggattgaatgaagcggtattcctct

SEQ ID NO: 11146 - protein, 159 aa, Panicum virgatum
  misc_feature: Ceres CLONE 1726451-R
  misc_feature (1)..(156): Pfam Name: Enolase_C Pfam Description: Enolase, C-terminal TIM barrel domain
  misc_feature: SWISSPROT Homolog: EC 4.2.1.11 Phosphopyruvate hydratase
VYKSFVSEYPMVSIEDPFDQDDWVHYAKMTEEIGEQVQIVGDDLLVTNPTRVAKAIKEKSCNALLLKVNQIGSVTESIEAVKMSKHAGWGVMTSHRSGETEDTFIADLAVGLATGQIKTGAPCRSERLAKYNQLLRIEEELGAAAVYAGAKFRAPVEPY

SEQ ID NO: 11147 - DNA, 1643 bp, Panicum virgatum
  misc_feature: Ceres CLONE 1726464
  misc_feature: Encodes the peptide sequence at SEQ ID NO. 11148
aggagagagagagagaggaagcgccctgccaaaggaagaaaccgcggcgagaggaggagagggaggaggaacggcggagggcgagcaagatgagagagatcatcagcatccacatcggccaggccgggatccaggttggcaacgcctgctgggagctctattgcctcgagcacggcatcgagcccgatggcaccatgcccagtgatacctcggttggcgtcacacatgatgccttcaacaccttcttcagcgagaccggttctggcaagcatgtgccgagggccatctttgtcgaccttgagcccactgtcatcgatgaggtgcgcactggctcgtaccgccagctctttcacccagagcagctaatctccgggaaggaggatgcggctaacaactttgcccgtggccactacactgttgggaaggagattgtcgatctgtgcctcgaccgagtgcgcaagctagcagacaattgcactgggctgcagggatttttggtgttcaatgctgttggtggtggtactggctctggacttggttcactgctgttggagcgcctctcagttgattatggcaagaagtccaagctcggcttcaccatttatccttccccacaggtgtcaacagctgttgtagagccatacaacagtgtcctctcgacccactccttgcttgagcacacagatgttgcagtcctcctggacaatgaggctatctatgacatatgccggaggtcccttgacattgaaaggccaacctacaccaacttgaacaggctgatctcacagatcatatcttcgcttaccacctccctgagggttgatggtgctatcaacgtggatgttacagagttccagaccaaccttgtccatatccacgtatccatttcatgctttcatcatatgcccccggttatctctgccgagaaggcctaccatgagcagctctctgtgcccgaaatcaccaatgctgtcttcgagccctcaagcatgatggccaagtgtgacccaaggcatgggaagtacatggcttgctgcttgatgtaccgtggtgatgttgttcctaaggatgtcaatgctgcagttgcaaccatcaagaccaagagaactgtccagtttgtggactggtgccccactggattcaagtgtggcatcaactaccagccaccctctgttgtccctggaggtgacctggcaaaggtccagcgtgctgtgtgcatgatcagcaacaatacagctgtcgcggaggtgttctctcgcatcgaccacaagttcgacctgatgtacgccaagcgtgctttcgtgcactggtacgtcggtgagggtatggaggaaggcgagttctcggaggcccgtgaggacttggctgcccttgagaaggactacgaggaggtcggcgcagagggtgcggacgacgaaggcgacgagggagaagactattgagcagttggttaataagtagttcgtgggtggttaatggtttgggttgtcgagtatactctgcatggttccattccattgcgtactgctgccgtgtgtgtttccattttgttttatgtggtaaattgttcgtagcccccggttggccatgattgttcatatcgtcttgctttggtttgcaatgctattcgtccaaattcagtg

SEQ ID NO: 11148 - protein, 450 aa, Panicum virgatum
  misc_feature: Ceres CLONE 1726464
  misc_feature (49)..(246): Pfam Name: Tubulin Pfam Description: Tubulin/FtsZ family, GTPase domain
  misc_feature (248)..(393): Pfam Name: Tubulin_C Pfam Description: Tubulin/FtsZ family, C-terminal domain
  misc_feature: Useful for making plants with altered cell wall content and/or composition
MREIISIHIGQAGIQVGNACWELYCLEHGIEPDGTMPSDTSVGVTHDAFNTFFSETGSGKHVPRAIFVDLEPTVIDEVRTGSYRQLFHPEQLISGKEDAANNFARGHYTVGKEIVDLCLDRVRKLADNCTGLQGFLVFNAVGGGTGSGLGSLLLERLSVDYGKKSKLGFTIYPSPQVSTAVVEPYNSVLSTHSLLEHTDVAVLLDNEAIYDICRRSLDIERPTYTNLNRLISQIISSLTTSLRVDGAINVDVTEFQTNLVHIHVSISCFHHMPPVISAEKAYHEQLSVPEITNAVFEPSSMMAKCDPRHGKYMACCLMYRGDVVPKDVNAAVATIKTKRTVQFVDWCPTGFKCGINYQPPSVVPGGDLAKVQRAVCMISNNTAVAEVFSRIDHKFDLMYAKRAFVHWYVGEGMEEGEFSEAREDLAALEKDYEEVGAEGADDEGDEGEDY

SEQ ID NO: 11149 - DNA, 2018 bp, Panicum virgatum
  misc_feature: Ceres CLONE 1726465
  misc_feature: Encodes the peptide sequence at SEQ ID NO. 11150
attgttaaaccggcgcccgcatctaccagttaacgcctcccttccgttcccttcctcccttctcgcatttccggccagggggactcgacattgacgcctccgccgagctttggggatgactggcagtagaagggtccaagcctcaggctatcaattgtactgtcctggttggaattgcctggacagctggattgcaagtctgtgtccacgttaaagtcttcttgtggaggataccatactgctatatcgaccgaattgttccttgaagcttaggtaatataaggcaatgggatgttcaatggttattctgagaaatgaccaatggtttactaactagtgttcattaattgaatggccaaacatgcggtggaaacgaaagatacatcatggaggaccatctgaacaacaacaggtcagtccacttgtggatgaagtatgtgccattgacgaggaggtttcccatctttgtagaattaaatctgaaccaagtcagagaactcgtgcatccatttatgctggccagaagaggcctgtctcaacattcaagttattatcagggagagaatcaaattgctcggggatgggcagattctcttcagctgattgctcttatgctcttcggaaacacctaccagtgaaaggcccatggtgtgtggatgacatggatagtgaagcttacatctcacagttctctgcagatggttcacttctaattggtgggttccggggaagccacatcagagtctacaactctgaaaaaaattggaaggttcataaagatataacctgcaaacgtctgcgctggacaatttcagatattgccctctcacctgatcaacgattcctggcttattccagtttgtcgcctactgttcacatagtaaatgtccagaatgctgtaagggaatcacatgctaacattacagaaattcatgagggtctggagttttctgacgatgatgacgaattctcctttgggatattctctgtaaaattttcaaaagatgggcgagaacttgttgtaggaaacaacaatgaatcaatatgtatttatgatcttggagcaaacaaagtaacagaacgcattaatgcacatgtggctgatgtcaatgtggtcaccttcgctgatgaaacaagtgatgtcttgtactctggaagtgatgatagcctttgtaaggtttgggataggcgctgccacaagaaacaaaagccagtaggtgttctgaccggtcatttagatgggattacatttattgatagccgtggagatgggcactattttatctcaaactgcaaggatcagactattaaattatgggatctcaggaaaatgtcttccactacaaaagagtgcacaccaaaagggtatgaatgggattacagatggatgacatacccgtcagaagcccgatatttgaagcatccatatgatcagtcactagccacattcagaggccattctgtgttgcgcacacttattcgttgttatttttccccaatgcacagcacgagtcagaggtacatatacacaggatccagtgaccaatgtgtctatatttatgatgtggcgacaggtaaggttgttgaaaaactgagatggcacgggtcgatcatcagagactgctcatggcacccgtacctccccacacttgtcagctcttcttgggacggctatttggtccggtgggaggcaacagaggatggcagagacccctccatgctcaagacatggaagcagaggatgcatccagaatgatacacagtgtcgtttgtcctttagaagtgaagctctcaagggtctcatgtgggcatgtggctccacttggtcaccttgcaggcttcccaagcctctggctcgaaaaagtccttttactatttaaaatttcgtgctgtatataagtgatcgagagtgaattgttgaggcggttcgcaggtcgagtgaattgttgaggcggtacatagactcgcaaaattgtaatgcaaaagtttatctatctatctatactatatcttatctt

SEQ ID NO: 11150 - protein, 464 aa, Panicum virgatum
  misc_feature: Ceres CLONE 1726465
  misc_feature (282)..(320): Pfam Name: WD40 Pfam Description: WD domain, G-beta repeat
  misc_feature (405)..(443): Pfam Name: WD40 Pfam Description: WD domain, G-beta repeat
  misc_feature (236)..(275): Pfam Name: WD40 Pfam Description: WD domain, G-beta repeat
  misc_feature: SWISSPROT Homolog: EC 2.7.11.7 [Myosin heavy-chain] kinase
MRWKRKIHHGGPSEQQQVSPLVDEVCAIDEEVSHLCRIKSEPSQRTRASIYAGQKRPVSTFKLLSGRESNCSGMGRFSSADCSYALRKHLPVKGPWCVDDMDSEAYISQFSADGSLLIGGFRGSHIRVYNSEKNWKVHKDITCKRLRWTISDIALSPDQRFLAYSSLSPTVHIVNVQNAVRESHANITEIHEGLEFSDDDDEFSFGIFSVKFSKDGRELVVGNNNESICIYDLGANKVTERINAHVADVNVVTFADETSDVLYSGSDDSLCKVWDRRCHKKQKPVGVLTGHLDGITFIDSRGDGHYFISNCKDQTIKLWDLRKMSSTTKECTPKGYEWDYRWMTYPSEARYLKHPYDQSLATFRGHSVLRTLIRCYFSPMHSTSQRYIYTGSSDQCVYIYDVATGKVVEKLRWHGSIIRDCSWHPYLPTLVSSSWDGYLVRWEATEDGRDPSMLKTWKQRMHPE

SEQ ID NO: 11151 - DNA, 2776 bp, Panicum virgatum
  misc_feature: Ceres CLONE 1726475
  misc_feature: Encodes the peptide sequence at SEQ ID NO. 11152
gatcgccttttttctccctcgcctttcttcaacctcccgactcgttcgcctctccccaccccacccctgcgcaaaaccctagccccaggcccgatggccgccccgccgcagccgcaggcgccgccggcggaggagggggccgcaccggccgctcccctgcccgccgccccgccggggccgcggccgtacgaggtggcggtcgcggcggccgagctccgaccggtggactgcaacctcgcggcgctctgcgaccacgtccaggcggagggcttcggctccggggccttctccgatgtcgtcgtggaggccatgggcgccacctaccggctccaccgcctcatcctctcccggagcgcctacttcaggaatatgctacatggtccttggagagaggccggagcacctaccgtggtcttgcacattgatgatgcaaatgttgattcagaggcaattgcaatcgctctggcatatctttatgggcaacctcccaagcttaatgataacaatgcatttcgggtgctcgcagctgcatcatttctggatcttcaggacttatgtacaatatgtacagattttattatttctgagctttggacatcaaactttttacaatatcagttgtttgctgaaagtcaagattatggtagtcatggagaacgtgtcagaaatgcctgctggggttatctttgtcaaagtgccacactggaactacgagaggtgctaccaaagctttcttcacaaactttgcatgctctccttacgtctgacgaattgtgggtccctaatgaagagaaacggtttgagctagcattgtttactctacttgcaaaggttactgtgtgcgagttacaagttagtggaaatgaagcaagctcaccgaatgctgatcgatccatgaggaaggggaagtctccaatgaatgaacctggcgaggaacagctaattgagtctgaattgcagaacttgaagttgcatgataacttggggactgaaattgcccataacattattgctatttcagatatgaatggtcaagcttccaagaggatggagaatgattgttctactggaggaccatctggagaaagcacttcatatcagtttaatgaaaacatctggctttctagtgagcaaactaagaattatttctcaagaacttccagtaatggggttgttcctactgagtggggtaggcctaatgcaccactttggggtggtagggttgttgggcggcggcaagttagatgcattaggggggcctcttgtctatctactgatgaatataatgcttttatgaatatctttgaaaggggttctcttctctactgcaacatgtcatttgatgcgctgttaagcgttcgaaagcaacttgaagaatttggattcccttgcaaagctgtcaatgatggtctttggctacagatgcttctgtgtcacagagtgcaagcgatagttgctgatacttgcagaaattgttgcctaactagtaattcttgtgcctgcaagcaagcatatgtgagctcgcatacccactacaggcaggagcatgaccggagcagtgcttctggcacagtaggtaatatctatcttgcagatgcccagggtgatgggaatggtgtgcttgggcctgtccgtattaatgtaagaggagcagtcgatggacttgctggtattggaagagggaactcaaatgtgcctggtgcagcttgggctcctacacgttatgtcttctcccgtgtcccttatgggcttggttcaagaaatggtcagcaatttgccaatgatgaatcagaacctagaattgaccgcaatggagatatttcagcagatggcctgactgcattggttaatcttagccaagaaaacaatgctgcccatcagcaggctgaaagtatgtttgagactggcatgcagacgagacatcgcagtgttgcatctgtttccactccaggtggttcttcggtccagatgcaggagtcaaaggagcatgaacttgggtctgattgggaaattgcagaggactcaactatatcattagacatgaaaacaccacttagccattttcctcctttccgctttggggttgagtttgaggatgtgcacaggcttgctgatggtcaggtgaaacattcgtctgaagtattttatgcaggctctttgtggaaggtgagtgttcaagcattcaatgatgaggatcctcatgggcgacgcacccttggactttttctccaccgacgcaaggctgagtttttagaccccttgaggaaggctcacatgtacgttgaccctcgggaaaaagttactgctcggtatcagctcatctgtccatcaaagagagaggttatgatattcggaagccttaaacaggctgggacgctgctaccaaaagccccaaagggctggggctggcgcactgctatactgtttgatgagcttgcggatcttctccagggtggcgccctgcgaatcgctgcagtagtccagctcgtttaaaacaacggttgcacaaaacaacttgcaaggttggtgatatcacagcagtgtatgtagttgacacctacaaaataactctcctcatctatatctcgttcaaatgccgaactgcttaatcatgtgctctgtgctcatgccctcgaagtgtgtaataagggttgtatagtcgctcgtgtttgatgtataggtgaacctttaagctctggactcaaattgggtccatgtggacttgtagcagctgttgagtttttcaaatgaaaaatcattgtcatgacacagtccg

SEQ ID NO: 11152 - protein, 799 aa, Panicum virgatum
  misc_feature: Ceres CLONE 1726475
  misc_feature (52)..(166): Pfam Name: BTB Pfam Description: BTB/POZ domain
MAAPPQPQAPPAEEGAAPAAPLPAAPPGPRPYEVAVAAAELRPVDCNLAALCDHVQAEGFGSGAFSDVVVEAMGATYRLHRLILSRSAYFRNMLHGPWREAGAPTVVLHIDDANVDSEAIAIALAYLYGQPPKLNDNNAFRVLAAASFLDLQDLCTICTDFIISELWTSNFLQYQLFAESQDYGSHGERVRNACWGYLCQSATLELREVLPKLSSQTLHALLTSDELWVPNEEKRFELALFTLLAKVTVCELQVSGNEASSPNADRSMRKGKSPMNEPGEEQLIESELQNLKLHDNLGTEIAHNIIAISDMNGQASKRMENDCSTGGPSGESTSYQFNENIWLSSEQTKNYFSRTSSNGVVPTEWGRPNAPLWGGRVVGRRQVRCIRGASCLSTDEYNAFMNIFERGSLLYCNMSFDALLSVRKQLEEFGFPCKAVNDGLWLQMLLCHRVQAIVADTCRNCCLTSNSCACKQAYVSSHTHYRQEHDRSSASGTVGNIYLADAQGDGNGVLGPVRINVRGAVDGLAGIGRGNSNVPGAAWAPTRYVFSRVPYGLGSRNGQQFANDESEPRIDRNGDISADGLTALVNLSQENNAAHQQAESMFETGMQTRHRSVASVSTPGGSSVQMQESKEHELGSDWEIAEDSTISLDMKTPLSHFPPFRFGVEFEDVHRLADGQVKHSSEVFYAGSLWKVSVQAFNDEDPHGRRTLGLFLHRRKAEFLDPLRKAHMYVDPREKVTARYQLICPSKREVMIFGSLKQAGTLLPKAPKGWGWRTAILFDELADLLQGGALRIAAVVQLV

SEQ ID NO: 11153 - DNA, 922 bp, Panicum virgatum
  misc_feature: Ceres CLONE 1726480
  misc_feature: Encodes the peptide sequence at SEQ ID NO. 11154
accacaccgccactccctccctgccctctcgctcccgatctatccaccaccaccaccgccctctccgcgccaccactcccctcgcctcgcgcggcgaccggcggcgggacgtcggcgggccgatcatggggctcttcaccgtgacgaagaaggccaccacgcccttcgagggccagaagcccggcacctccggcctccggaagaaggttactgtattccagcaacctcattatctacagaactttgtccaatcaacattcaatgcccttcctgctgaggatgtaaaaggtgcgaccattgttgtctctggtgatggccgctatttctcaaaagatgctgttcagatcataacaaaaatggctgctgccaatggagcaagacgtgtttgggttgggctaaacagtctcatgtctactcctgcagtgtctgctgtcatccgtgaaagagttgatgcagatggatcaaaggctacgggtgccttcatcttaacagcgagccacaacccaggtggtccaactgaggacttcgggatcaaatacaatatgggaaatggtgggcctgcccctgagtctgttactgacaagattttctctaatacaacgacgatctctgaatacctcatcgccgaagaccttccagatgttgatatttctgttgctggtgtcactagcttcagtggacctgaaggcccctttgatgtggatgtctttgactccagtgtagattacataaagttaatgaagacgatttttgattttgaggcaataaagagttgctgacctctccaaaattacattctgttatgatgccctccatggtgttgctggagcttatgccaacacatctttgtggaagagcttggtgctgatgaaagctctctgttgaattgcgtcccgaaggtaatgtatttctctattgtcac

SEQ ID NO: 11154 - protein, 217 aa, Panicum virgatum
  misc_feature: Ceres CLONE 1726480
  misc_feature (16)..(165): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFEGQKPGTSGLRKKVTVFQQPHYLQNFVQSTFNALPAEDVKGATIVVSGDGRYFSKDAVQIITKMAAANGARRVWVGLNSLMSTPAVSAVIRERVDADGSKATGAFILTASHNPGGPTEDFGIKYNMGNGGPAPESVTDKIFSNTTTISEYLIAEDLPDVDISVAGVTSFSGPEGPFDVDVFDSSVDYIKLMKTIFDFEAIKSC

SEQ ID NO: 11155 - DNA, 533 bp, Panicum virgatum
  misc_feature: Ceres CLONE 1726480-R
  misc_feature: Encodes the peptide sequence at SEQ ID NO. 11156
ctgatgtttccgaagtagttgcagctgacgagtttgagtataaggatcctgttgatggctctgtgtccaagcaccagggtatccgatacctctttggagatggttcacgactggtgttccgtctctctggaaccggttctgttggtgccaccatccgtgtctacattgagcagtacgagaaggattcctccaagaccggcagggattcacaggatgctcttgctccactggttgatgttgcactcaagctctccaagatgcaagagtacactggccgctctgcccccaccgtgatcacataaatttttgaagagcctgtgttttagaatgagcagcacttacacaaaccttctttctggcctcgtgtttgatagttttttccccgtgtccatctcaccagtgaataaagtgtatgtttattgcccatactgcagacttgccgctggcacagcatgcggtaataagtcttgtcacagtgctgtaactgggagcttgtttctcctctcgcaatatatcagatgtgtttttttgtt

SEQ ID NO: 11156 - protein, 99 aa, Panicum virgatum
  misc_feature: Ceres CLONE 1726480-R
  misc_feature (1)..(88): Pfam Name: PGM_PMM_IV Pfam Description: Phosphoglucomutase/phosphomannomutase, C-terminal domain
  misc_feature: SWISSPROT Homolog: EC 5.4.2.2 Phosphoglucomutase
DVSEVVAADEFEYKDPVDGSVSKHQGIRYLFGDGSRLVFRLSGTGSVGATIRVYIEQYEKDSSKTGRDSQDALAPLVDVALKLSKMQEYTGRSAPTVIT

SEQ ID NO: 11157 - DNA, 850 bp, Panicum virgatum
  misc_feature: Ceres CLONE 1726486
  misc_feature: Encodes the peptide sequence at SEQ ID NO. 11158
aacgaacgaaaagtttccgctgcaagcatggacctctcaccgtttcttgcactgcttcccatcgcccttctctccctcgtgttcttcttctccaccggcagaaaatctactctctcccatggaggtggacggaggagcttgccaccctcgccgccgggcttccctctcgtcggccacctgccgcttcttgtcgggtcgctaccccaccggacgctccgggtgatggccggaacgcacggcccggtcacgctcctgcggctcggccgcgtgcccatcgtggtggcctcctcggcggccgcggcgcaggaggccatgaagacccgagacgtggccttcgcggggcgataccgcgggccgatggtcgagcgccttttctgtgggcgtgacatggccttcgctccctacggcgagcactggcgccaggcgcgacgcgtctgcgtgctccaccttctcagccagcgctgcgtgctctccttccgccgcgttcggcagcaggagaccgccgccctgctcgaccgcgtccgcgccgccggtgtcgacgacggcgccgtgaacctgagccatctcctcgtcgtctactccagcgtcgtcctcctgcgggccgcgttcggcaacgacgactccagccatgggctcgacggagaarggaaggttctgaggaagttgttggtcgacgtcgaggagctgctgggcttgggcacgctcggcgaggtcgtgccgtggctggcgtgggtggactcgatgatgggggtgcatgccaaggcaacacggacgtttgatgcgctggatggcttcctcgagcggggcatcgcagaccaccatgcgcggcgccgtggaggcccgcgggagg

SEQ ID NO: 11158 - protein, 274 aa, Panicum virgatum
  misc_feature: Ceres CLONE 1726486
  misc_feature: SWISSPROT Homolog: EC 1.14.13.21 Flavonoid 3'-monooxygenase
  misc_feature (207)..(207): Xaa is any aa, unknown, or other
MDLSPFLALLPIALLSLVFFFSTGRKSTLSHGGGRRSLPPSPPGFPLVGHLPLLVGSLPHRTLRVMAGTHGPVTLLRLGRVPIVVASSAAAAQEAMKTRDVAFAGRYRGPMVERLFCGRDMAFAPYGEHWRQARRVCVLHLLSQRCVLSFRRVRQQETAALLDRVRAAGVDDGAVNLSHLLVVYSSVVLLRAAFGNDDSSHGLDGEXKVLRKLLVDVEELLGLGTLGEVVPWLAWVDSMMGVHAKATRTFDALDGFLERGIADHHARRRGGPRE

SEQ ID NO: 11159 - DNA, 733 bp, Panicum virgatum
  misc_feature: Ceres CLONE 1726486-R
  misc_feature: Encodes the peptide sequence at SEQ ID NO. 11160
gggggacaaccagcaaatcaccgaggaccacctcggcaagctgcgccgcctcaagccggtgctcaaggagacgctcggtctgcacatgccgtcgccgctcgtgctgcgggagacggtcgaggacaccgagctgctcggctaccacgttccggcacgcacccgtgtcatcatcgacgtcggggccatcgcacgggaccccgccacctgggagcgcgccgaggagttcctgccggagcggtggtttggggacgatggcgggccgctggcggcggcggcggggcaggacttcacattcttgccgttcggtggcgggcggagagggtgccctggtgctgggtttggcatggcgagcgtcgacctggtgctgacgagcctgctgtgccacttcgactgggagctaccggccggtggggcgtccacggtcgacatggatgaggtggggggattggccgtgcggttgaagaaacctctgtgtctggtcgctaagccatggtctcctcagtaagatccatcatggtgtcggtgtcgtctatatatcctactactcatattcatcaggaaattaaataaagatcttaatatattatccgcaagggccacgtgtccttcactggtatcttatacattcatggtaaacagcaaaatgtagagtttggatgcatgacttacattattacatataagcatccatgtaataagtactttatattggctatatatattattctcctct

SEQ ID NO: 11160 - protein, 167 aa, Panicum virgatum
  misc_feature: Ceres CLONE 1726486-R
  misc_feature: SWISSPROT Homolog: EC 1.14.13.68 4-hydroxyphenylacetaldehyde oxime monooxygenase
GDNQQITEDHLGKLRRLKPVLKETLGLHMPSPLVLRETVEDTELLGYHVPARTRVIIDVGAIARDPATWERAEEFLPERWFGDDGGPLAAAAGQDFTFLPFGGGRRGCPGAGFGMASVDLVLTSLLCHFDWELPAGGASTVDMDEVGGLAVRLKKPLCLVAKPWSPQ

SEQ ID NO: 11161 - DNA, 1738 bp, Panicum virgatum
  misc_feature: Ceres CLONE 1726493
  misc_feature: Encodes the peptide sequence at SEQ ID NO. 11162
attcgcttcgtccgtatacctccccctcgcccttccctcctctcctcccccaaagccatccccgacaaggcgacaaacaacctctccggcggccgaagccgatagaggcgaactccggcgaaggcgctcccaagcgcaaccctctcccgtccgcgctcgtttccaacctcgagtccgtgctcgccgcgcgccgcccgcccccggccgaggaggtcggaaccgccgccgcatccggcgaggcggaggctcccgatgccccgctgaccgatggggcgccgtcgaggcccgtcgttctgctgacctgcgccggggggatccggtcggcgggtctcgcggcgctcatcgacgccctcgtcgccggcggccgctgcgacgtccacgtgtgcgcccccgaatcggacaagccagcctgcggccactcaattaccgtccgtgagaccgtcactgcgacatccgtggatttcaaaggggctaaagcttttgagatatccggcacaccggttgactgtgtctcattggcattatctgggaggctgtttccttggtctgcacctgctttggtgatcagtggtattaacgcgggaccaaattgtggatatgagatgttccactcgtctgccattgctgctgcaagggaggccttagtgtatggggtgccttcaattgcagtttcattgaattggaagaaggatgaaagcaaagacagcgacttcaaggatgcagctcaggcctgtttgccattgatacatgctgccttggctgacattgagaaaggaaatttcgtcaaaggttgcctactgaatattgggattccaagctcaccctctgcaaacaagggtttcaagttgaccaaacagagtggatacagtcctgctcaaagttggcaagctgtatcaacaaacaggccttcatctgctgcacactttatgggcatgcatcaaagcctcggtattcagttggcacagcttgggaaggatgcatctgcagcaggagctgcacggagagttagtgctcagcgaaagacagtcgaggttgagtctgttgcagctgctggtaaacaagaggcacgtgaagtagtgaagaagttattccgtgctgagtttgtcgagaagcaacatgaagatttagatgaagatatcgatttaagggctatggagaatggatttatatctgtcactcctctgaatatacatgggcaagtggaggctgacattggagccccagtttcagattgtctctcagcagttgtatctctaggcaaagaaaaggaagctgctccagctacagctgaccaacaaattgctgctgaggaaaaagaagacccgtcagcagcctaacaaacatgtacacactccataggtgtcttagttcttgcagtgatggtggtcttttatctcttctctttattgggtttgatttgtttagccttttgcgcttgatattgttcagtgcaatttcaattttttttgttcatctttctgccaattgccggcttccttggccgtgcaaaatgatttgatgcagatgcctctacattttggatgtaacagatgaatactgcccagcccccactattttttcagtgtggtttgttctaggaaggtgttttattcagcatgggatatgtggttgattttgtcttgttcccgtctgaacgatggctgccaaaattggccgcttgtaacttgaaatgctgttgcagccattcaatgtggtaatgtcatcctgacttttgtgg

SEQ ID NO: 11162 - protein, 444 aa, Panicum virgatum
  misc_feature: Ceres CLONE 1726493
  misc_feature (95)..(292): Pfam Name: SurE Pfam Description: Survival protein SurE
  misc_feature: SWISSPROT Homolog: EC 3.1.3.5 5'-nucleotidase
SLRPYTSPSPFPPLLPQSHPRQGDKQPLRRPKPIEANSGEGAPKRNPLPSALVSNLESVLAARRPPPAEEVGTAAASGEAEAPDAPLTDGAPSRPVVLLTCAGGIRSAGLAALIDALVAGGRCDVHVCAPESDKPACGHSITVRETVTATSVDFKGAKAFEISGTPVDCVSLALSGRLFPWSAPALVISGINAGPNCGYEMFHSSAIAAAREALVYGVPSIAVSLNWKKDESKDSDFKDAAQACLPLIHAALADIEKGNFVKGCLLNIGIPSSPSANKGFKLTKQSGYSPAQSWQAVSTNRPSSAAHFMGMHQSLGIQLAQLGKDASAAGAARRVSAQRKTVEVESVAAAGKQEAREVVKKLFRAEFVEKQHEDLDEDIDLRAMENGFISVTPLNIHGQVEADIGAPVSDCLSAVVSLGKEKEAAPATADQQIAAEEKEDPSAA

SEQ ID NO: 11163 - DNA, 936 bp, Panicum virgatum
  misc_feature: Ceres CLONE 1726497
  misc_feature: Encodes the peptide sequence at SEQ ID NO. 11164
ttcgtctctcattttccgcgctcgcgcgctcccgccacacacaccccccaaccttcctcgcttctccagactctagcctcgccaaggcttcctgatcaggttgggagcgcaggagaggagcttggaaggatggcgtcggtttccagggctgtctgcggcgtgcagatgccgtgcttgaacggcagggaggcgcccgccggccgccgatcggtcgcggcgccgaaggcccggaacgccaagcggggcgtcatccgctccgtgtcggtctccggctccgtctccggccgcggccagcattgcgcgcctgccgacgccgtcgccgacgccgcgccaattacagcgacaaagagggtgttccccttcggcaagggcaagagcgagggcaacaggggcatgaaggatctgctgggcgggaagggcgcgaacctggcggagatgtcgagcatcgggctgtcggtgccgccggggttcacggtgtcgacggaggcgtgccagcagtaccaggaggccgggcgcgcgctgccggcggggctctgggcggagatcctcgacggcctggcgtaggtggaggagtacatgggcgcgcgcctcggcgacccgcagcgcccgctcctgctctccgtccgctccggcgccgcggtgtcgatgcccggcatgatggacacggtgctcaacctggggctcaacgacgaggtggccgccggcctggccgccaagagcggcgagcgcttcgcctacgactcataccgccgcttcctcgacatgttcggcaacgtcgtcatggacattccccatgcactgttcgaggagaagcttgagcacatgaaggaagccaagggggtggagcttgacaatgacctgactgccgctgacctcaaagagctggtggctcagtacaaggatgtctacgtccaggccaaggggggagccattccc

SEQ ID NO: 11164 - protein, 119 aa, Panicum virgatum
  misc_feature: Ceres CLONE 1726497
  misc_feature: SWISSPROT Homolog: EC 2.7.9.1 Pyruvate, phosphate dikinase
MGARLGDPQRPLLLSVRSGAAVSMPGMMDTVLNLGLNDEVAAGLAAKSGERFAYDSYRRFLDMFGNVVMDIPHALFEEKLEHMKEAKGVELDNDLTAADLKELVAQYKDVYVQAKGGAI

SEQ ID NO: 11165 - DNA, 715 bp, Panicum virgatum
  misc_feature: Ceres CLONE 1726497-R
  misc_feature: Encodes the peptide sequence at SEQ ID NO. 11166
ccattgagtacaaaattggaactatgattgaaattcccagggcagctctagtggctgatgagatagcagagcaggctgaattcttctcttttgggacgaacgaccttacacagatgacgtttggctacagcagggatgatgtggggaagtttctccccatttatctttctcagggtatcctccaacatgatccctttgaggtgcttgatcagagaggagtgggcgagctggttaagtttgctacagagaggggacgcaaaactaggcctaacctgaaggtgggcatctgtggagaacatggtggggagcctcagtcagttgctttcttcgcaaaggctgggctggattatgtttcttgctcccctttcagggttccgattgctaggctggctgcagctcaggtgctcatctgagagcacctcctcatcggcaaccggatcgccagctcttggtgcatctggtgaagaataatcatacaggtccatgaaacggtggaaactctgctttctggcaaaggctgttgtatgtagtcttctctgtgtgcgcgcgcatgtaagccttaatgggtggtgttctgaatttcccttgaactggcatggtaatgtagtaccaaattaaacagcgatgatgacgaagagctatcgaatatattggcgattactagtgctgtcaatttgcttccttgtatgagttgctaatggaagtgatgcatttc

SEQ ID NO: 11166 - protein, 136 aa, Panicum virgatum
  misc_feature: Ceres CLONE 1726497-R
  misc_feature (1)..(136): Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
IEYKIGTMIEIPRAALVADEIAEQAEFFSFGTNDLTQMTFGYSRDDVGKFLPIYLSQGILQHDPFEVLDQRGVGELVKFATERGRKTRPNLKVGICGEHGGEPQSVAFFAKAGLDYVSCSPFRVPIARLAAAQVLI

SEQ ID NO: 11167 - DNA, 2022 bp, Panicum virgatum
  misc_feature: Ceres CLONE 1726503
  misc_feature: Encodes the peptide sequence at SEQ ID NO. 11168
agaagtcgaacaggatatagatctcagcaagccagggatgagggcgagccagctgaggccaagcttgtgctctcgtgggcgaggctgaccttcttgctcctccagttcatcgatgcgccgcctccgcctcgactcgccggatcaacggagctccatggctgccgtccagcgcggtgctgcggattgagtgggaggaatctctcgcccgctccttttttctgggagcgaggaagtgagggtaggtgctttgggatacagataggagcagcgctgggatttacgattctggaatgggttcatttgggatggattggaaccagaagggttctgtgttgtgggattgggagaatttaccgctgataggcacaagtggtaacgagagcgcaaagatgattgcgactcaggctgaggccaagttttcagccgctgaggtcacaaggcatggatcagtgcattcttcctgtggtactttctcttccaactcggagatggggtatggctcatctaagagctccatatccgcgtcgattgattcttcgcccaaggtggggaagaacatggagctcaattttgcacctgccagagtgtctgacaagaacactgttttggtaaaggttgatgatgccagaacctccccatcatcagtgatagccgtaagcagtggagagctggtgcttagcctgaaacttggcaagagaacctattttgaagatgtctgtggagggcagagtgtcaagagttctccgtcggatacgagtacagtgactcctcctgctttggtgaagaaggcaaaggcagctcaaaacgcacagaacacatactgtcaggttgaaggttgcaagattgatctctcttctgctaaagattaccatcgaaagcacaaagtctgtgaagctcactctaaggctccaaaggtggttgttgctggtctggagcggcgattttgtcaacagtgtagccggttccatggtttaaatctcttcgaccagaaaaaacgaagctgccgcaggcgtctcaatgatcacaatgcccgcagacggaagccacagcctgaagcaatttcttttggttcatcaaggctctctgcaatgttctatgatgcaaggcaacagacaactcttcattttggtcaagttccttatggtcaaatgagaagctgtacaagttcttcatgggataacccaggaggagccttcaaatttgcagaaactaaagctccttggttaaagccagcaagagctgctggtattgatggcttgcatctatcaagtcagcaggtatggaacaacattatgccacatggtggacatcaagattttgatgggttcatgggtttcaatggaaccagtgcaaagatcctcaatcaaggcgatgaagcttctgcgtccgtctccaactcaaatggaaatccggaccttcagcgtgctctctctcttctgtcaaacaattcggctggtgctggcaacaaccacccgaccactcagctgcaccctggcctgagcaccctcgccagcacctccaacgcagtgatgcaagcttcatcaccagggctctggcaagacggcacagcgcttgatcttcatgcgcggtttcaggctctcgatccccttggcagtggcagcgccatcccaacaactcatgaggtccagctcccaaaaccgtccttattcgacgactcctcttcccactatgacctgatgcactgatgcttccttcggttcgtgcctccattgccccggttccgaggaagcggacttggtttcctgatgtccgaaactctgaattttggattgttacgatgtcctgaaaaaaaataaaggccgcacaaaactgaggctcgagttaatccagatttgagcctcgttgccatgagaattcctgtgtcagtagctctgtgcttgaataatccatacttgtgattctgtttatgcaacttgattgcttcagcaaagtgaccatggacgattttgttctgatgctaaattctcaatgccatgaatggaattgtctaaaaaaaaagcc

SEQ ID NO: 11168 - protein, 471 aa, Panicum virgatum
  misc_feature: Ceres CLONE 1726503
  misc_feature (177)..(255): Pfam Name: SBP Pfam Description: SBP domain
MGSFGMDWNQKGSVLWDWENLPLIGTSGNESAKMIATQAEAKFSAAEVTRHGSVHSSCGTFSSNSEMGYGSSKSSISASIDSSPKVGKNMELNFAPARVSDKNTVLVKVDDARTSPSSVIAVSSGELVLSLKLGKRTYFEDVCGGQSVKSSPSDTSTVTPPALVKKAKAAQNAQNTYCQVEGCKIDLSSAKDYHRKHKVCEAHSKAPKVVVAGLERRFCQQCSRFHGLNLFDQKKRSCRRRLNDHNARRRKPQPEAISFGSSRLSAMFYDARQQTTLHFGQVPYGQMRSCTSSSWDNPGGAFKFAETKAPWLKPARAAGIDGLHLSSQQVWNNIMPHGGHQDFDGFMGFNGTSAKILNQGDEASASVSNSNGNPDLQRALSLLSNNSAGAGNNHPTTQLHPGLSTLASTSNAVMQASSPGLWQDGTALDLHARFQALDPLGSGSAIPTTHEVQLPKPSLFDDSSSHYDLMH

SEQ ID NO: 11169 - DNA, 2182 bp, Panicum virgatum
  misc_feature: Ceres CLONE 1726511
  misc_feature: Encodes the peptide sequence at SEQ ID NO. 11170
aacctgagcacctaccccgctgccgccgccgctgccgccgacgggtcgcctcctgctccgcggtgaatacattgctgaagatggggaaaggggggaaggagaaggagaagaagtcgctggacatcctcgcggggtccgacgaggactccgacagcggcggcgaggacctctcgaagatccagatcaacgaggagtacgctcgccgcttcgagcacaacaagcggcgggaggcactgcagcgctacgaggagctcaagaagaagggcctcgcccccgcgtctgatgacgaaagcgacgacaacgaggagtcgtccgaagaggaggaggacgaggacgccatcgcctcgcgccgcgtcgaccgacgcgtgttcgaggtgatccgccgcatccgcagcggcgacccccgcatcctcgacaaagacgccaaggtttactcctcggaggaggagggcaaagaggagaagaaagaagagcccaagcagaaaaagaaggctaagaaggagaagcctctatacctcaaggacgtcaacgcccgacacctgctcgaggagggccctgagttcacagctcagaccagccggagtagcaggtacgataggatcgcctacgatgagcagcagaagaagggtctgcaggctttccttgaggcagagaaggaggttttaggtgatgacgacgacgacgatgatttgttccatgagaagccgaaggctggagcaggcgccgatgacgaggaggatgaagaggaaaatgagacgaaggagctagctggtgaggtttttgggaaggatgaggagctggacgagaacgagaggttcttgaaggaatttttccttaagaggccatacctcgagtcagggaaggagaagaagtcctatctggatgatatgcaggaattgtcggacgtagaagagatcaatgaacaggaaatatacgagcatgtttacaatttccggcatgaggaggctgaagcatcaggggcagtggtggcagaccgggtaatggggcattcaagggttgttgaagggtctgtgaggaagaaggagagcagcaggaagcagcagcggaagagcaaggaggagaggatagcccgagctaagcaagagcaagctgaggagttgaagcatctcaagaatctgaagaagaaagagattgcagagaagcttgagaggatccggatgattgccgggattgaaggcgatgctgcatgtaagcttggtgctgatgacctggaggaggattttgatccagaggattatgacaagaaaatgcaagagatgtttgatgactgttattatgaggctgatgatgttgatcctgagtttggaagtgacgaggagatggatttggagaagccagattttgacaaggaggatgaattacttgggcttcctaaaggctgggctagtgaaaaagataaagaagagtctagtgccacagatgggaaagctacaaaagggaagatctctctcaaggacaaggtcgagcttgagaaagagatggaagagtactacaagttggactatgaggacactattggagatctgaagactcgattcaagtataagaaggttaatcctaacagttttggtctgagtacctacgacatattggcatctgatgacatggatctgaaccagtatgtttccatgaagaagctagctccttacagggagagtgaatggaaggtaacacatcataagaagttgagcaaggacttgatccttggaggccagaagaaagaagggaagaaggacaaatctggcaagaaatctaagtctgctgaaggtggctctagttcttcaaaaccagagaaagacaagctgccaattgaacaagagtcaactgatgacaagaaaaagtctaccagaagcagcagaaggaagcgccgtaatgaggatctgaagatacccagtggtcgtctagaggcatatggaaagataaattcaaagcgtcacaagagccattgagctttggagattcatcaaagtacatctagggaattttgcttttctttttatgcattttggaagggctgaaatcttatttgagaggctttgcttcttctttgggagttgcaaaccagtgtcgtcctagtagaattatttctctgaattttgcagacagtgttgtgcacctccttttgtgaaccatatagtttaattgccttgaagtttgctgc

SEQ ID NO: 11170 - protein, 629 aa, Panicum virgatum
  misc_feature: Ceres CLONE 1726511
  misc_feature (379)..(560): Pfam Name: Krr1 Pfam Description: Krr1 family
MGKGGKEKEKKSLDILAGSDEDSDSGGEDLSKIQINEEYARRFEHNKRREALQRYEELKKKGLAPASDDESDDNEESSEEEEDEDAIASRRVDRRVFEVIRRIRSGDPRILDKDAKVYSSEEEGKEEKKEEPKQKKKAKKEKPLYLKDVNARHLLEEGPEFTAQTSRSSRYDRIAYDEQQKKGLQAFLEAEKEVLGDDDDDDDLFHEKPKAGAGADDEEDEEENETKELAGEVFGKDEELDENERFLKEFFLKRPYLESGKEKKSYLDDMQELSDVEEINEQEIYEHVYNFRHEEAEASGAVVADRVMGHSRVVEGSVRKKESSRKQQRKSKEERIARAKQEQAEELKHLKNLKKKEIAEKLERIRMIAGIEGDAACKLGADDLEEDFDPEDYDKKMQEMFDDCYYEADDVDPEFGSDEEMDLEKPDFDKEDELLGLPKGWASEKDKEESSATDGKATKGKISLKDKVELEKEMEEYYKLDYEDTIGDLKTRFKYKKVNPNSFGLSTYDILASDDMDLNQYVSMKKLAPYRESEWKVTHHKKLSKDLILGGQKKEGKKDKSGKKSKSAEGGSSSSKPEKDKLPIEQESTDDKKKSTRSSRRKRRNEDLKIPSGRLEAYGKINSKRHKSH

SEQ ID NO: 11171 - DNA, 1687 bp, Panicum virgatum
  misc_feature: Ceres CLONE 1726513
  misc_feature: Encodes the peptide sequence at SEQ ID NO. 11172
gcaagccgccagccgccacggcatggcctcggcctcactcttcgccgcggcacgccgcctgctccgcctcggcggccggggccgcagctggatccccccatctcgcgccgccgcttcctcgtctcgcaccaacagcgaggagaagcgaccgctgccggcgcggccacggagcctgcagtccacgctgtggccgctgggccacccgggcacgctcctggtgccggagatcgaactgtgggcggcgcggcccggaaatcgcttccgtgccgttgagctccagcgcatcgtcaaggagctccgcaggcggcgccgcccccgccaggccctcgaggtctccgaatggatgaaccttaagggtcacgtcaaattcctgcctaaggatcatgcaattcacctagatttgattggtgaagttcatggagttggagcagcagagacctacttcaataacctgtctgacaatgataagaaagagaaaccttatggtgcacttctgaactgctacgtacgagagctccttgtcgacaaagcattggcccattttcagaagatgaaagagctgggctttttattctccccactcccctacaacaacctcatgagcctctacaccaacctggggcagcatgagaaggtcccttcggtgatggcagaaatgaaaagcaacgggattattcctgaccaatttagctacagaatatgcattaattcgtatggtgtgaaagcagatttttttggtctggagaacaccctggaggagatggagtgtgagcctcaaattactgttgactggaatacctatgctgttgtggcgaataactacattaagggaaacctaagagataaggcatactctgcattacagaaagcagagtcaaaaatagataaaggaaattcggattgctataaccatctgatatccttgtacggtcacctgggggacaaatcagaggtcaagaggctgtgggcgctccaaatgttgaattgcaagaggcatattaatagggactacacctcaatgcttgttgtactcatgaagcttgatgaggtcgcagaagctgaagctctgttgaaagagtgggagtctagtaaaaatgcattcgacttccaagttccaaatgtcctgctcaccgggtaccgcctgaaggacttgctggacaaggctgagacactgctcaacgacttcttgaaaaagggaaaggtgcctacttcaaccagctgggccatcgtggcaattggctatgcagagaaaggtaatgttgcgaaagcttatgagctgatgaagaaagccctccgtgtatacaccccaaatagtggctggatccctagtgcttcaatgattgagatgatacttaaatatcttggagatgaaggagcgctcaaggatgttgaaacttttgttgatctgctgaaagttgctgtgccattgaactcggatatgaccgaggctctgtcaagggctcgtgctagagaagaaaaggaggttgcggagacaaatgcatgaggctgttgttgctcgggctcttgattgttaacgagatggagctttagttctgctgctgttgccctcctttcaaactgctaggcgttctacttggaaataattatgtcagttttagaatttctctaggtcatatgactttgtagggtggcactattgacttatgtgaagtatttttttaatcgg

SEQ ID NO: 11172 - protein, 493 aa, Panicum virgatum
  misc_feature: Ceres CLONE 1726513
  misc_feature (187)..(221): Pfam Name: PPR Pfam Description: PPR repeat
  misc_feature (152)..(186): Pfam Name: PPR Pfam Description: PPR repeat
MASASLFAAARRLLRLGGRGRSWIPPSRAAASSSRTNSEEKRPLPARPRSLQSTLWPLGHPGTLLVPEIELWAARPGNRFRAVELQRIVKELRRRRRPRQALEVSEWMNLKGHVKFLPKDHAIHLDLIGEVHGVGAAETYFNNLSDNDKKEKPYGALLNCYVRELLVDKALAHFQKMKELGFLFSPLPYNNLMSLYTNLGQHEKVPSVMAEMKSNGIIPDQFSYRICINSYGVKADFFGLENTLEEMECEPQITVDWNTYAVVANNYIKGNLRDKAYSALQKAESKIDKGNSDCYNHLISLYGHLGDKSEVKRLWALQMLNCKRHINRDYTSMLVVLMKLDEVAEAEALLKEWESSKNAFDFQVPNVLLTGYRLKDLLDKAETLLNDFLKKGKVPTSTSWAIVAIGYAEKGNVAKAYELMKKALRVYTPNSGWIPSASMIEMILKYLGDEGALKDVETFVDLLKVAVPLNSDMTEALSRARAREEKEVAETNA

SEQ ID NO: 11173 - DNA, 1689 bp, Panicum virgatum
  misc_feature: Ceres CLONE 1726519
  misc_feature: Encodes the peptide sequence at SEQ ID NO. 11174
ccattaatgagccagtcagcttgtctaaaaaaaaaatgagctagtcagctagaccgaccccacggctcaccccaccaccaccaccaccctcgctcgcaggcaggcagccatgaatcatgattctatctccttccaacccagcggagcagcgaaaggatgacaccactagccaaataaacccaggcgtcctaccgcttctagctccctccctgcggccggccgaggagctaggaggaatccagcagggagcgccacgcgcggccgcctcgcgtaggggttttagttggtcatctttgttcctgatggggaattgcgccggcgtggaggggaacgccgagatcaacccttccttcagtgcccccaattcgtcagggaccggttctaagaacagcagcaagaatgcaaccgacaccagcacctttggtaccaagacatccggctcttcatcgtcggtgccacctactcctcgtacggagacagaaattctggaatcatcaaatgtccgaaagttcaccttcagtgagctgaaaggctccacaaggaacttcagaccggacagccttctcggggagggaggctttggctcggtgttcaagggatggatggatgagcgcacgcttgcacctgtgaaaccaggcactgggatgattgtcgcagtgaagaagcttaagctcgacagcttccaagggcacagagaatggctggctgaggtaaattacctagggcagttgtcccaccctaatcttgtgaaacttattgggtactgcttggaggatgaacaacggcttcttgtgtatgagtacatgccaagagggagcttagagcatcatcttttcaggagagggtcgaactaccaaccgctcccatggaacttacggatgaaagttgcacttgaggcggccagaggccttgctttcctgcacggcgaccaggctaaagttatctaccgtgatttcaagacctccaatattcttctcgactcggagtacaatgcaaaattgtctgatttcggtttggcaaaagatggtccaagtggtgataaaagtcatgtctctactagggtcatggggacacaaggatatgctgcccctgaatatcttgcaacaggccatttgaccgcgaagagcgatgtgtacagctacggtgttgttcttctggagttgttgtctgggcagcgtgctctggacaagaaccgcccacctggccagcacaacctggtggagtgggctaggccttacatcaccaacaagaggagggtgatccatgtcttggactcgcggttgggttcccagtattcccttcccgcggcgcagaagactgcagccctagcactgcaatgcttgtcgatggacgcacgatgcaggcctggcatggatcaggttgtgaccgtgttggaaggccttcaagacaccaagagtgcagtgagatctggcaagtaggagaatggctagttacggttggtcttgcctctctgaaggatcgtcgtcttgtagtactccaatggagtaaaacggtgaacggatgagggatttcaggggcaacttgcttctgaagagtgtataatattaatatatcttgctttgtgtatagctagctgcttcgttggtgcaactttttctctacatatgtatattttagccgtccacttgtgttgtatcaagttcaaaaacagttctttttgttgggtcc

SEQ ID NO: 11174 - protein, 378 aa, Panicum virgatum
  misc_feature: Ceres CLONE 1726519
  misc_feature (82)..(364): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated drought sensitivity
  misc_feature: Useful for making plants with modulated heat sensitivity
MGNCAGVEGNAEINPSFSAPNSSGTGSKNSSKNATDTSTFGTKTSGSSSSVPPTPRTETEILESSNVRKFTFSELKGSTRNFRPDSLLGEGGFGSVFKGWMDERTLAPVKPGTGMIVAVKKLKLDSFQGHREWLAEVNYLGQLSHPNLVKLIGYCLEDEQRLLVYEYMPRGSLEHHLFRRGSNYQPLPWNLRMKVALEAARGLAFLHGDQAKVIYRDFKTSNILLDSEYNAKLSDFGLAKDGPSGDKSHVSTRVMGTQGYAAPEYLATGHLTAKSDVYSYGVVLLELLSGQRALDKNRPPGQHNLVEWARPYITNKRRVIHVLDSRLGSQYSLPAAQKTAALALQCLSMDARCRPGMDQVVTVLEGLQDTKSAVRSGK

SEQ ID NO: 11175 - DNA, 1685 bp, Panicum virgatum
  misc_feature: Ceres CLONE 1726520
  misc_feature: Encodes the peptide sequence at SEQ ID NO. 11176
agaccaccaggcaacctcccctcccctcccctcccgagtcgccgtcgcctccgcctccccctcatccccgcgccgcctcagcggtttaatcttcacccgcagtcatgggtaaggagaagtcccacatcaacatcgtggtcattggccacgtcgactccggcaagtcgaccaccaccggccacctgatctacaagcttggaggtatcgacaagcgtgtgatcgagaggtttgagaaggaggctgcggagatgaacaagaggtccttcaagtacgcctgggtgcttgacaagctcaaggccgagcgtgagagaggtatcaccattgatatcgccctgtggaagttcgagaccaccaagtactactgcacggtcattgatgcccctggacaccgtgacttcatcaagaacatgatcacgggtacctcccaggctgactgtgctgtccttatcattgactccaccactggtggttttgaggccggtatctccaaggatggccagacccgtgagcatgctctccttgctttcactcttggagtcaagcagatgatctgctgctgtaacaagatggatgccaccacccccaaatactccaaggctcgttatgatgagattgttaaggaagtctcctcctacctgaagaaggtgggctacaaccctgacaagattgccttcgttcccatctctggttttgagggtgacaacatgatagagaggtccaccaaccttgattggtacaagggcccaaccctgcttgaggctcttgaccagatcaacgagcccaagaggccttcggacaagcccctgcgtctcccccttcaggatgtgtacaagattggtggtattggaactgtccctgttggccgtgttgagacaggtatcatcaagcctggtatggttgttacctttggccccagtggcctgactactgaggtgaagtcagttgagatgcaccacgaggctctccaggaggcccttcctggtgacaatgttggcttcaacgtgaagaacgttgctgtgaaggatctgaagcgtgggtatgtggcctccaactccaaggatgaccctgccaaggaggctgccagcttcacctcccaggtcatcatcatgaaccaccctggacagatcggcaacggctatgccccagtgctggactgccacacctcccacattgctgtcaagtttgctgagctcattaccaagatcgacaggcgatctggtaaggagcttgagaaggagcccaagttcctcaagaatggtgatgctggtatggtcaagatggttcccacgaagcccatggttgtggagacattctctgagtaccctcctcttggtcgctttgccgtccgtgacatgagacaaacagttgctgttggagtcatcaagagtgtggagaagaaggacccgaccggcgccaaggtgaccaaggctgctgccaagaagaaatgatgtctggttgaatctgtgtcttcttttgggatacctagatgatctattatcatggcttacttttgtctattgccatttctgttattgtattgtgtgaactgttattttgctggtaaaatgcgtctttgggttcaattcctgtttttgtaattttggcttcgggaaaactggaatgcttggactgattagtgccattatcaaccatgaatctgagtctatatctcttcgtattgctat

SEQ ID NO: 11176 - protein, 447 aa, Panicum virgatum
  misc_feature: Ceres CLONE 1726520
  misc_feature (5)..(225): Pfam Name: GTP_EFTU Pfam Description: Elongation factor Tu GTP binding domain
  misc_feature (322)..(430): Pfam Name: GTP_EFTU_D3 Pfam Description: Elongation factor Tu C-terminal domain
  misc_feature (248)..(315): Pfam Name: GTP_EFTU_D2 Pfam Description: Elongation factor Tu domain 2
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 11177 - DNA, 763 bp, Panicum virgatum
  misc_feature: Ceres CLONE 1726521-R
  misc_feature: Encodes the peptide sequence at SEQ ID NO. 11178
caagaggaatcaagcaacccaagttctggtgtatcagctgcggattactttcttggtcctggcttagatattctgttgcagcgtttggcagagagtgatctcaatcgttctggcacaccacctgccaagaaggaggctgtagctgcattgccatctgtgaacatcaaggaagtgttgggttgttcagtctgtcttgaggattttgagatgggagcagaagcaaagcagatgccctgtcagcataaattccactctcagtgcatccttccatggctggagcttcacagttcttgcccaatctgtcgatttcagttgcctactgaggagacgaagaacccatgtgaatcagccagcagtgccggggccatgaacggcaatggagacaatgttgctgcaagcagtagtgatacagaaagtactacccgtaatggagacaaccattcagatagtcctatcttctctgctttgagcgcactcttctctgatccatcctcatcatctgatgatgaaagtgctccacactcttctgagacctgaagacaccgctggatgcaggcttgcagtacggtgaaggtgatctgaaatgtgagactggcatctttatattgtagtttctgactttctgtacatatctctgaattggcgcccccagaagacaagatattctatcctcttttctgaaaactatgtggcttgtaacgtgctagtgcttgctatgtttacttatcctaaataaaagttagcctctagtgtgcttaccgtc

SEQ ID NO: 11178 - protein, 178 aa, Panicum virgatum
  misc_feature: Ceres CLONE 1726521-R
  misc_feature (61)..(101): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature: The sequence is a functional homolog of SEQ ID NO 1722 in the 11/479,226 US patent application
QEESSNPSSGVSAADYFLGPGLDILLQRLAESDLNRSGTPPAKKEAVAALPSVNIKEVLGCSVCLEDFEMGAEAKQMPCQHKFHSQCILPWLELHSSCPICRFQLPTEETKNPCESASSAGAMNGNGDNVAASSSDTESTTRNGDNHSDSPIFSALSALFSDPSSSSDDESAPHSSET

SEQ ID NO: 11179 - DNA, 734 bp, Panicum virgatum
  misc_feature: Ceres CLONE 1726521
gtcctgccactcccaactgctcctcgacgccgggcacgccgcgcagggaggaatcatggcctgaagcgaaatcccgcgccgcgacgctgcgaggataactttctcaggccagggaaggaagacatctccttgacgcgatagagcttttgatggttgctataagtattcaggggtgaattaggactgcaagatactactgaagcgaaacagatagtgtcaacagagtttgtttcaagatggatgaaggccaggaagttaggtattggtgccacatgtgtgaggaggtgatcgatcctatgccggaaatgaagtgccctagctgtgagggtgggtttgtggaagagatggactctgaaggctttgaaccagctacaaacacgaggtctgatcgctccctctctgctttggctccgctgctttttggtatgctggggggttcgtcgcgcagatcaagactcaggagggaggccatggaggatgttgatgctgatgaggatgaggatgaggatgattcagaccgtgagctcgaactattcaattggaggcggcgaaggaggacgccctcagcatcacttgtcaggctgattcaaactatacgtgatgacatgaggggcgtggatgacactgacagtgatacagagagagatatggagagagaaagaagggagagacaggctgtggagaggaggatggagaggcagagggcagagaggcaggctgtggagaggagggcg

SEQ ID NO: 11180 - DNA, 2272 bp, Panicum virgatum
  misc_feature: Ceres CLONE 1726524
  misc_feature: Encodes the peptide sequence at SEQ ID NO. 11181
tccggcgagggcgtgatggaccctggccgaggccccgctgagcgcccgccgtcgctcgccgcctcaccttgtaagaagcgaaaggttgctggtgcacattctcatggttctttggactccccaaacttgatcatagggattggtttcgccaagagcaatgaatgtacagggaaaatctccaacaagaatttgcatgtaattggggacactccaaacccatatgagcaggttatttccgccatagggagaactctgtcaccatttgatgaggagaagcttatactatgctttggatttggcgatgaaagcactcgtgaccattcagtatttagcttctatagtgataaccagccctgttgtggttttaaacaagcacttgctcgctacagggaacttgttccgcaacttagttttgctggtccaacttcatttgcacctatcatcgaaactgttataggaattgttgagaatagtggtggccagtatcatgtcctccttataattgcagatggacaggttacacgaaatattgaaactggaaatggacagttgagccctcaggaagaggagaccctagatgccattgttaaagctagtaattatcctctttcaattgtgcttatcgggatcggtgatggaccatgggacatgatgagccgatttgatgacaacataccttatcgtgcatttgataattttcagtttgtgagcttcacagagcagatgttgaaatcatcatccagcaaaaaggaaggagactttgctctttccacattgatgaagagtgcaggacattttgaggccgcatcgagcttccagcttgatggtgaacaaagaggattttcagatcgaaacgtgttacctccacctgtggctgatcagagacagtattctggatattcatccacctgcaataatgcatcagttcaaaaaatcgcatcagcggacagtgatatgtgtgatccactgactgctgagggtcataaagttaccagtgcgcacaggaatcccaagtttgtagaaattgataatgtccatcatcctgatttggaatcatatcttcacatgactgagagtccttcggaagaacttgaagacatagagtgcattgaagatcgacatggttgcagattgaagcaagaaatttgttcaaatgataacggagatatttccagtacatctgacaagacaattgtgaattggctttcactcccacccggtgtggtgtggcgcatttggggttcactttgcaatgattctgatcgccaaaagatgcactttgtctctaaggagtggtataaggagatacctgaagttatggcccgacgcccttgggtaattgggtctggtacgattcatggaatcttccattctattaatgggaagagtctgtcgcaaatgaagttcaggtgtgaaataccagatgggtctttctatagtagctgttcaagctttctcgtgatgcagacagacaacgaacattttttgtggagccctagcaacaggatgtctctgaaactgccactaaagacatacgagaagattgtaatgcatgaagactctgattcttacgcctttgcctactccagtggtaaggtcaaattttcctatggaagaccccaagttgagtcaagctggaagcagatattgtgctatgacaaatctatcggagatatttgccagtgtgataatgaatattatgctgtcagtaacatgtttcgcctctactggctggatcaaaagagcagtaagcttgaacttattggacccgagcaaacgtcaaatgacatcaagaaattactgctggatggaaattttccagaccacctcttcctcgctgatgtaaatcatgagctggtgattgtcgcagttggccgaaatctgcggtctgtggacttgttcaaggttctctggatcagtgaccgaatgacaagtttggtaagggtcccggaccttggtatttggtcattgtttctcggcagaaaccaagcaattgcattaagtgctgacgacttccctggtattagtccaagcactttgtaccttgctttagatccgctgatggatgatgaggagcctaccgtgcagttgtacaatcttgcgacaagaagtgttgtagatacaggctatccggtccacaagctaggttccccctttttttaccaacctgatatagtttcagcatctgtattgtatgagtgatttgtcagaacactcctgttgatcattacatgttaaacaccggataaaattcatctaatgcatcttgttt

SEQ ID NO: 11181 - protein, 733 aa, Panicum virgatum
  misc_feature: Ceres CLONE 1726524
  misc_feature (63)..(211): Pfam Name: Copine Pfam Description: Copine
SGEGVMDPGRGPAERPPSLAASPCKKRKVAGAHSHGSLDSPNLIIGIGFAKSNECTGKISNKNLHVIGDTPNPYEQVISAIGRTLSPFDEEKLILCFGFGDESTRDHSVFSFYSDNQPCCGFKQALARYRELVPQLSFAGPTSFAPIIETVIGIVENSGGQYHVLLIIADGQVTRNIETGNGQLSPQEEETLDAIVKASNYPLSIVLIGIGDGPWDMMSRFDDNIPYRAFDNFQFVSFTEQMLKSSSSKKEGDFALSTLMKSAGHFEAASSFQLDGEQRGFSDRNVLPPPVADQRQYSGYSSTCNNASVQKIASADSDMCDPLTAEGHKVTSAHRNPKFVEIDNVHHPDLESYLHMTESPSEELEDIECIEDRHGCRLKQEICSNDNGDISSTSDKTIVNWLSLPPGVVWRIWGSLCNDSDRQKMHFVSKEWYKEIPEVMARRPWVIGSGTIHGIFHSINGKSLSQMKFRCEIPDGSFYSSCSSFLVMQTDNEHFLWSPSNRMSLKLPLKTYEKIVMHEDSDSYAFAYSSGKVKFSYGRPQVESSWKQILCYDKSIGDICQCDNEYYAVSNMFRLYWLDQKSSKLELIGPEQTSNDIKKLLLDGNFPDHLFLADVNHELVIVAVGRNLRSVDLFKVLWISDRMTSLVRVPDLGIWSLFLGRNQAIALSADDFPGISPSTLYLALDPLMDDEEPTVQLYNLATRSVVDTGYPVHKLGSPFFYQPDIVSASVLYE

SEQ ID NO: 11182 - DNA, 1156 bp, Panicum virgatum
  misc_feature: Ceres CLONE 1726528
  misc_feature: Encodes the peptide sequence at SEQ ID NO. 11183
agccagtactccagtatccacgaccacgcagcacctgcgactgcgagcacacagctgcttcggccccttctcagcgcgcgagcgttgcctgtgtgtgtgttgttcgtgagcaggcgcggcggcacggatggcgcagtccatgctcatatcgacgagcggcggcggcggccgcgcgctgccgtcgctgcaggccggccggccggcgccgtacccgcggctcgcgctgccgtctgcatacaggcactccaggtccgtctccgtgaagaccctggccctcttcggcaagtccaaggccgcgccggcgaagaaggctcctgcgcccaaaccgaaggttgaggacgggatcttcggcacgtccggcgggatcggtttcaccaaggagaacgagctgttcgtcggccgtgttgccatgcttggttttgccgcatccctactcggagaggccatcaccgggaagggcatccttgcccagctgaacctggagacgggcatccccatctacgaggcggagcccctcctcctcttcttcatcctcttcaccctcctcggcgccatcggcgctctcggagaccgcggcaccttcatcgacgacgccactggcctcgacaaggccgtcatcccacccggcaagggcttccgtggcgccctcggcctcagcgagggagggccgctgttcgggttcaccaagtcgaacgagctgttcgtggggcggctggcgcagctgggcgtggccttctctatcatcggcgagatcatcacggggaagggcgcgctggcgcagctcaacatcgagacgggcgtgcccatcaacgagatcgagccgctcgtgctcttcaacgtcctcttcttcttcatcgccgccatcaaccctggcaccggcaagttcatcatcggcgaggacgagaagtagagagagaccgagggaaatgatgcgcctggttgtttgtggttgatcgatcagtgcgtctctgcgcgtgtgcgtgcaactcgctgtgtattgcacgtgaggctttggaggttagggtgttgcgttgggttgtcttgtaaaacaagagcttatctaatatccaatgactgccggtgttctcttagagtaattaagatcttggttagttccgtttgaaaaagaatgaagacgattagacgagagacctgt

SEQ ID NO: 11183 - protein, 260 aa, Panicum virgatum
  misc_feature: Ceres CLONE 1726528
  misc_feature (62)..(209): Pfam Name: Chloroa_b-bind Pfam Description: Chlorophyll A-B binding protein
  misc_feature: Useful for making plants with modulated light quality response
  misc_feature: Useful for making plants with modulated nitrogen use efficiency
MAQSMLISTSGGGGRALPSLQAGRPAPYPRLALPSAYRHSRSVSVKTLALFGKSKAAPAKKAPAPKPKVEDGIFGTSGGIGFTKENELFVGRVAMLGFAASLLGEAITGKGILAQLNLETGIPIYEAEPLLLFFILFTLLGAIGALGDRGTFIDDATGLDKAVIPPGKGFRGALGLSEGGPLFGFTKSNELFVGRLAQLGVAFSIIGEIITGKGALAQLNIETGVPINEIEPLVLFNVLFFFIAAINPGTGKFIIGEDEK

SEQ ID NO: 11184 - DNA, 816 bp, Panicum virgatum
  misc_feature: Ceres CLONE 1726543-R
  misc_feature: Encodes the peptide sequence at SEQ ID NO. 11185
ggaattgattgctgtctcaatcactgctaccagccattgtggacttgcagaggataggcacgggagagtccggcttgcaataattgagtacatcccattgttggcaagtcagttaggtgttgggttttttgatgacaagttgggtgcactctgcatgcaatggttggaagataaggtcttctcaatcagagatgctgctgctaacaacttgaagcggcttgcagaggagtttggtcctgagtgggcgatgcaccatataattcctcaggtgctggaaaagataaacaactcacactacctgtatcgcatgacaattctgcaagctatctcattgttggcccctgtaatgggtggagaaatcacttgtcaaaagctgcttccagtcgtcattaattcctcaaaggacagggtccctaacatcaagttcaatgttgcaaaagtattgcagtcgcttataccaatcctcgatcaatctgttgtggaaaagaccgtgaggccttgccttgttgagctcagcgaggatcctgatgtggatgtaagatactatgcaaaccaggcactgcaggcgtgcgatcaaatgatggtgtcaagctaactagtctgatatttagtgctatattcttttagtccaattttggagtacctgtaatctggccttcagattgaagaaaagttccttctagcctcagtaacagatagaaactgccatgctgataaatggacggtcttgatcccttgttcattgtgttattaatgttgtaattgagcaagacacaacacgttattatgtgtgaatgtagattggactttgctttc

SEQ ID NO: 11185 - protein, 197 aa, Panicum virgatum
  misc_feature: Ceres CLONE 1726543-R
  misc_feature (158)..(194): Pfam Name: HEAT Pfam Description: HEAT repeat
ELIAVSITATSHCGLAEDRHGRVRLAIIEYIPLLASQLGVGFFDDKLGALCMQWLEDKVFSIRDAAANNLKRLAEEFGPEWAMHHIIPQVLEKINNSHYLYRMTILQAISLLAPVMGGEITCQKLLPVVINSSKDRVPNIKFNVAKVLQSLIPILDQSVVEKTVRPCLVELSEDPDVDVRYYANQALQACDQMMVSS

SEQ ID NO: 11186 - DNA, 814 bp, Panicum virgatum
  misc_feature: Ceres CLONE 1726543
attcccctcaccccgtctctctctctctctctctctctctctcagcggcgacgcctcgggagctcctagggcctgccccttctccggccgccatatccgccgccgcccgatccgagcccctcggagttcagaaatcctcgataaacctgatggctatgattgatgagcctctgtatcccattgctgtattgattgacgagcttaagaatgaggatatccaattgcgtctaaactcaatcagaagactttccacaattgctcgggcgcttggggaagaaagaaccagaaaggaactgattccatttcttagtgaaaacaatgacgatgaagatgaggtgcttcttgcaatggccgaggaattgggtgtgttcattccttatgttgggggtgtagaacatgctcatgttttgcttccaccattggagacattatgtacggtggaggaaacttgtgtccgcgataaggcagttgaatctctgtgccgcattggtgcacagatgaaggaaagtgacattgtcgactggttcattccagcagtaaagaggctagcagcaggtgagtggtttacagctcgggtatcatcctgtggtcttttccacatagcctatccaagtgcaccggaccaactgaaagcagaattgaggactatatatggtcagctatgtcaggatgacatgcctatggtcagaagagctgctgcatcaaatcttggaaagtttgctgccacagttgaacagagtcatctgaagacagaaataatgtctatatttgatgatctaacccaagatgatcaagattcagtgcgtttgttggc

SEQ ID NO: 11187 - DNA, 939 bp, Panicum virgatum
  misc_feature: Ceres CLONE 1726544
  misc_feature: Encodes the peptide sequence at SEQ ID NO. 11188
actctagacgtacccgccctctcacgcaacttcgcaaaaaagaggcctcgccttgttcattttcactcccagcatcggcgaaatttgacacgccaggccgccaggcgccagcacagaaaagggtaaaaaaccaccccagaaaaaaaaacccgaatcaaacgcgtcccctggaggccagaaatataacgaggaaggaaggggcgatagcggcgagggggacgaacaagcggccgcgcagaaatggcgtcgatgcagagctggcgcaaggcctacggcgccatcaaggacaccaccaccgtcagcctcgccaacctcaactccaacttcaaggatctggatgtggcgatcgtgaaggcgactaaccacgtggagtgcccgcccaaggagcgccacctgcgcaaagttgttgcggcgacgtccatcgccaggccacgggctgatgttgcctactgcatccacgctcttgcccgccgtcttgccaagacccgcaactggattgttgcactgaaaacacttgtagtgatccataggctacttcgcgagggcgatcctacatttcgagaagagcttcttaactttacacaaaggggacggattctacaactttcaaactttaaggatgattccagcccgattgcttgggattgttctgcttgggttcgcacatatggtttgtttttggaggaaaggttggaatgcttcagagttctgaagtatgatgtcgaagctgagcgtttgtccaaacagggtcaaggtcctgaaaagggacacagtagaactagagagttggattcacaggatctattagagcaactgccagcgttgcagcagtattatacagacttgtgggatgccggcctgaaggagctgcaataacaactacttggtgcatatgctctagctttggtgctaaaagaagcttcaaatttattgtgcgat

SEQ ID NO: 11188 - protein, 211 aa, Panicum virgatum
  misc_feature: Ceres CLONE 1726544
  misc_feature (29)..(211): Pfam Name: ANTH Pfam Description: ANTH domain
MASMQSWRKAYGAIKDTTTVSLANLNSNFKDLDVAIVKATNHVECPPKERHLRKVVAATSIARPRADVAYCIHALARRLAKTRNWIVALKTLVVIHRLLREGDPTFREELLNFTQRGRILQLSNFKDDSSPIAWDCSAWVRTYGLFLEERLECFRVLKYDVEAERLSKQGQGPEKGHSRTRELDSQDLLEQLPALQQYYTDLWDAGLKELQ

SEQ ID NO: 11189 - DNA, 635 bp, Panicum virgatum
  misc_feature: Ceres CLONE 1726544-R
gctcgcccttgttaccgctccgagcaacacaacttcatctgcttctagcagtacattgggtggtggattcgacaagctcatcttggacagcctttatgatgatggggcttacaggcagagacaacagcagcagctatatggttcagcagcgcctaatccattcatgacaaatgatccttttgcaatgtccagccaagtcgctcccccaccatcagtgcaaatggctgccatgtctcggcagcatcaacagatcccaacggtgatgcaaccaaatcccttcggaccaccaatgcaaccgcagatgggcatgggccctgcaacaaacaatccttttctggatgctggcttcgggccattcccggtggcgaacaacgggcatcggcaacataacccattcggtggtgcccaacttctgtaggccatagttacatgagcaaatttgtgccccagcaaatgcgatttttgtgtgattatatcatgcattgtgcttggccattattgtatgcgacccctgtatcatgtgttggctaaaccacacggggctgctgagttacccgatccttgttgtaaagaaattagtgacctgtgtaacaccaagtatatgtcaataaacagtaggacgtgcttataattat

SEQ ID NO: 11190 - DNA, 1801 bp, Panicum virgatum
  misc_feature: Ceres CLONE 1726548
  misc_feature: Encodes the peptide sequence at SEQ ID NO. 11191
gtctagacccttcctttctctcctgctgtcccttttgctcttctcggtgtaagcgtgtgcgcgtttcactgctttggtttcatctcccgctctttctttcctccccactgctcctccggccaagtgctggaacgaggaagcctcatgcggccgccggccggggagcggtagagcgccggagatgggctgggcgcccaggtggctgcgcgggctgctcggcggcggcaacaaggccgccgagacgaagcccgtgaaggaaaagaggcgctgggggttcgggaagtccttcagggagaaggcgccggcgccggtggcggcgcggcctccgacgccgccggtgcagcccacggcgacgcctcgccggggctacgcgccggcgccggacgaggcggacgacgagcagagcaagcgcgccatcgcggtggccgcggccactgcggcggttgcggaggccgccgtagccgcggcgcaggcggccgccgccgtggtgcggctgacgagcagcgggcggtgcgcgccggccgccgccaagcgggaggagtgggcggctgttcggatccaggccgctttccgtggatacctggcgaggcgggcgctcaaggcgctgcgggggctggtgaagctgcaggcgctggttcggggcaacatcgtgcggcggcaggcggcggagacgctgcggtgcatgcacgcgctcgtccgcgtccaggcgcgcgcccgcgcctgccgcgcaattcgctcgcagcaggtcccggctcacccagatccgccgacgccggagaagtacgatcaggcgggtgcccccaggcacgggcgttccggctctctaaaggggagctcgtcgaagacaccgggcagcgagaggctgggcagggagaggtcggaatcttgcgggaggaactggctggaccggtgggtggaggagaggtacatggacgacgagaagaacgccaagatcctggaggtggacaacggcaagccagggcggtatgcttccaagaggcgcggcggcggcggcaaccagcaccagtcgccgtgctcgacgatgacgtccgaccagaacagccggagctacgcgaccatgccggagtcgacgaccgcgcagcggtccgtgccgagcccgccgtcggtgggcatgggcgaggccctgagcccgctccgcctgcccgtggacattgccgagctctgcgacagcccacagttcttctcggcgtcgtctcggccggggagctcccggcgggggcccttcaccccgagcaagagcgagtgctcccgcagcctcttcgggggctactccgactaccccaactacatggccaacacggagtcgttccgcgccaaggcgcgctcccagagcgcgcccaagcagaggccgcactacgacaagtccagctccctccgcaaggcgtcggcggcgcaggcctacttgacggggccgtgcgcgccgacggcgcagcagaggtcggcggcctcgctgcacgccaagttcaccaacaaggcgtacccgggctctggcaggctggatcgactcggcatgcccgtcaagtactgatcctgttatgttatcctaccaaagttgctttctggagtggtgttgcttcttgagcgatcagtgtctcagctctcgagcaaggtcgatgaagtaaaatctagtagtggtcgttaggcttttgtgtgccttcctggtgctgttaccctcgacagttttctgtttcttgctttttaatagcgaagtgtaagttggtagtagctgcactgtaatactatctgtgctttaacagtttaactgctaagtgctaactcc

SEQ ID NO: 11191 - protein, 455 aa, Panicum virgatum
  misc_feature: Ceres CLONE 1726548
  misc_feature (120)..(140): Pfam Name: IQ Pfam Description: IQ calmodulin-binding motif
MGWAPRWLRGLLGGGNKAAETKPVKEKRRWGFGKSFREKAPAPVAARPPTPPVQPTATPRRGYAPAPDEADDEQSKRAIAVAAATAAVAEAAVAAAQAAAAVVRLTSSGRCAPAAAKREEWAAVRIQAAFRGYLARRALKALRGLVKLQALVRGNIVRRQAAETLRCMHALVRVQARARACRAIRSQQVPAHPDPPTPEKYDQAGAPRHGRSGSLKGSSSKTPGSERLGRERSESCGRNWLDRWVEERYMDDEKNAKILEVDNGKPGRYASKRRGGGGNQHQSPCSTMTSDQNSRSYATMPESTTAQRSVPSPPSVGMGEALSPLRLPVDIAELCDSPQFFSASSRPGSSRRGPFTPSKSECSRSLFGGYSDYPNYMANTESFRAKARSQSAPKQRPHYDKSSSLRKASAAQAYLTGPCAPTAQQRSAASLHAKFTNKAYPGSGRLDRLGMPVKY

SEQ ID NO: 11192 - DNA, 1779 bp, Panicum virgatum
  misc_feature: Ceres CLONE 1726556
  misc_feature: Encodes the peptide sequence at SEQ ID NO. 11193
acaagctcgcccaccaagctctcaccgcgcagcagcaaccaggcgaccccccattccccaggcaggcaggatgtccggcatggaggccgggctggtgcgcaagtacccttcggacgctggcggcctccgcgcggcgcggcacggcccgcacgggcactcagccagcgcccgcaccgcgcacagcatgtccgcggcggcgctgcgcaagaagtcggacgcctcgctggtgcgcaaggtgcccttcgcgccgctccgccccgtcctcgccaacctccaggaggtcttcctcggcaccaagctcgccgtgctcttccccgccgtgccgctcgccgtcgccgcgcagtgcgccaacttcggccaggtgtgggtgtttgcgctcagcttactcggcctcatccctctcgccgagcgcgtcagcttcctcaccgagcagatcgcaatttacaccggccccaccgtgggcggcctcctgaacgcgacgtgcggcaacgccacggagctcatcatcgcgctgttcgcgctgatgcagggcaagatcgaggtcgtcaagtgctccctcctcggctccgtcctctccaacctgctgctcgtgctcggcacctccctcttctgcggcggcgtcgtcaacctcggcgccgaccagccatacgacagaagccaagcggacgtcagcacgggcctcctcatcctcggcgtgctgtgccagtccctgccgctcatgctgcgctacgcggtgggcgccggcgagcactccgtcgccgcggcaaccacggggctcgacctctcgcgcgcctgcagcatcgtcatgctgctcgcctacgtcgcctacctcttcttccagctcaagacgcacgcccagctcttcgagccgcaggaggtcgacgaagacggcgaggatcaggaagaggccgtcatcgggttcgccagcgggctcttctggctcgcgttcaagactgttctcatcgccatcctgtccgagtacgtcgttggcacgattgagccaacctcaaaatcctggggcttgtcagtgagcttcatcagcatcatcctgctcccaatcgtcggtaacgcggcggagcacgctggcgccatcctttttgctctcaagaacaagctggacatcaccctcggagtcgctctggggtcggcaacccaaatctccatgttcgtggtgccgctgagtgtcattgtagcttggatcgcgggtattcaaatggacctcgacttcaagctgctagagactggctgtctgtttgtctcagtaatagtaacagccttcaccctccaggatggaacgtcacactatttgaaggggatccttctcctcctgtgttacattgtcatcggcgcatgctttttcgtcacgaggcaacctgcaggtcatgcaaacggcaatggtgttgggctggctgtaccaaccggtacatggaacgcacagggggcataacaggttaggagtcctgcctggacaagccagcatgcaagacagcagagcaatgacctaaatcagagactgaaactgcatgaatctgtcgggcctaggtttcgcaatgagtgatgatcctacttttccagagaaatgtggaagccggccggtccgagtgctaccgagagcaaatgtattcatcgtgtgagatgggaagggtttgtgcttgtattaattactattggtttagttagtaggctgcggctgctagccacaataagggtaccaaatatgtatgcatccaatcctgtgtatatgattcatcgtgcgctgcttcgtatatgaagcttaat

SEQ ID NO: 11193 - protein, 458 aa, Panicum virgatum
  misc_feature: Ceres CLONE 1726556
  misc_feature (296)..(429): Pfam Name: Na_Ca_ex Pfam Description: Sodium/calcium exchanger protein
  misc_feature (106)..(257): Pfam Name: Na_Ca_ex Pfam Description: Sodium/calcium exchanger protein
MSGMEAGLVRKYPSDAGGLRAARHGPHGHSASARTAHSMSAAALRKKSDASLVRKVPFAPLRPVLANLQEVFLGTKLAVLFPAVPLAVAAQCANFGQVWVFALSLLGLIPLAERVSFLTEQIAIYTGPTVGGLLNATCGNATELIIALFALMQGKIEVVKCSLLGSVLSNLLLVLGTSLFCGGVVNLGADQPYDRSQADVSTGLLILGVLCQSLPLMLRYAVGAGEHSVAAATTGLDLSRACSIVMLLAYVAYLFFQLKTHAQLFEPQEVDEDGEDQEEAVIGFASGLFWLAFKTVLIAILSEYVVGTIEPTSKSWGLSVSFISIILLPIVGNAAEHAGAILFALKNKLDITLGVALGSATQISMFVVPLSVIVAWIAGIQMDLDFKLLETGCLFVSVIVTAFTLQDGTSHYLKGILLLLCYIVIGACFFVTRQPAGHANGNGVGLAVPTGTWNAQGA

SEQ ID NO: 11194 - DNA, 1549 bp, Panicum virgatum
  misc_feature: Ceres CLONE 1726557
  misc_feature: Encodes the peptide sequence at SEQ ID NO. 11195
acacaatcgcacaatcgcacgtaatcgcatctattcggctcagtcactctcctcgcacgccgcgaaaggcacagaaccgccggtccccaatggagaacggcgccgccgccgtggccgcgtggaacttcgctccgaacgacgccctcctcggcctgacggcgctctccgtgcgcggcgtgctgggcaaagtgaaggccgggatggtggagggcagcggcgccggcggcgcgcgccccgtggtcccgctgggccacggcgacccgtcggcgttcccgtgcttccggacggcgcgggaggccgtgggcgccgtcgccggcgcgctccggtccggggagtacaactcctacgccgcctgcgtcggcctggagccagcacggaggtctatatcacagtatttgtcgcgcgacctgccatacgagctatcagccaacgacgtctacctgacaagcggttgcgcccaagcgatcgaggtcgtctgctctgccctggctcgccatggcgccaacatcctgctcccaaggccgggctacctgttctacgaggcgcgcgccgtcttcaacgggatggaggcccggtacttcgacctcgtaccggagagaggctgggaggtcgacctcgatggcctgcaagcactcgctgatgggaatacggttgccatggtcatcgttaacccggggaacccctgtggcaacgtctacacctatgagcatttgggcaagattgcgaagatggcgaggaagctgggcatctttgtgattgcggatgaagtgtatgcgcacttaacgtttggggagaagaagtttgtgccgatgggcgtgttcggctcggtggcgccggtgctcactctgggatccatatcaaagagatgggtggtgcctggatggagacttggctggatagtatgcaatgatcctaatggtgtatttcacaaaaccaaggtagtggacagcatcaagagttaccttgacatctcctctgatcctccaacttttgtccagggggcaattccgcaactcatcaaaaacactaagcaagaatttttcgataaaactgtcgaggttctaagacaaaccgccgatatatgctgggagaagttgaagggagtcagctgcatcacttgccccagcaggcctgagggttccatgtttgtaatggtgaaactggatctgtcctgcctgaaagacatcaaagatgatatggatttctgctgccggcttgccaaggaagaattggtggtggttttgccaggatgtgctgtgggatacaagaattggctccggatcaccttcgcaatcgcaccatcttctcttgaagatggccttgacaggctcaaatccttctgcttgcgccacagcaagcaaaagtgatgtggtaagcttgaagtgttcaagaagtgatatgataaggatttaatcgcaccatcttctcttgaagatggccttgacaggctcaaatccttctgctcagtcatcacttgctattcttgcaactcctgttgtaacgccagtgtgcgcaggtgcactgttcttgaatacatgacggattatac

SEQ ID NO: 11195 - protein, 425 aa, Panicum virgatum
  misc_feature: Ceres CLONE 1726557
  misc_feature (48)..(414): Pfam Name: Aminotran_1_2 Pfam Description: Aminotransferase class I and II
  misc_feature: SWISSPROT Homolog: EC 2.6.1.5 Tyrosine transaminase
  misc_feature: Useful for making plants with modulated nitrogen use efficiency
MENGAAAVAAWNFAPNDALLGLTALSVRGVLGKVKAGMVEGSGAGGARPVVPLGHGDPSAFPCFRTAREAVGAVAGALRSGEYNSYAACVGLEPARRSISQYLSRDLPYELSANDVYLTSGCAQAIEVVCSALARHGANILLPRPGYLFYEARAVFNGMEARYFDLVPERGWEVDLDGLQALADGNTVAMVIVNPGNPCGNVYTYEHLGKIAKMARKLGIFVIADEVYAHLTFGEKKFVPMGVFGSVAPVLTLGSISKRWVVPGWRLGWIVCNDPNGVFHKTKVVDSIKSYLDISSDPPTFVQGAIPQLIKNTKQEFFDKTVEVLRQTADICWEKLKGVSCITCPSRPEGSMFVMVKLDLSCLKDIKDDMDFCCRLAKEELVVVLPGCAVGYKNWLRITFAIAPSSLEDGLDRLKSFCLRHSKQK

SEQ ID NO: 11196 - DNA, 759 bp, Panicum virgatum
  misc_feature: Ceres CLONE 1726559
  misc_feature: Encodes the peptide sequence at SEQ ID NO. 11197
aaaacttccaaggcgaaagcttccattccggcccatcgtcgtctccacaaatggagctcacgctaacaatgatggtcaccaccgtcgtcctcctcctcgtgctgatcggcttcctcgtcaggccgcgccgcagccaccggaaggcgctgaacctcccgccaggccccaggggctggccggtgttcggcagcctgagcttgctagcaggcacgctcccgccgcaccgcgtgctggccacgctcgcggcgcgctacggcccgctcatgcacctccggctcggctccttcgacgtcgtggtcgcctcctccgcggaggcggcgcggctcgtcctcaagacccacgacctcgccttcgccgaccgcccgccggcggcctggggcgccatcatcgcctacaactacaagggcatcgtacacacgccctacgggccctactggcgcatggcgcgcaagctctgcgccacggagctcttctccgcgcggctcgtccacgcgttcgagcccgtgcgcgcggaggagacgcgcgccctgacgcgcgacctgttcgagcgcgccggcgccgccgtgccggtgagggagctcctgatgggcttcacgatgcggagcatcctccgcatggcgctcggggagaagtggccgggctcctacggcagcgccgccgagggcgaagtgttccggcggtcgctcgaggaggccttcgcagtgagcggcgcggtgagcaacgtgtgggagtggatgccgtgtctcgcctggctcgacg

SEQ ID NO: 11197 - protein, 236 aa, Panicum virgatum
  misc_feature: Ceres CLONE 1726559
  misc_feature: SWISSPROT Homolog: EC 1.14.13.21 Flavonoid 3'-monooxygenase
MELTLTMMVTTVVLLLVLIGFLVRPRRSHRKALNLPPGPRGWPVFGSLSLLAGTLPPHRVLATLAARYGPLMHLRLGSFDVVVASSAEAARLVLKTHDLAFADRPPAAWGAIIAYNYKGIVHTPYGPYWRMARKLCATELFSARLVHAFEPVRAEETRALTRDLFERAGAAVPVRELLMGFTMRSILRMALGEKWPGSYGSAAEGEVFRRSLEEAFAVSGAVSNVWEWMPCLAWLD

SEQ ID NO: 11198 - DNA, 454 bp, Panicum virgatum
  misc_feature: Ceres CLONE 1726559-R
  misc_feature: Encodes the peptide sequence at SEQ ID NO. 11199
agggcgtggacgcgcgcggggcgcacttccagctgctgccgttagggtccggacgtcgaatgtgcccggcgcacaacctcgcgtcgagggagatggcggccaagctggcgagcttggtgcaggggttcgcgtggcggttgccggatggggtgccacccgaggacatgagcctggaggaatccttggggctgtcggtgagccccaaggatccgctcgttgcggtcgaccagccaaggttgccggcacacctctacacaggagtccactagctagattattgtcatccggatttatgtatcaggtgtttggatacatgagtggtatgtcaggttaaacaccagcagtgttcttgagttgttcatcaccacaagcgactgggtactggctctcctcgtatagcatctacatagagttatattacaaacaatgatcaaattatcatcctttttccatg

SEQ ID NO: 11199 - protein, 88 aa, Panicum virgatum
  misc_feature: Ceres CLONE 1726559-R
  misc_feature: SWISSPROT Homolog: EC 1.14.13.21 Flavonoid 3'-monooxygenase
  misc_feature: Useful for making plants with altered carbohydrate content
GVDARGAHFQLLPLGSGRRMCPAHNLASREMAAKLASLVQGFAWRLPDGVPPEDMSLEESLGLSVSPKDPLVAVDQPRLPAHLYTGVH

SEQ ID NO: 11200 - DNA, 878 bp, Panicum virgatum
  misc_feature: Ceres CLONE 1726561
  misc_feature: Encodes the peptide sequence at SEQ ID NO. 11201
actgaatctgttacagtcaaccttcgttgtcctaatagtggatccagaatgaggattgctggaaggttcaagtcttgtgttcacatgggttgttttgatcttgaaacctttgtggaattgaatcaacgctcccgcaagtggcaatgtccaatatgtttaaagaattactctcttgagaacttaatgattgatccttatttcaatcggattacttctttgttgcgcaattgcagtgaagatgtgaatgagcttgatgttaaacctgatggatcatggcgtgtgaagggtgatgctgccaccagagagctatctcagtggcatatgcctgatggcacactttgtgacttaaaggaagatacaaaccttggtgcaaaaaatctgaatcaagtcaagatagagggtacttctgatggacatagaagtttgaaacttggaatcaaaagaaatcctaatggcatatggcaagttagcagtaaggcagatgacaagaaaccttctatggttggaaatcacatccagaacaacaatgggtttcaagcacctaacactctgcctatgatcagtagccccaccgggagttacagagatggagaagacgcaagtgtgaaccaagaagggggtggtactcaatttgatatatcattgaaccaagagtttgacagttttgcccgtaactttggtcaaacatacaatacagaggataggcagcagcagcagcagcagcagcagcagcaacataatgctgcagatgtcattgttcttagtgattctgatgaagaaaacgacacgattgttcacccgccagctgtctttgacaatactgctacagatggcaacaattttcctttcgccactagtggtgctgcatctggatatcc

SEQ ID NO: 11201 - protein, 292 aa, Panicum virgatum
  misc_feature: Ceres CLONE 1726561
  misc_feature (6)..(55): Pfam Name: zf-MIZ Pfam Description: MIZ/SP-RING zinc finger
TESVTVNLRCPNSGSRMRIAGRFKSCVHMGCFDLETFVELNQRSRKWQCPICLKNYSLENLMIDPYFNRITSLLRNCSEDVNELDVKPDGSWRVKGDAATRELSQWHMPDGTLCDLKEDTNLGAKNLNQVKIEGTSDGHRSLKLGIKRNPNGIWQVSSKADDKKPSMVGNHIQNNNGFQAPNTLPMISSPTGSYRDGEDASVNQEGGGTQFDISLNQEFDSFARNFGQTYNTEDRQQQQQQQQQQHNAADVIVLSDSDEENDTIVHPPAVFDNTATDGNNFPFATSGAASGY

SEQ ID NO: 11202 - DNA, 605 bp, Panicum virgatum
  misc_feature: Ceres CLONE 1726561-R
ctctcccaagcacgaacaatgacagatgcaatggagtgggtctaaatccgagaaggatcgaaaatatattttttcatcctcggcaaccgcggtctgttaggcctcgcctgtgtttatcattagatactgattcggagtagcttgggcatcacattggaatctccgagttcgctattaatttggcaaagttggcataatcttgatttttactttggagggctatcaggttggttgatacaaggagacaccagtgcagatgctttgttgcttcaacctggtgtgagccaagtgttttgtatgatccaagtgggatctgcatagagttcatttgatggttggtacaggatattttctaactggaagtgaaggcttaatgtggctagcggagcaggttgtacatttttcctgacatttactgggtataaggaataggggggccatcacttggcgaaggacaaatacatgtgaatgcttgtgtgtaccatcattgtatttagggtttgggtgctaatttagattgtttgttaccctgatgtttgatggaaaataaattattccttgaagtggcggtcaataaccagagcccttcacttttgatttggagc

SEQ ID NO: 11203 - DNA, 1728 bp, Panicum virgatum
  misc_feature: Ceres CLONE 1726569
  misc_feature: Encodes the peptide sequence at SEQ ID NO. 11204
ctacggactccgggtcccggcacgattccatcaccacgccagcagccagacacaagagacaacgccggtcgcggcagccggtcgatggggtcgtctccggaggcgccgctgctgcccccgcagcggggcggggaggaggcggggcgctgccgctggtggcgcggcggcgcctcttgggccgcggcgacggcggaggccggccggctggcggcgctgggcgcgcccatgatcgcggtcgcgctgctgcagctcatgatgcagctcatctccaccgtcatggtgggccacctcggggaggtgccgctcgccggcgccgccatcgccaactcgctcaccaacgtctcgggattcagcgtcctcatgggactcgcatgcggattggaaactatttgtggacaggcctacggagcggagcagtatcacaagctagctttatttacctacaggtccatagttgtgctccttgttgcgagtgtgcccatcgccattatatggcttttcatcccggatgtacttcctctcataggacaggatgcgcagatagcaagtgaggccgggaggtatgccttgtggcttatccctggtttattcgcctacagtgtggctcaatgcctttcaaagttcctccagtctcagagcctgattttccccatggttttgagctccttgacaacgctcactctctttattcctttgtgctggttcatggtttacaaagttgggatgggtaatgctggagctgcttttgcagtaagcatctgtgattgggttgaagtcacggttcttggtctctatattaagttctcaccttcttgtgacaaaacccgtgctgcacccacgtgggaaacttttcgaggaattggcagtttcatgcggttggctgtaccttcgactcttatgatttgtcttgaatggtggtcgtatgagctgcttgttctggtttctgggaacttgccaaatccagcacttgaaacttctgtgctctcaatatgcatatctacagtagtgttggtgtacaatctcccatatggcattggaaatgctgcgagcgtgcgtgtgtcaaatgagctaggtgcagggaacccagatggcgcccgcttagtagtagttgtctccttatccattataatttgcactgcggttctggtgagcgtaactcttctatcgttgcgccatttcatcggaattgctttcagcaatgaggaagaggttgtaaattatgtcaccagaatggtaccgttgctttcaatttcagttcttattgacaacctccaaggagtcctttcaggtatttctagaggctgtggatggcagcatttaggtgcctatgttaacctgggcgcgttctatcttattggcattcctgtggcgcttgttctcggttttgcattccatctaggaggagctgggttctggattggcatgatagctggtggagctacacaggtcactctcctatcagtcatcactgcaatgacaaattgggggaagatggctgaaaaggctagggatagagtgtttgaggaaagtcttcctacacaggcggattgatcacatggaggtagaatcacatccaaaaaatttcagcaccctaagtgatcttttttgttgggaagaggtgtcatgttccaccacggatatgtaaaaatagcgttatgagtatggtattctttcactgaaaagagttgtccaatgaaattaataaaatactaggctattttgctattt

SEQ ID NO: 11204 - protein, 488 aa, Panicum virgatum
  misc_feature: Ceres CLONE 1726569
  misc_feature (47)..(207): Pfam Name: MatE Pfam Description: MatE
  misc_feature (268)..(431): Pfam Name: MatE Pfam Description: MatE
MGSSPEAPLLPPQRGGEEAGRCRWWRGGASWAAATAEAGRLAALGAPMIAVALLQLMMQLISTVMVGHLGEVPLAGAAIANSLTNVSGFSVLMGLACGLETICGQAYGAEQYHKLALFTYRSIVVLLVASVPIAIIWLFIPDVLPLIGQDAQIASEAGRYALWLIPGLFAYSVAQCLSKFLQSQSLIFPMVLSSLTTLTLFIPLCWFMVYKVGMGNAGAAFAVSICDWVEVTVLGLYIKFSPSCDKTRAAPTWETFRGIGSFMRLAVPSTLMICLEWWSYELLVLVSGNLPNPALETSVLSICISTVVLVYNLPYGIGNAASVRVSNELGAGNPDGARLVVVVSLSIIICTAVLVSVTLLSLRHFIGIAFSNEEEVVNYVTRMVPLLSISVLIDNLQGVLSGISRGCGWQHLGAYVNLGAFYLIGIPVALVLGFAFHLGGAGFWIGMIAGGATQVTLLSVITAMTNWGKMAEKARDRVFEESLPTQAD

SEQ ID NO: 11205 - DNA, 1214 bp, Panicum virgatum
  misc_feature: Ceres CLONE 1726573
  misc_feature: Encodes the peptide sequence at SEQ ID NO. 11206
ctacccttctccatccgctcccaccctctcggctgccaggagaagcagccgctgccgccgcttcgacagccaccgcagggtaccaagatgggtggttttgtcaagacccaaaagaccagtgcgtactccaagcgtttccaagtgaagttcaagagaaggcgcgctggcaagacagactacagggcaaggatcaggttgattaaccaagacaagaacaagtacaacacgcccaaatacagatttgttgtgcgatttaccaacaaggacatcactgcacaaatcgtatctgcaagtattgcgggtgatatggtacttgctgctgcctactcccatgagctgccacgatatggtcttgaagttggtctgaccaactatgctgcagcctactgcactgggcttcttttggcccgtcgtgtgctcaagcttcgtgatttggataaggagtatgagggcaacgttgaggccactggtgaagacttctctgttgagccagatgatgagaggaggcctttccgtgctcttttggatgttggccttgttaggactaccactggaaaccgtgtctttggtgccctgaagggagctttggatggtggtctagatattcctcacagtgagaagaggtttgctggtttcaagaaggatgaaaagcagctggatgctgaggtccaccgcaagtacatctatggtggtcatgttgctgagtacatgaggactctagctgaggaggagccggagaagtaccagtctcacttcagtgagtacatcaagaagggtattgaggctgatgacatggaagctctgtacaagaaggtccatgctgccatccgagctgatcctaccatggccaagtcaaccaagcagccaccgaaggagcacaagaggtacaaccccaagaaactgacctatgagcagaggaaggccagcctagttgaaaggctcaacgccctcaactcgtctggtggtgctgatgatgatgacgatgaggacgacgagtgaagtgtcccttcgtagtagtgctatcttatgtggcgatcagaacttgtgccatggcacctatcgttacctgtagtcctgcaacaggcatttttgtttaagtttgtcgatgtgaacaaagctgttctgctagttttgagctggagttatggatattaaaattaagatgcttccgattgaacgtggttcttctgaatccccagttgtggtttgaaacc

SEQ ID NO: 11206 - protein, 303 aa, Panicum virgatum
  misc_feature: Ceres CLONE 1726573
  misc_feature (27)..(173): Pfam Name: Ribosomal_L18p Pfam Description: Ribosomal L18p/L5e family
MGGFVKTQKTSAYSKRFQVKFKRRRAGKTDYRARIRLINQDKNKYNTPKYRFVVRFTNKDITAQIVSASIAGDMVLAAAYSHELPRYGLEVGLTNYAAAYCTGLLLARRVLKLRDLDKEYEGNVEATGEDFSVEPDDERRPFRALLDVGLVRTTTGNRVFGALKGALDGGLDIPHSEKRFAGFKKDEKQLDAEVHRKYIYGGHVAEYMRTLAEEEPEKYQSHFSEYIKKGIEADDMEALYKKVHAAIRADPTMAKSTKQPPKEHKRYNPKKLTYEQRKASLVERLNALNSSGGADDDDDEDDE

SEQ ID NO: 11207 - DNA, 677 bp, Panicum virgatum
  misc_feature: Ceres CLONE 1726575
  misc_feature: Encodes the peptide sequence at SEQ ID NO. 11208
ctctagcctccatccaagtctctctctttctctctctacccctgcttctgggaagctcatcagcaggcagccatggacgacgccgctggggaagaagaagcttccatatactactggatcagatcaggggcaaggcagtcgtgttcactggccactccctcggtggcgccatcgccgccctcgccgccctgcactacctctgcatctcgtcgtcaagctcgacgtttggtctggcgcctccggtcctgtgcgtcaccttcggaagcccattgctcggcaccgaggcgctgtccagggccatcctgcgcgagcgatggggcggcaacttctgccacgtcgtctcccagcacgacgtcgtcccgaggctcctcttctgccccctcgacgccgtccccgcgcgcatcatcgtcgaaatgcagctgcggcaatggccggcgcgcacccaccactcgggcgcggtgaccgcggtcaccgccgatagggacgcgctccggcagctgatccagacgcacgtcggcgcggtggcgatggagcagaagctcgccgacccggcggcggcgccgagcggtggcccgtaccggccgttcgggacgtacgtgatgtgctcgccggacggcgcggtgtgcgtggacaaccccgccgccgccgtccagatgctctacgccacgttcgcgtca

SEQ ID NO: 11208 - protein, 224 aa, Panicum virgatum
  misc_feature: Ceres CLONE 1726575
  misc_feature (22)..(127): Pfam Name: Lipase_3 Pfam Description: Lipase (class 3)
LASIQVSLFLSLPLLLGSSSAGSHGRRRWGRRSFHILLDQIRGKAVVFTGHSLGGAIAALAALHYLCISSSSSTFGLAPPVLCVTFGSPLLGTEALSRAILRERWGGNFCHVVSQHDVVPRLLFCPLDAVPARIIVEMQLRQWPARTHHSGAVTAVTADRDALRQLIQTHVGAVAMEQKLADPAAAPSGGPYRPFGTYVMCSPDGAVCVDNPAAAVQMLYATFA

SEQ ID NO: 11209 - DNA, 624 bp, Panicum virgatum
  misc_feature: Ceres CLONE 1726575-R
  misc_feature: Encodes the peptide sequence at SEQ ID NO. 11210
gattatttcctcaaacatgggaagacccgactactgcaaattctgatgttgaaggagcattcggagataatgaccctgttgatgttgttgagataggtgaaagacgtgccaatattggggatgtccttaaggttaaaccattggcagctttagcaatgattgatgagggggagctcgactggaaaattgtggccatttctttggatgacccaaaagcatctcttgttaatgatgtggatgatgttgagaagcattttccggggacactgactgccatcagagactggttcagagactacaagataccagatggaaagcctgccaacagatttggtctcggcaacaagcccacaagcaaggaatatgcgctgaaggtcattgaggaaactaacgaatcatgggagaaattggtgaagaggaatatccctgctggagagctctcactagcctaatctcgaggccatgagaagccacaacattctttgaaccgcgtttttcttgatcatgtcgttttgtatgctgtaactatgtaagcatgcttcttcattttgcagacgttttttcgaactgtgtaacaggaataatcttgtcgggtgaataatgattctggagcgagtttttacc

SEQ ID NO: 11210 - protein, 149 aa, Panicum virgatum
  misc_feature: Ceres CLONE 1726575-R
  misc_feature (2)..(135): Pfam Name: Pyrophosphatase Pfam Description: Inorganic pyrophosphatase
  misc_feature: SWISSPROT Homolog: EC 3.6.1.1 Inorganic diphosphatase
LFPQTWEDPTTANSDVEGAFGDNDPVDVVEIGERRANIGDVLKVKPLAALAMIDEGELDWKIVAISLDDPKASLVNDVDDVEKHFPGTLTAIRDWFRDYKIPDGKPANRFGLGNKPTSKEYALKVIEETNESWEKLVKRNIPAGELSLA

SEQ ID NO: 11211 - DNA, 1630 bp, Panicum virgatum
  misc_feature: Ceres CLONE 1726576
  misc_feature: Encodes the peptide sequence at SEQ ID NO. 11212
gcgcgacgctccccagggctccaccacccctaaaaccctagaccacccgcgggagcggagcggagcggagggggagcctcgcccgtctcagattccgcccagcaccggcgcggccacacccgccgccatgaagctgacggtgaagaccctcaagggcacgtacttcgagatccgggtgcagcccaacgacacgataatggctgtgaagaaaaacatcgaagagaaacaaggaaaggatagctatccttggggtcaacaactgctgattttcaatgggcaggttttgaaagatgaaagtacattggaggagaacaaagtcagtgaagatggctttctagttgtcatgctcagtaagagcaaaatatctggttcaagtggagcctcatctgcccagccctcgagcactcctgcaaccaggcagccatctcctgtagatcctccacggcaagctccgcaacccccggtggcagcagctacaacttctcagcctgaaggccctcctgcacaggccccttcaaacacatatgacaatgcagcatcaaatctactatcaggaagcaatattgacacaatgattaaccagctaatggagatgggtggaggcagttgggacagagataaagtccaaagggctcttcgtgctgcttacaacagcccggaacgagctgttgaatacctgtactctggtattccagtaacagctgaagttgctgttccagttggtgttcaaggaggaaacacaactgatcaacctcctacgggggaagccgatcttgctggaattccaaacagcgctccattaaatcttttcccgcaggggggttccaatgctggaggtggaccacttgagtttcttagaaacaaccaacagtttcaagcacttagggaaatggtccaaacaaatccacaaatcttgcagcctatgctccaggaattgagcaagcagaatcctcaaattctaaggttgattcaggagaatcatgctgagttccttcagttaataaatgagccctttgaagatggcgagggggacttcttagaacaacctgagcaggatgaaatgcctcatgctatcaatgttacaccagaggagcaggaggccattggacggcttgaatccatggggtttgagagagcacgtgtcatagaggcattctttgcctgcgacaggaatgaggagctagctgcaaactatcttcttgagcatgctggtgaggaagattgagtgggaatagtttgcactcgcctttactgtacatctgacccaaagttatggagattgccacactgcgtcggaagtgcgtcagaagttctgaatgactaagcaaggtcgagaaggagctgatactttgaattgatcccttgtgcgagaccccatattacatgtcgtcttatacatttaaatttaatacatgtagcattcaacagaatgcttctgtagtgtatttccgtcgttctctagtggtaaacatcagttccgttctctatgcattagggttcatgggtaaaagtacaccacaaagtttgggtctcgataggaggatgccactttgcatcgtagcataatggcaaattgcaaaatactgctgttgctagcaatttccatgaagtctatggagtgaaatgatct

SEQ ID NO: 11212 - protein, 365 aa, Panicum virgatum
  misc_feature: Ceres CLONE 1726576
  misc_feature (240)..(298): Pfam Name: XPC-binding Pfam Description: XPC-binding domain
  misc_feature (145)..(184): Pfam Name: UBA Pfam Description: UBA/TS-N domain
  misc_feature (321)..(357): Pfam Name: UBA Pfam Description: UBA/TS-N domain
  misc_feature (6)..(78): Pfam Name: ubiquitin Pfam Description: Ubiquitin family
MKLTVKTLKGTYFEIRVQPNDTIMAVKKNIEEKQGKDSYPWGQQLLIFNGQVLKDESTLEENKVSEDGFLVVMLSKSKISGSSGASSAQPSSTPATRQPSPVDPPRQAPQPPVAAATTSQPEGPPAQAPSNTYDNAASNLLSGSNIDTMINQLMEMGGGSWDRDKVQRALRAAYNSPERAVEYLYSGIPVTAEVAVPVGVQGGNTTDQPPTGEADLAGIPNSAPLNLFPQGGSNAGGGPLEFLRNNQQFQALREMVQTNPQILQPMLQELSKQNPQILRLIQENHAEFLQLINEPFEDGEGDFLEQPEQDEMPHAINVTPEEQEAIGRLESMGFERARVIEAFFACDRNEELAANYLLEHAGEED

SEQ ID NO: 11213 - DNA, 1551 bp, Panicum virgatum
  misc_feature: Ceres CLONE 1726578
  misc_feature: Encodes the peptide sequence at SEQ ID NO. 11214
aatcccccagacccgagcacccccgattcgccgtgccaccgaagcgagagccgaacggaagcgagatcctcggcggcgagcgagcgagatggagggcggcgccggcgaggaggggaagcaggagcggcacctggtgctggcgcacaagctcttccttctctcccaccccgccgtcgacgacctctccaaggtcgccctccgcgccgaggtcctcgacgccgtgaaatccgacgacatggcgccgctgtttgagtcgctggtcgccgcgggcgtgctggagccggacgccgcgctgctggccgagatgcgcgggacgatcgacgacgagatccgcaagctcgatgagaaaattgctgatgctgaggagaatttgggtgagagtgaagtacgtgaagcccatcttgccaaatccttgtactttataagggttggtgagaaggaaaaggccctggaacaacttaaagttactgaaggaaagactgtagctgttggccaaaagatggatcttgtgtttcacactttgcagattggatttttctacatggattttgatctcatctcaaaatccattgataaggcaaagaacttgtttgaggaaggaggtgactgggagagaaagaacagattgaaagtgtatgaaggcttgtactgcatggcaaccagaaacttcaagaaagctgccagcttatttttagattccatttcgactttcacaacttatgagttattcccatatgatacattcatcttttatactgtcctcactagtgtcatcacactggatcgtgtatctctgaaacaaaaggtggtagatgcgccagaaatcctggccgtgatcggcaaagtacctcacctctctgagttcctcaattccctatacaattgccagtacaagtcgttttttgttgcattctctggcttgacagagcagatcaagttaaaccgttatcttcagcctcatttccgctactacatgcgggaagtgcgtactgttgtctactcacaattcttggagtcgtacaagagtgtaacaatggaagcaatggctgctgcttttggtgtgactgttgatttcattgaccaggaactgtcacggttcattgcagctgggaagcttcactgcaagattgataaggttgctggtgttcttgagacgaaccggccagatgagaggaacgctttctaccaggcgaccatcaagcaaggggacttcttgctgaaccgcatacagaagctttcacgagtcattgacctgtaagagttgctgtttctgttggagctccttcagtgccctgccaatgtttcctgcactggaagggtgagctcaacttatccacctcgactttcataagacatgagcattgctcttcttgtgtgaggaacaaattgctaagagaacttgtgtgttaatcgtgaattcactacatgtatcccatggctttataggaggaaggtgcagctcaatcccatggacgttacttttgtggtgaaccttggtttttcttttcacgtctcattatatatgtggttctatgcattacattctccgtc

SEQ ID NO: 11214 - protein, 389 aa, Panicum virgatum
  misc_feature: Ceres CLONE 1726578
  misc_feature (254)..(358): Pfam Name: PCI Pfam Description: PCI domain
MEGGAGEEGKQERHLVLAHKLFLLSHPAVDDLSKVALRAEVLDAVKSDDMAPLFESLVAAGVLEPDAALLAEMRGTIDDEIRKLDEKIADAEENLGESEVREAHLAKSLYFIRVGEKEKALEQLKVTEGKTVAVGQKMDLVFHTLQIGFFYMDFDLISKSIDKAKNLFEEGGDWERKNRLKVYEGLYCMATRNFKKAASLFLDSISTFTTYELFPYDTFIFYTVLTSVITLDRVSLKQKVVDAPEILAVIGKVPHLSEFLNSLYNCQYKSFFVAFSGLTEQIKLNRYLQPHFRYYMREVRTVVYSQFLESYKSVTMEAMAAAFGVTVDFIDQELSRFIAAGKLHCKIDKVAGVLETNRPDERNAFYQATIKQGDFLLNRIQKLSRVIDL

SEQ ID NO: 11215 - DNA, 1602 bp, Panicum virgatum
  misc_feature: Ceres CLONE 1726580
  misc_feature: Encodes the peptide sequence at SEQ ID NO. 11216
acactctggggagagcagcacgcagcaaggtcagctagctacaggacgaagctgcagctagcgcggcagatcagattgatcgagatggcggccgccttctcctccaccgtcggagctccggcctccaccccggctagcttcctcgggagcaagctcagcaggaagcaggcgaccgccgccgccgtgaactaccatggcaagagctccggcggcaacaggttcagggtcatggcaaaggaggtcgacgagtcaaagcagacggactccgacaggtggaagggcctggcctacgacatctcggacgaccagcaggacatcaccaggggcaagggcctcgtcgactccctcttccaggcgcccacgggggacggcacccacgaggccgtgctcagctcctacgagtacctgagccagggcctcagggactacagtgcctgggacaacatgaaggacggcttctacatcgccccggccttcatggacaagctcgtcgtccacctctcaaagaacttcatgacactgccaaacatcaaggttcccctcatccttggtatctggggaggcaagggtcaaggaaaatccttccagtgtgagcttgtcttcgccaagatgggcatcacccccatcatgatgagcgccggagagctggagagcggcaacgccggtgagcccgccaagctcatcaggcagcgttaccgcgaggcggccgacatcatcaagaagggcaagatgtgctgcctcttcatcaacgatctcgacgccggtgccggtcgcatgggcggcaccacccagtacacggtgaacaaccagatggtgaacgccaccctgatgaacatcgccgacaaccccaccaacgtgcagctccccggcatgtacaacaaggaggagaacccccgggtgcccatcgtcgtcaccggcaacgacttctccaccctctacgcgccgctcatccgtgacggtcgtatggagaagttctactgggcgcccacccgcgaggaccggatcggtgtgtgcaagggcatcttccgcaccgacggcgtccccgacgaggacgtggtcaagctcgtggacaccttccccggccagtccatcgacttcttcggcgctctgcgtgcccgggtgtacgacgacgaggtccgcaagtgggttgccgagaccggcgtggagaacatcggcaggaagctcgtcaactccaaggagggccctcccaagttcgagcagcccaagatcacgatcgccaagctgctggagtacgggcacatgctggtggcggagcaggagaacgtcaagcgtgtgcagcttgccgacaagtacctcagcgaggcggccctcggtgaggctaacgaggacgccatgaagaccggcgccttcttcaagtaggaatttaggaaaccaaccggcctcttgctattgaattgctaggcggccaattaaggttgcaagatggatgttttactcttgttcattgtaccaattaaagtaccggccggccggatctggacaagcgatagctgggcatggaaatttttgtcaatatatatcaaggttttaaatagccggctatagctttcgctatagacagctatagcttctagaaagtcc

SEQ ID NO: 11216 - protein, 431 aa, Panicum virgatum
  misc_feature: Ceres CLONE 1726580
  misc_feature (154)..(352): Pfam Name: AAA Pfam Description: ATPase family associated with various cellular activities (AAA)
  misc_feature: Useful for making plants with modulated biomass
MAAAFSSTVGAPASTPASFLGSKLSRKQATAAAVNYHGKSSGGNRFRVMAKEVDESKQTDSDRWKGLAYDISDDQQDITRGKGLVDSLFQAPTGDGTHEAVLSSYEYLSQGLRDYSAWDNMKDGFYIAPAFMDKLVVHLSKNFMTLPNIKVPLILGIWGGKGQGKSFQCELVFAKMGITPIMMSAGELESGNAGEPAKLIRQRYREAADIIKKGKMCCLFINDLDAGAGRMGGTTQYTVNNQMVNATLMNIADNPTNVQLPGMYNKEENPRVPIVVTGNDFSTLYAPLIRDGRMEKFYWAPTREDRIGVCKGIFRTDGVPDEDVVKLVDTFPGQSIDFFGALRARVYDDEVRKWVAETGVENIGRKLVNSKEGPPKFEQPKITIAKLLEYGHMLVAEQENVKRVQLADKYLSEAALGEANEDAMKTGAFFK

SEQ ID NO: 11217 - DNA, 1589 bp, Panicum virgatum
  misc_feature: Ceres CLONE 1726581
  misc_feature: Encodes the peptide sequence at SEQ ID NO. 11218
ggaaagggcaaaggatttttttcagattttgcggccgccaccgaccgagaccggggcccccccgagctgcagcgagccaccttcccccgacatgacgccgcatctgcccgccgcctcctcctcctccgccaccacctcccgcgccgccgccgccgcggcggcgcaccaccacctgctcggcgctgccgcggcgcacaaccacctgctcgacgccgccgcggccgcgccgtcctcgccgcaccaccgccggcggtggcggcgccgggtccccggctgcggcctccgcctgcgcggcgcgcccgtccgctgctgcgcggccgcggtgcccgcgccgcaggccgcggtgccggcgcgggcccgggccggggccgcgccgggggccaccacgcgcgtcttcgtggtgtccgacctccacacggactacccggataacatggagtgggtgcgccgcctccccgccgaggtcggcgccggggagggcgccggcctcgacgcgctcgtcgtcgcgggggacgtcgcggagaccagggacaactttgcgcgcaccatggaggtgctcaggggccggttcggggccgtcttctacgtccccgggaaccacgacctctggctgcgacgcgagggcggccgctacatggattcgctggagaaactgactgcattgcttgatgcgtgtagtgagctgggtgtggatacaggcccaagaatgataggtgacttgggaatcataccattgttctcatggtatcacaagagctttgacaaggagaaggatgttaacagtgtgcgcgtcccttctctagagatggcttgtaaagactttcatgcttgtaaatggccttcagaccttgcaaacgatgatgagtctattgctctttacttcgacaaattgaatgacaagaaccatgatgctattgaagaagtaaaaaatagcagcaagcagatactaacattttcacacttcgtaccaaggcaagagttgtgtcctgaaaaacggatgctttattacccataccttccaaaggtcattggctctgatttcctggagaggaggctgagagatatacacagcaacagaaaagatggagcagcttgccatgtttttgggcacacacatttctgttgggattctgtggttgatgagatcaggtacatacaggcacctttggcgtatccccgagaaagaaagagaagaatgaatagcgaaggttggctaccattttgtgtataccgtgacggcttcaaccccgaaatatatccagccttgtggtcggactattacaacaagaacaaaagggagcctgagaacactcagctcgcgccgtgggtcgccagacatttcgcgaagtaccacaaattccactgaccgctactggagttcatgttttgcatttacctgcatttacctggtccgatcaggacggtgttggaacctgcatttacctggagaagaaaaggagatgttgacgtttcacctgtacatgatttcttttttgtttccactcttaccatagacttttgggcaagtaagcgcctgcctgtgttgaatgtatgttgcagaaatcagaataatgtgtataagattcttc

SEQ ID NO: 11218 - protein, 424 aa, Panicum virgatum
  misc_feature: Ceres CLONE 1726581
  misc_feature (99)..(344): Pfam Name: Metallophos Pfam Description: Calcineurin-like phosphoesterase
MTPHLPAASSSSATTSRAAAAAAAHHHLLGAAAAHNHLLDAAAAAPSSPHHRRRWRRRVPGCGLRLRGAPVRCCAAAVPAPQAAVPARARAGAAPGATTRVFVVSDLHTDYPDNMEWVRRLPAEVGAGEGAGLDALVVAGDVAETRDNFARTMEVLRGRFGAVFYVPGNHDLWLRREGGRYMDSLEKLTALLDACSELGVDTGPRMIGDLGIIPLFSWYHKSFDKEKDVNSVRVPSLEMACKDFHACKWPSDLANDDESIALYFDKLNDKNHDAIEEVKNSSKQILTFSHFVPRQELCPEKRMLYYPYLPKVIGSDFLERRLRDIHSNRKDGAACHVFGHTHFCWDSVVDEIRYIQAPLAYPRERKRRMNSEGWLPFCVYRDGFNPEIYPALWSDYYNKNKREPENTQLAPWVARHFAKYHKFH

SEQ ID NO: 11219 - DNA, 731 bp, Panicum virgatum
  misc_feature: Ceres CLONE 1726593
  misc_feature: Encodes the peptide sequence at SEQ ID NO. 11220
taggctgtagccactagccacagggagggagggagccgcttcagatccgccgagcccaccagcctcccgcccatgcggccgccggcgatgctccgccgggccgcggcggcactcgcgctcgcgctcgcgctcgggatcctcgccgccgcgccggcctccgcattctacctccccggcgtcgcgcccaacgacttccacaagaaagatccacttttggtgaaggtgaataagttgacatccacaaagacacaacttccctactcctactactctcttcctttctgcaagccggactcaatagttgacagcgcagagaatcttggagaagttcttcgtggtgaccgcattgagaactccccttatgtgtttgagatgagagagcccaagatgtgccagattgtctgcagatcatcaattgatgataaacaagcaaaggagctcaaggaaaagataggtgatgagtatcgggtgaacatgattcttgataacctcccactagttgttcctatcgcatggcaggataggaatgctattgtttatcagggtggatatcatgttggtgtcaaggggcagtatgctggtagcaaggatgagaaggtctttatccacaaccacttgacattttttgttaaataccacaaggatgaaactacagaactctctagaattgttggatttgaggtcaaaccattcagtattaaccatcagtttgaaggccaatggaatgataa

SEQ ID NO: 11220 - protein, 219 aa, Panicum virgatum
  misc_feature: Ceres CLONE 1726593
  misc_feature (61)..(219): Pfam Name: EMP70 Pfam Description: Endomembrane protein 70
MRPPAMLRRAAAALALALALGILAAAPASAFYLPGVAPNDFHKKDPLLVKVNKLTSTKTQLPYSYYSLPFCKPDSIVDSAENLGEVLRGDRIENSPYVFEMREPKMCQIVCRSSIDDKQAKELKEKIGDEYRVNMILDNLPLVVPIAWQDRNAIVYQGGYHVGVKGQYAGSKDEKVFIHNHLTFFVKYHKDETTELSRIVGFEVKPFSINHQFEGQWND

SEQ ID NO: 11221 - DNA, 567 bp, Panicum virgatum
  misc_feature: Ceres CLONE 1726593-R
ttggcttcaccagttctactacatctttggcttccttttcctggtgttcattatcctcatcatcacctgtgcggagattacgatcgtgctttgctatttccaactgtgcagtgaggactataactggtggtggaggtcctatctcacctcgggatcatctgcaatctacctcttcctgtatgccgggttctacttcttcacaaagctgcagatcacaaaactggtgtcaggcatactgtactttggctacatgcttctggcctcgtttgcgttctgtgtgctcactggtacaatcgggttctgcgcctgcttctggttcacgagattgatctactcatctgttaagatcgactaggtttgctgacatgagactgcagagtttgataccagtacggttatcatgaaaactgtattttaggtgttcacggcgaaaacaatttatacccagtgtggttcagagatgaagataacatacatcggcagttcggcactatggagttatgtaaggacgcgggagtataggacactactgtgagcttcatatggagcattttttttatttcgggg

SEQ ID NO: 11222 - DNA, 916 bp, Panicum virgatum
  misc_feature: Ceres CLONE 1726595
  misc_feature: Encodes the peptide sequence at SEQ ID NO. 11223
  misc_feature (802)..(802): n is a, c, t, g, unknown, or other
aaaactccggcaagggtctcgtccagccgctcccccctagtcgccgccggcccgccgcaccatcaacccgcgggcaccagccaaatgcactgacggtcgccgtagcgtcgacccgtcgaccatcccgagggaggcgggcgtgccatggacgcagcggcggaggaggcgcggcgcgcgaaggaggccggcaatgaagcctacagcaagtccttcctcgagacggccgtcgagcactacacccgcggcgcgctcctcgaccccagcgacatctccttcctcaccaaccgcgccgccgcctacttccacatgggcaagtaccaggagtgcgtgagggactgcgacgaggccgtgaggcgcggcagggagctcagcgccgacaacaagctgatcgcgaaggcgctgtcgcggaaggcgtctgcgctgctcgagctcgcgggctgcgccggggactacgcgccggcagtcagggccctgcagcagtcgctggccgaacactacagcgaggagacgcttgacaggctcggcaaggcggagagcaagaggaaggagctggatgagaaggagcgacggggccaggccgccgaccaccaccgtgagagagggaatgaatcgttcaagaagaagaaataccatgaagcagcaatgcactacactcaagctatgaaaatgaacccaaaggatcctagaatttttagcaacagagctcaatgctacatctctctgggagctttacctcaaggtcttgaggatgcagagaaatgcattgaactggatcctacttttctgaaaggctatgtgcgcnaagctaaagttcagttcctgatggaagattatgaaaatgctatggcaacttaccaagagggtttgaggtgtgacccagacaatctggaaatacttgatggctttaggagatgtg

SEQ ID NO: 11223 - protein, 257 aa, Panicum virgatum
  misc_feature: Ceres CLONE 1726595
  misc_feature (42)..(75): Pfam Name: TPR_1 Pfam Description: Tetratricopeptide repeat
  misc_feature (146)..(179): Pfam Name: TPR_1 Pfam Description: Tetratricopeptide repeat
  misc_feature (180)..(213): Pfam Name: TPR_1 Pfam Description: Tetratricopeptide repeat
  misc_feature (214)..(247): Pfam Name: TPR_1 Pfam Description: Tetratricopeptide repeat
  misc_feature: SWISSPROT Homolog: EC 3.1.3.16 Phosphoprotein phosphatase
  misc_feature (220)..(220): Xaa is any aa, unknown, or other
MDAAAEEARRAKEAGNEAYSKSFLETAVEHYTRGALLDPSDISFLTNRAAAYFHMGKYQECVRDCDEAVRRGRELSADNKLIAKALSRKASALLELAGCAGDYAPAVRALQQSLAEHYSEETLDRLGKAESKRKELDEKERRGQAADHHRERGNESFKKKKYHEAAMHYTQAMKMNPKDPRIFSNRAQCYISLGALPQGLEDAEKCIELDPTFLKGYVRXAKVQFLMEDYENAMATYQEGLRCDPDNLEILDGFRRC

SEQ ID NO: 11224 - DNA, 1712 bp, Panicum virgatum
  misc_feature: Ceres CLONE 1726596
  misc_feature: Encodes the peptide sequence at SEQ ID NO. 11225
caccatcatcactccattagtgctctgctctccagtcgctcccctcccggcctcccctagctaagaaaagggccaaattaagctcgccgccgacgggagcagcagctactagctagacagagagcccggagtgatggaccttatgaggccgctggccgtggtggtggcgctgctggccgtgtgggccgccgcggcggaggggttcgacatcctccagatcctgggcaagcaggacgagttctcgcagttctgcaagctgctcaacgagacgcacctggccggcgacatcaaccgagaccgcactatcaccgtgctcgccgtggccaacggcgacatgggacacctcaccagcggccactactcgctcgggaccatccgccacatcctcgagctgcacgtcgtcgccgactactacgacgagaagaagctcaagcagctgtcgcacggcgccaccgccgcatccaccttgttccagcgatccgggtttgcccccggcatggcaggttacgtcaacataacgcagcaccgcggcggcaaggtgacatttatcgtcgatgacgcagccgactccgtgaagccggtcacctttgtcaagcagatcgagagccaccgctacgattactcggtgctccaggtcagcagtgtgctctcctcgccggaggccgaggcgcccgtggccccgccggctcccgtcaacctcaccgacctcctctccaagaagtactgcaagagcttcgcgggccttcttgctgccgacgctaaggccttcgacaccatcaacggaaccaaggacaccgcgctgacgctcttttgccctgtcgacgccgccgtggccgccttcttgcccaagttcaagaacctgacggccaaggccaagacggccatcctgctctaccacgccgtgccggactactactccatgcagttcctcaagtccaataaaggcgaggtgaccacgctcgccaccaccagcgtcgccaagaaggactacacctacgaagcgcagaccgaggctgacaccgtcacgctcgacaccacggtcaccacctctaccatccaggccaccgtcagggacgacgacccgctcgccatctacgccgtctccaagttcctgcagcccaaggagctgtttaagtccaaaaccaaggacctcgcgccggcgcccgcgccagaggaggccaagaagaagaccaagaagaagcccggcagcacctcgacggctgccgcgccctcaggcgacgaagccgcggacggcccggctgccgacaactcagctgacgacgctgcggacaaggccggcgccgcgccgtctccgctcgtccggtgggtcaccgcggttgcgacggtggcagccgtgctggcgctggtggcctaaggtgtgccctgatgtgttatgttttctttttaacttattggaaccctcttcttttctttgtccaattcgtgtcccttgttggtgcagaaaataagaagggtcattttactttatttttatatttattgctgcattctcatggaaaaggggaaaaaaagaggaaagcttagaggtgtgtcagatcatgtagctctttggattgtggtgatcattttgtaatgatagtgatcaatggaattgaagagtgtgtttatatgtgcactacgatgcatcacggagtttagagttgtatactcccaccgttttgctttcggtctgtccaagcttgagctttcgg

SEQ ID NO: 11225 - protein, 413 aa, Panicum virgatum
  misc_feature: Ceres CLONE 1726596
  misc_feature (197)..(329): Pfam Name: Fasciclin Pfam Description: Fasciclin domain
  misc_feature: Useful for making plants with altered carbohydrate content
MDLMRPLAVVVALLAVWAAAAEGFDILQILGKQDEFSQFCKLLNETHLAGDINRDRTITVLAVANGDMGHLTSGHYSLGTIRHILELHVVADYYDEKKLKQLSHGATAASTLFQRSGFAPGMAGYVNITQHRGGKVTFIVDDAADSVKPVTFVKQIESHRYDYSVLQVSSVLSSPEAEAPVAPPAPVNLTDLLSKKYCKSFAGLLAADAKAFDTINGTKDTALTLFCPVDAAVAAFLPKFKNLTAKAKTAILLYHAVPDYYSMQFLKSNKGEVTTLATTSVAKKDYTYEAQTEADTVTLDTTVTTSTIQATVRDDDPLAIYAVSKFLQPKELFKSKTKDLAPAPAPEEAKKKTKKKPGSTSTAAAPSGDEAADGPAADNSADDAADKAGAAPSPLVRWVTAVATVAAVLALVA

SEQ ID NO: 11226 - DNA, 1833 bp, Panicum virgatum
  misc_feature: Ceres CLONE 1726599
  misc_feature: Encodes the peptide sequence at SEQ ID NO. 11227
aaaaacagaggaggaaaagccagggaaaaaaaatatcacgctcctcttcctccgttcccctgctcgattccccgcgaggaattcgcccccaaatctatcgatctgctctacccagtccaccaatccgtggatcgatccgcgcgcgtgtccggtttgccccggggttccgatctggtcttcgcctcgtcaggggaggagccggaggagaagatgaacggcgccgggggcagccaccagcaacagcagcagaggctccggcagcagcagcagcagcaggcgctcctgatgcagcaggcactgcagcagcagcagcagcagtaccagtccggcgtcctcgcggcagcggcagcggccgccatgacccagatggaacctatttccaatggcaatcttccacctgggtttgatccttccacttgtcgcagtgtgtatgtggggaatgtgaacccaaacgtcaccgagagccttctgattgaagttttccagagtgctggccttgtggaaagatgcaagctcatcaggaaagagaagtcttcctttgggtttgtggattactatgatcgaagatctgctgctctagcaataatgacccttcatggccgtcacatatatggacaagcaatcaaggtgaactgggcatacgccagtacacagagggaggacacatctgggcatttccatatttttgttggtgatttaagttctgaagtgaatgatgcaactctttatgcctatttctcagcatatccctcttgttctgatgctcgagtcatgtgggacaacaaaaccgggcgctccagaggttatggttttgtctccttccgtaatcaacaggaagctgaaactgctataaccgaaatgtctggaaaatggcttggaagcagacaaataaggtgcaactgggcaacaaagaacaattcagaagagaaaccagaaactgacaatcacaatgcagttgtactaacaaatggtggctcaagtaattcagcaacagatgcaagccaggatggaggaagtaaagagaacccagagcacaaccctgattgtactactgtatatgttggcaaccttggacatgaggttaaccgagatgagcttcaccgccacttctataacttaggggtcggggcaatcgaggaaattcgtgttcaacaggagaaagggtttggatttgtgagatatagcacccatggtgaagcagcattagctattcagatggccaatggattggtggtccgtgggaaacctcttaagtgctcatggggcaacaaaccaactccacctgggactgcatccaagcccctaccccctccagttgctccataccagcctgctgttgcaatgccaggcgtcccgcaaggcttcacagcagctgagcttctggcttatcagaggcagcttgccttgagccaggctgcagcagggcagattgcagggcagcacggtctcgcggggcaggtatctgctgggctgcttgctggttcccaggccctctacgatggctacccaaaccagtcatctgcccagcagcttatgtactacaactagggttcgagaggaaggcatttgtagtgttcagcttgcttggtgcaagcctggccctcctcgtcctgtttttattttctggtacatgtactatttgtgtgagagtttttcttgttctcttgttgcgggattgtattactatcctcgtactgtaccattgaccatcattttccatgtctaattccgttgagtagtccactttaacagagtaagagatgtattctatgtgaatttgtgattgattaatgtaatgctccctaggatcggcttcggtctctggtatgcttc

SEQ ID NO: 11227 - protein, 445 aa, Panicum virgatum
  misc_feature: Ceres CLONE 1726599
  misc_feature (158)..(229): Pfam Name: RRM_1 Pfam Description: RNA recognition motif. (a.k.a. RRM, RBD, or RNP domain)
  misc_feature (282)..(349): Pfam Name: RRM_1 Pfam Description: RNA recognition motif. (a.k.a. RRM, RBD, or RNP domain)
  misc_feature (73)..(140): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
MNGAGGSHQQQQQRLRQQQQQQALLMQQALQQQQQQYQSGVLAAAAAAAMTQMEPISNGNLPPGFDPSTCRSVYVGNVNPNVTESLLIEVFQSAGLVERCKLIRKEKSSFGFVDYYDRRSAALAIMTLHGRHIYGQAIKVNWAYASTQREDTSGHFHIFVGDLSSEVNDATLYAYFSAYPSCSDARVMWDNKTGRSRGYGFVSFRNQQEAETAITEMSGKWLGSRQIRCNWATKNNSEEKPETDNHNAVVLTNGGSSNSATDASQDGGSKENPEHNPDCTTVYVGNLGHEVNRDELHRHFYNLGVGAIEEIRVQQEKGFGFVRYSTHGEAALAIQMANGLVVRGKPLKCSWGNKPTPPGTASKPLPPPVAPYQPAVAMPGVPQGFTAAELLAYQRQLALSQAAAGQIAGQHGLAGQVSAGLLAGSQALYDGYPNQSSAQQLMYYN

SEQ ID NO: 11228 - DNA, 837 bp, Panicum virgatum
  misc_feature: Ceres CLONE 1726603
  misc_feature: Encodes the peptide sequence at SEQ ID NO. 11229
aagccgctgctttcgccgcatccctcctcctcctctcgatctgattcggagcgagatcaacagcaaaccaagatgcattcgacgaatctcctgctcgaggagcccatccgcatggcctcaatcctcgagccatccaagaccagcttcttcccggcgatgacgaagatcgttgggacgctcgggcccaagtcgcgctccgtcgacaccatctctgcctgcctcaaggccggcatgtccgttgcgcggttcgatttctcgtggggagacgccgcctaccaccaggagacgctcgagaacctcaagctcgccatcaaggccaccaagaagctatgcgccgtcatgcttgatactgtcggccccgagttgcaggtggtgaacaagaatgaaacaccaatttcccttgaggagaatggcactgttgttctcacacctcatcaggggcaagaagcctcctccagcttgctgcccatcaacttctccggactcgccaaggctgtgacaccgggcgcaacaatatttgtggagcaatacttgttcaccggcagtgagactacttcagtttggttggaggtttctgaagttcaaggagatgatgtggtctgtataatcaagaacacagctacattggctgggtcactgttcacactgcattgctcccagattcatattgacttgccaacgctatctgatgaggataaggatgttatcagaaaatggggtgctccaaataagattgactttctctctttgtcttacacaaggcatgctgaagatgtgcggcaggcacgggagttcctctcaaaattgggcgatctcagccaaactcagatttttgca

SEQ ID NO: 11229 - protein, 254 aa, Panicum virgatum
  misc_feature: Ceres CLONE 1726603
  misc_feature (30)..(254): Pfam Name: PK Pfam Description: Pyruvate kinase, barrel domain
  misc_feature: SWISSPROT Homolog: EC 2.7.1.40 Pyruvate kinase
MHSTNLLLEEPIRMASILEPSKTSFFPAMTKIVGTLGPKSRSVDTISACLKAGMSVARFDFSWGDAAYHQETLENLKLAIKATKKLCAVMLDTVGPELQVVNKNETPISLEENGTVVLTPHQGQEASSSLLPINFSGLAKAVTPGATIFVEQYLFTGSETTSVWLEVSEVQGDDVVCIIKNTATLAGSLFTLHCSQIHIDLPTLSDEDKDVIRKWGAPNKIDFLSLSYTRHAEDVRQAREFLSKLGDLSQTQIF

SEQ ID NO: 11230 - DNA, 770 bp, Panicum virgatum
  misc_feature: Ceres CLONE 1726603-R
  misc_feature: Encodes the peptide sequence at SEQ ID NO. 11231
ctgagaaagtattcaacccagatttatactacaagcgaactctgaaatatgtgggggaaccgatgacgcacttggaggccattgcttcctcagcggtgcgagctgctatcaaggttaaggcatctgtgatcatttgcttcacctcttctggacgggctgcaaggctaattgcgaagtacaggcccagcatgcctgttctttctgttgtcattcctcgtctaaagacaaaccaactgaagtggagtttcaccggtgcttttgaggcaagacaatcacttgtagttagaggcctctttccgatgcttgctgatccacggcatccagctgaatctaccagcgctacaaatgagtcagttctgaaggttgctcttgaccacggcaaagcctctggtgtgatcaagtctcatgaccgtgtagttgtttgccagaaagtgggagattcatcagttgtgaagatcattgagctggatgactagacgcatgttcactactaggacatattttgccgatttttgctgagccaaaacttgctgtctatgtataatcatatagcttcgcagaatgagcagtttttcctatggtgtcatcataggatttgctttgcagtttaaaactcgtacggcgcagtttggaagttgttttaattacccgtagcaacttattggcaatttgctagtactgtaccacctaaatgggcagatggaacaatgagatcatactgtaccctttatccttctatattgtttgacctgagcctgttttcccctcac

SEQ ID NO: 11231 - protein, 157 aa, Panicum virgatum
  misc_feature: Ceres CLONE 1726603-R
  misc_feature (24)..(154): Pfam Name: PK_C Pfam Description: Pyruvate kinase, alpha/beta domain
  misc_feature: SWISSPROT Homolog: EC 2.7.1.40 Pyruvate kinase
EKVFNPDLYYKRTLKYVGEPMTHLEAIASSAVRAAIKVKASVIICFTSSGRAARLIAKYRPSMPVLSVVIPRLKTNQLKWSFTGAFEARQSLVVRGLFPMLADPRHPAESTSATNESVLKVALDHGKASGVIKSHDRVVVCQKVGDSSVVKIIELDD

SEQ ID NO: 11232 - DNA, 1974 bp, Panicum virgatum
  misc_feature: Ceres CLONE 1726606
  misc_feature: Encodes the peptide sequence at SEQ ID NO. 11233
atctcccgcgtttcttattttccccttgctaccctgctctacccgaggctatccacttctctggttctcccaattttttcccccaatctcccctcctcttcccggcagcagatagaagctgtacctgttcctcttcgatttggctcgtcttatctcctggcgctcaaaagctcaagcctttccagggctgggaggcgacaaatcggaggggattcggagcgcaaagcttctgtatccaatccagggggggaagggttgcgaggttttctgcatccaaagttgggcgcttttgcttattctccttaacagaaatcgcttgctttgtgtaggaaagccagatcttgtccacagatacgggtttgaaatctgtgagcgagtcgacgaacaagatagggctcactttgaagatcttggtcaccacaagaaatttgcagttattgtgccttctcactggacatgtctttccacagcataatccgtgatgttagggaaagctttggtagcttatcaagacggagttttgaggttagaatttctggtctgcctggtcttggtcatcacagagggaaatctgttggatctgtgagcaacctgcacgatggacctatagtagttgatcaaagcaggtgggttggtcttcctcccgaattgcttcgagatgtaatgaaaaggcttgaggaaggtgagagcacttggccatcccgcagagatgttgttgcttgcgcagcagtttgtggaacatggagagagatatgcaaggacatagtgccgagtccggaatttggtggaatgctcacttttccagtgtcacttaaacagccgggacctagagatggaataatacagtgttttataaaaagggacaaatcaacatcaacttattatctttacctatgtcttagtcctgctgtcctcagtgagaacgggaaatttctactagcagctaagaggaatcgtcgtacaacttatactgagtacatcatttctatggatcctaaaaatatatcacgttcaagtaatggctacgttggaaaaatgaggtcaaattttcttggcacgaaattcgtcatatacgacactcagccgccatacaatgctgggagtcttgtttcatgcgggcgtggcagccgtagaatctcctctaggagggtttcccccaaggtacccgctgctagctatcccattgcccgggtgaactatgagctaaatgtgcttggcacaagggggcccaggcgtatgaattgcaccatgcattccatcccagcctcagcactggaacctgaaggcatggtccctggccaacccacgcaactcttcctccctggcacttctgcctatgaagaatcctttcgtagtgtaaataccgcttccagctcaaggttctcggttacagaccactcattggacttcagctcctctcgtttctcagaggtaagcagagtgatccagcaaggtgaggatgatggtcaggccaaggagaggcctttggttctccgcaataaagagccaaggtggcacgagcagctgcagtgttggtgcctcaacttccgtggccgggtgacagtggcttctgtgaagaactttcagttgatagctgcgccattgttagatgctgtgccctctgaattgacgcagcaggctcagcagcaaacccagccttcgagttcatcttcagcatccgatcatgataaggtgatcctgcagtttggaaaggttgccaaggacatgttcacaatggactaccgatacccgctctcagcattccaggccttcaccatctgtttgactagctttgacaccaagctggcttgtgaatagattagagataagaacaggcatgtaggtcagtaagtatttatatggtgtgtgtgtgcgtgtcaaagctaagaaccggcaattgttctaagctgcaggtgtttggtacaatttttcatgtctgtaacctgtaatggtgaaacgtgcagacattacctc

SEQ ID NO: 11233 - protein, 453 aa, Panicum virgatum
  misc_feature: Ceres CLONE 1726606
  misc_feature (122)..(447): Pfam Name: Tub Pfam Description: Tub family
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
MSFHSIIRDVRESFGSLSRRSFEVRISGLPGLGHHRGKSVGSVSNLHDGPIVVDQSRWVGLPPELLRDVMKRLEEGESTWPSRRDVVACAAVCGTWREICKDIVPSPEFGGMLTFPVSLKQPGPRDGIIQCFIKRDKSTSTYYLYLCLSPAVLSENGKFLLAAKRNRRTTYTEYIISMDPKNISRSSNGYVGKMRSNFLGTKFVIYDTQPPYNAGSLVSCGRGSRRISSRRVSPKVPAASYPIARVNYELNVLGTRGPRRMNCTMHSIPASALEPEGMVPGQPTQLFLPGTSAYEESFRSVNTASSSRFSVTDHSLDFSSSRFSEVSRVIQQGEDDGQAKERPLVLRNKEPRWHEQLQCWCLNFRGRVTVASVKNFQLIAAPLLDAVPSELTQQAQQQTQPSSSSSASDHDKVILQFGKVAKDMFTMDYRYPLSAFQAFTICLTSFDTKLACE

SEQ ID NO: 11234 - DNA, 790 bp, Panicum virgatum
  misc_feature: Ceres CLONE 1726610
  misc_feature: Encodes the peptide sequence at SEQ ID NO. 11235
gacggggggcaccaccacgcgggaccctctctaatctaaagaactaacggaatccccaaaaaacaactcgccggcgacgatggcagcgcctgcgagctcgggggaggcgatggaggaggtggaggtggggggctacaggctgcagagtctggtgggaaagggcgcgtacgccgaggtgttccgcgccgcgcaccgggtcaccggcgcgcgcgtcgcggtgaaggcgatcgaccgccggcgactcgagaagcgcgtccacgacgggatcctcaaggagagggagatcctcaagagcatcgatcaccccaacatcctccgcctcctcgacaccatcgacacgacggatgtcatgtacttagttctggagtactgcgatggaggcgacctcgataaatttttggacaagcacggccgtttgccggtggccaccgccaaggactttatgcggcagctcgcggaagggctgaagatgctgaggcagaggaacatcgtccatagggacctcaagccacagaaccttctcctatcaaccaatggtgatgccattatattgaaaatcggcgactttgggtttgccaagcatgaaaatttagctgccacaatatgtggttcgccatattatatggccccaaaaatttggcaagggaaggactacgatgcaaagtcagacttgtggagtgttggggtcattctttttcagctagtcactgggaagttgccatatcgtgggattacctgtttccagctgcaccaaaacatcctagcttctgatgaacttaacttcccttca

SEQ ID NO: 11235 - protein, 236 aa, Panicum virgatum
  misc_feature: Ceres CLONE 1726610
  misc_feature (19)..(235): Pfam Name: Pkinase Pfam Description: Protein kinase domain
  misc_feature: SWISSPROT Homolog: EC 2.7.11.1 Non-specific serine/threonine protein kinase
MAAPASSGEAMEEVEVGGYRLQSLVGKGAYAEVFRAAHRVTGARVAVKAIDRRRLEKRVHDGILKEREILKSIDHPNILRLLDTIDTTDVMYLVLEYCDGGDLDKFLDKHGRLPVATAKDFMRQLAEGLKMLRQRNIVHRDLKPQNLLLSTNGDAIILKIGDFGFAKHENLAATICGSPYYMAPKIWQGKDYDAKSDLWSVGVILFQLVTGKLPYRGITCFQLHQNILASDELNFP

SEQ ID NO: 11236 - DNA, 784 bp, Panicum virgatum
  misc_feature: Ceres CLONE 1726610-R
tctctgaatcttctacagaatatgtcctgcctaggagtgatcattcatctccgaatgcggcgcgaggatgggacttcagtagacctgtttctgttcgttcgtgggttgaaagtgggttcatgaaagcatatgatcgtgccgagaagatatcacatatattgcggaagagttatgataacactgagatgcccgatgcaatggatgtcatattcaaaactgctttagaatatgggaaaagtggtgcggcgaatgaagttttgggataccgtagtaaatcagcgtcgctatattcaaaatctatcatcttgctcacattcatattgcaagaagcacctacgttgccactaaatcctccattttccccttcacagtcagagcaacaacgcatccatagctacatagctaatttgaagagccatatctgcagtgctcaggttgcggggcaacagcagagaatagttcataactaatttccggcatcatggctaagctttttgtcctccatactgtttttgtctagggaggtgttcagtgtattggtgacatctgatgtcatgaactcttgtatatataacattatatagttgcagaacgccatggtccatcagaccatcagccatttcttttgcacataacacttagtgaagctctatggtagcccctaactgctttgtgcaaaatgctgaggtgacctaaaacttgtacatgctttatgcaaaatgtaaatagaaactgtttcaacacttctttataatcgtctagtctcctttcaagttttggagcg

SEQ ID NO: 11237 - DNA, 837 bp, Panicum virgatum
  misc_feature: Ceres CLONE 1726617
  misc_feature: Encodes the peptide sequence at SEQ ID NO. 11238
ttcgtctctcattttccgcgctcgcgcgctcccgccacacacaccccccaaccttcctcgcttctccagactctagcctcgccaaggcttcctgatcaggttgggagcgcaggagaggagcttggaaggatggcgtcggtttccagggctgtctgcggcgtgcagatgccgtgcttgaacggcagggagacgcccgccggccgccgatcggtcgcggcgccgaaggcccggaacgccaagcggggcgtcatccgctccgtgtcggtctccggctccggctccgtctccggccgcggccagcattgcgcgcctgccgacgccgtcgccgacgccgcgccaattacagcgacaaagagggtgttccccttcggcaagggcaagagcgagggcaacaggggcatgaaggatctgctgggcgggaagggcgcgaacctggcggagatgtcgagcattgggctgtcggtgccgccggggttcacggtgtcgacggaggcgtgccagcagtaccaggaggccgggcgcgcgctgccggcggggctctgggcggagatcctcgacggcctggcgtgggtggaggagtacatgggcgcgcgcctcggcgacccacagcgcccgctcctgctctccgtccgctccggcgccgcggtgtcgatgcccggcatgatggacacggtgctcaacctggggctcaacgacgaggtggccgccggcctggccgccaagagtggcgagcgcttcgcctacgactcgtaccgccgcttcctcgacatgttcggcaacgtcgtcatggacattccccatgcactgttcgaggagaagcttgagcacatgagggaa

SEQ ID NO: 11238 - protein, 235 aa, Panicum virgatum
  misc_feature: Ceres CLONE 1726617
  misc_feature (76)..(230): Pfam Name: PPDK_N Pfam Description: Pyruvate phosphate dikinase, PEP/pyruvate binding domain
  misc_feature: SWISSPROT Homolog: EC 2.7.9.1 Pyruvate, phosphate dikinase
MASVSRAVCGVQMPCLNGRETPAGRRSVAAPKARNAKRGVIRSVSVSGSGSVSGRGQHCAPADAVADAAPITATKRVFPFGKGKSEGNRGMKDLLGGKGANLAEMSSIGLSVPPGFTVSTEACQQYQEAGRALPAGLWAEILDGLAWVEEYMGARLGDPQRPLLLSVRSGAAVSMPGMMDTVLNLGLNDEVAAGLAAKSGERFAYDSYRRFLDMFGNVVMDIPHALFEEKLEHMR

SEQ ID NO: 11239 - DNA, 1799 bp, Panicum virgatum
  misc_feature: Ceres CLONE 1726628
  misc_feature: Encodes the peptide sequence at SEQ ID NO. 11240
agcagaccaactcatcaagcgagcaagcactagcaggaggtctagctaccctctgctcctcgccctagcttgtgcaggtacggtatagccatggacgagttcttctaccagtcgctgctcctctccgtggcggccgtcgcgctgctgcagctggtgaagctggcgctgaagccgcggcggcggctgccgccggggccctggcggctgccggtggtcggcagcatgcaccacctcgtgaacgtgctaccccaccgcgcgctgcgggacctggcggccgcgcacggcccgctcctgatgctgcagctcgggcagacgccgctggtggtggccacgtccagggagacggcgcgcgccgtgctcaagacgcacgacaccaacttcgccacccggcccaagctcctggccggggagatcgtcggctacgagtgggtggacatcctcttcgcgccctccggcgactactggcgcaagctccgccagctctgcgccgccgagatcctcagccccaagcgcatcctctcgttccgccacatccgggaggacgaggtgatgctgaaggtggaggagatccgcgcggcggggccggggacgcccgtgaacctgagcgtcatgttccacagcatcaccaacagcgtcgtgtcccgggcggcgttcgggaagaagcgcaagaacgccgccgagttcctggcggcgaccaaggccgtggtcggcctctccagcggcttcaacatccccgacctgttcccgacctggaccgccgtgctggccaagctcaccggcatgacgcgcagcctcaaggagatccaccggacggtggacaccatcctcgaggagatcatcgaggagcgcaaggccgcccgcgccgacaagatccggagcggcgtccccgccgaggacgtcgacgagaacctcgtcgacgtgctcatcggcctgcaggagaaaggaggcttcggtttccaactcaccaacagcatcatcaaggccatcatactggacatgttcgcgggcggcacgggcacgtcggggtcggccatggagtgggggatgtcggagctgatgcggaacccggcggtgatgaagaagctgcaggggcagatcagggaggcgttccgtgggaaggcggtggtgacggaggacgacctgcaggcgagcaacctccagtacatgaagctggtgatcaaggaggcgctgcggctgcacccgccggcgccgctgctggtgccccgcgagagcatcgaggagtgcgagctcgacggctacacgatcccggccaagtcgcgggtcatcatcaacgcgtgggccatcggccgcgaccccaagtactgggaggaccccgacgagttcaagccggagcggttcgaggacggctcccgcgacttcaccggcggcagctacgagttcctccccttcggctccggccggcggatgtgccccggcttcaactacgggctcgccagcatggagctcgcgttcgtcgggctgctctaccacttcgactggtcgctgccggagggcgtcagggaggtcgacatggcggaggcgcccgggctcggcgtccgccgccgcacgccgctggtgctctgcgccaccccgtacgtcccggtcgccggcggcgcctagctagctggcagctggcggctacgtacggcgcggcctcgttttcccgttccctccgatccgtccatctcgcgctgagtgctcgagtagttgtgttgtgcactattattattactgcgaaccttgcacctaaaatttggagtttgtactaaagtcggtggtaataaagtcaaattatatac

SEQ ID NO: 11240 - protein, 509 aa, Panicum virgatum
  misc_feature: Ceres CLONE 1726628
  misc_feature (33)..(499): Pfam Name: p450 Pfam Description: Cytochrome P450
  misc_feature: SWISSPROT Homolog: EC 1.14.13.68 4-hydroxyphenylacetaldehyde oxime monooxygenase
MDEFFYQSLLLSVAAVALLQLVKLALKPRRRLPPGPWRLPVVGSMHHLVNVLPHRALRDLAAAHGPLLMLQLGQTPLVVATSRETARAVLKTHDTNFATRPKLLAGEIVGYEWVDILFAPSGDYWRKLRQLCAAEILSPKRILSFRHIREDEVMLKVEEIRAAGPGTPVNLSVMFHSITNSVVSRAAFGKKRKNAAEFLAATKAVVGLSSGFNIPDLFPTWTAVLAKLTGMTRSLKEIHRTVDTILEEIIEERKAARADKIRSGVPAEDVDENLVDVLIGLQEKGGFGFQLTNSIIKAIILDMFAGGTGTSGSAMEWGMSELMRNPAVMKKLQGQIREAFRGKAVVTEDDLQASNLQYMKLVIKEALRLHPPAPLLVPRESIEECELDGYTIPAKSRVIINAWAIGRDPKYWEDPDEFKPERFEDGSRDFTGGSYEFLPFGSGRRMCPGFNYGLASMELAFVGLLYHFDWSLPEGVREVDMAEAPGLGVRRRTPLVLCATPYVPVAGGA

SEQ ID NO: 11241 - DNA, 704 bp, Panicum virgatum
  misc_feature: Ceres CLONE 1726631
  misc_feature: Encodes the peptide sequence at SEQ ID NO. 11242
acactcccaacctcgaacgccaagctgagcaagcaggccgagcggcaagcgcgcacatccgcctccaatcctccgtgcagccagctcgacctgtccatggcgccgaggaggtccccttcgccggccggaagcagcagcagcggcggcggctgcagcgcggagcgcgcggcggccgagcagcagcagcagccgaggctccgcggcgtgcggaggcggccgtggggccggtacgcggcggagatccgcgacccggcgcggaaggcgcgcgtgtggctgggcaccttcgacacccccgaggaggccgcgcgggcctacgacgccgccgcgcggaagctccgcgggccacgcgccgccaccaactaccccgcggcggccgatgattcgccgtgcctgttcctggacccggcgccgacgaagacggtggtgcggcagttcctgccgccgctgaagggggccgaccaagagcggagctgcgggtacccgggggcggcggcggcgtcggtgggcctcgggctggacctcaacctgcctccgccggccgagatggtgatgtagcggcggaaatggaattggccgatcgagccgcccaagatgatgctcatgcagtcatgctgctagctagctgccacgaatgtactcttagctagtagctcatgcagtaaaaaataggcagctagtagctcctagctcgtgtttcttttgtg

SEQ ID NO: 11242 - protein, 152 aa, Panicum virgatum
  misc_feature: Ceres CLONE 1726631
  misc_feature (32)..(83): Pfam Name: AP2 Pfam Description: AP2 domain
  misc_feature: Useful for making plants with altered lignin content
  misc_feature: The sequence is a functional homolog of SEQ ID NO 1769 in the 10/374,780 US patent application
MAPRRSPSPAGSSSSGGGCSAERAAAEQQQQPRLRGVRRRPWGRYAAEIRDPARKARVWLGTFDTPEEAARAYDAAARKLRGPRAATNYPAAADDSPCLFLDPAPTKTVVRQFLPPLKGADQERSCGYPGAAAASVGLGLDLNLPPPAEMVM

SEQ ID NO: 11243 - DNA, 664 bp, Panicum virgatum
  misc_feature: Ceres CLONE 1726631-R
  misc_feature: Encodes the peptide sequence at SEQ ID NO. 11244
ttcaccattggaagctgtgggtcccaagggatgaacggcatgaacgagagcaagctggtggatctgctcaacggctccgagtacgtgccgacctacgaggacaaggacggtgactggatgctcgtcggcgacgttccgtgggagatgttcgtcgaatcgtgcaagcgccttcggatcatgaagggatcagaagccattggcctggcgcccagggccatggagaaatgcaagaacagaaactgaacacatggggccgccagatgcaagaaccaagtctagctctgcagctctgctcgtctctgtatcatactcgtccctgttctccaagcctgtacctcctgatcagtgaagtcattttggtgtgtcaactgttctatcagttccagtgagtcagtcagccagccaggcagtcagtcagtcagtgttcaagtctcatcttgtcatatacaaaagagagaagccaggaacatgtacctgtcctgtcctataacaatgtctttttgctctacctgctctttttatttttgggcacaaaatgcaaaggcaccctgctcctaatcaaggggcccttttgcatcttgtccaccaaaagttgtttaattatattaccatggtgtgtcaatggaacaaataattgttgcaagctgttaaaaaaatgtattgt

SEQ ID NO: 11244 - protein, 80 aa, Panicum virgatum
  misc_feature: Ceres CLONE 1726631-R
  misc_feature (1)..(72): Pfam Name: AUX_IAA Pfam Description: AUX/IAA family
  misc_feature: The sequence is a functional homolog of SEQ ID NO 2006 in the 10/374,780 US patent application
  misc_feature: The sequence is a functional homolog of SEQ ID NO 288 in the 10/412,699 US patent application
  misc_feature: The sequence is a functional homolog of SEQ ID NO 664 in the 11/479,226 US patent application
  misc_feature: Useful for making plants with altered terpenoid content
  misc_feature: Useful for making plants with modulated nitrogen use efficiency
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: Useful for making plants with altered alkaloid content
  misc_feature: The sequence is a functional homolog of SEQ ID NO 890 in the 10/412,699 US patent application
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: The sequence is a functional homolog of SEQ ID NO 739 in the 10/374,780 US patent application
  misc_feature: The sequence is a functional homolog of SEQ ID NO 738 in the 10/374,780 US patent application
  misc_feature: The sequence is a functional homolog of SEQ ID NO 736 in the 10/374,780 US patent application
  misc_feature: The sequence is a functional homolog of SEQ ID NO 204 in the 10/225,066 US patent application
  misc_feature: The sequence is a functional homolog of SEQ ID NO 292 in the 10/412,699 US patent application
  misc_feature: The sequence is a functional homolog of SEQ ID NO 40 in the 10/225,068 US patent application
  misc_feature: The sequence is a functional homolog of SEQ ID NO 82 in the 10/374,780 US patent application
  misc_feature: The sequence is a functional homolog of SEQ ID NO 1780 in the 10/412,699 US patent application
  misc_feature: The sequence is a functional homolog of SEQ ID NO 2008 in the 10/374,780 US patent application
  misc_feature: The sequence is a functional homolog of SEQ ID NO 678 in the 11/479,226 US patent application
  misc_feature: The sequence is a functional homolog of SEQ ID NO 686 in the 11/479,226 US patent application
FTIGSCGSQGMNGMNESKLVDLLNGSEYVPTYEDKDGDWMLVGDVPWEMFVESCKRLRIMKGSEAIGLAPRAMEKCKNRN

SEQ ID NO: 11245 - DNA, 2454 bp, Panicum virgatum
  misc_feature: Ceres CLONE 1726635
  misc_feature: Encodes the peptide sequence at SEQ ID NO. 11246
atcccccgcgagaaccggtcagatatttatgagcgcagccgcgagtgaaccttccctccccgctctcgtgttcgtgcttgcagtcgcagtcgcaagcgccaagcggtggagctgagccgcgagggggataagcgcaagcccgggggcgtggctgggttggcggcttcggcggcggcggcggcccgctggtctccggaatggcgtgggaggtgacgaaggctttgggctttaaatacaccttaattgggtgataagatagtcgcagtgcagctaccagtttcttacaagcaaaatccttgataccaagggaagtgactggattttgttcaaccttgtacaaaaaatcatgggtggcgtctgctccaggaagaggagccaattggtggatgagggagactctctccaggcatccccaaggttctcaaaaaccagcagcttgaaatggttgctgctatcactgccccgcaccaattctaatgtctcccgcaggggacaaggggaggggccagggcggtgcccgtcccttatggagctttgtgtggctagagtctgcaaggatatcgacaaatattctagtttcatgatgctgccgagggatctcagccagcagattttcaataagctagtagaatcaaactgtcttacagaggcatcgcttcaaacatttagggattgtgctctgcaggacatttgcttaggggagtaccctggaatgaaggatgcttggatggaagtagtggcatctcaaagaaaatcattgttattggttgatatttcttgctctgaagtaactgatagtgggatagatcttcttagagattgctcaagcatacaaagtttggcatgtaattactgtgatcaaatttccgaacatggcctgggaatgttgtcaggactttcaaacctgagttctttaagtttcaagagaagtaatggtgttactgctgaaggaatgagagccttcgcaaatttaattaacttagtaaatctcgaccttgaaggttgcctaaagattcatggtggccttattcatttaaaagatctgacaaagctggaatcactgaatctgagatattgcaatcatattgcagattcagatatcaaatatttaacagatcttaccaatttgaaggaccttcaattgtcatgttgtagggtcacagatctgggtatatcctatcttagaggcttgtcgaagctcactcacttgaacctagagggctgcccagtgactgctgcttgtttggaagctattacaggattggcttcattgatattgttgaatttgaatcgttgtggtatatacgatgatggctgtgaacactttgaaggtcttaaaaaactgaaggttctaaacttggggtttaactatattacagatgcttgtttggtgcatctcaaagaattaatcaatttggagtccttgaacatggattcatgcaaggttggagatgatggcctacagcatcttaaaggccttgtgctactacaaagcttggagctttctgatactgaagttggaaacaacggaatacagcatctatctggccttcgtaatctgcaaagtatcaatctctcatttactttggtcacggacattggtatgaagaagatctccatgctgaatgcgctgaagtcggttaatcttgacaaccgccaaattactgatgttggcttggcagcacttacaagtctcaccgggctgactcatcttgacctttttggagctcacataactgactatggtgcaaactgcttcagatgttttaagaatcttaagtctcttgaggtctgtggtgggttcatcaccgatgctggagtgaagagcatcaaggatctgaaagctctgacgcttctgaacctatctcaaaatgttaaccttacggacaaaaccttggagctgatttctggcttgaccgctttggtcaacttgaacgtctcaaactcccgggtgtccaacgccggtctcaaacacctgaaggacctgcagaacctgcgctcgctgtccctggactccaccagggtcacggcatatgagatgaagaagctccaggcgacgactctgcctaatctgatcagcatgcggcctgagtagcttgccagtcgccatccggcgcctgctgtaaataatcgtcaggctgttctggataggtctagccctggcccctggaagagcctgaggtgaaggcggacatataagttaatgataccgttagtgtgtggcgggtctagtgctgggtgtcaacgtgcccgtcgttcgggtcgtttcgggatgccgtagaactgggctgttgctttgcgccgtgcgtgcaccctccaaggcgcgacgggaagaaacagaattgtaaatagcgcgcttcctcgccatctgggatgctttatgctgtatgttgtcgtgtgtcaaacatgctatttccgtgttaaattggagctgggtgtcttgcgttctggttc

SEQ ID NO: 11246 - protein, 582 aa, Panicum virgatum
  misc_feature: Ceres CLONE 1726635
  misc_feature: SWISSPROT Homolog: EC 2.7.11.1 Non-specific serine/threonine protein kinase
MGGVCSRKRSQLVDEGDSLQASPRFSKTSSLKWLLLSLPRTNSNVSRRGQGEGPGRCPSLMELCVARVCKDIDKYSSFMMLPRDLSQQIFNKLVESNCLTEASLQTFRDCALQDICLGEYPGMKDAWMEVVASQRKSLLLVDISCSEVTDSGIDLLRDCSSIQSLACNYCDQISEHGLGMLSGLSNLSSLSFKRSNGVTAEGMRAFANLINLVNLDLEGCLKIHGGLIHLKDLTKLESLNLRYCNHIADSDIKYLTDLTNLKDLQLSCCRVTDLGISYLRGLSKLTHLNLEGCPVTAACLEAITGLASLILLNLNRCGIYDDGCEHFEGLKKLKVLNLGFNYITDACLVHLKELINLESLNMDSCKVGDDGLQHLKGLVLLQSLELSDTEVGNNGIQHLSGLRNLQSINLSFTLVTDIGMKKISMLNALKSVNLDNRQITDVGLAALTSLTGLTHLDLFGAHITDYGANCFRCFKNLKSLEVCGGFITDAGVKSIKDLKALTLLNLSQNVNLTDKTLELISGLTALVNLNVSNSRVSNAGLKHLKDLQNLRSLSLDSTRVTAYEMKKLQATTLPNLISMRPE

SEQ ID NO: 11247 - DNA, 730 bp, Panicum virgatum
  misc_feature: Ceres CLONE 1727407
  misc_feature: Encodes the peptide sequence at SEQ ID NO. 11248
aaggcttccatttccaacgatggagctcgcagcaacgttgtccatggccatggcattggtggctgtcttggtagtcttcgtcctcagctccgtcgtcctgccacgaggccggcggaaggcactgaaccttccgccggggccgcggggttggccggtgctcggcagcctcggcgttctggcgggcgcggccccgccgcaccgcgggctggccgcactcgcggcgcgccacggcccgctcatgcacctccgtctcggctcctaccacaccgtggtggcctcgtcggcggagaccgcccgcctcgtcctcaagacccacaacctcgccttcgccgaccgcccgcccacggccgccggcgagatcacctcctacggctaccggggcatcgtgcacacgccgtacgggtcctactggcgcatggcgcgcaagctctgcgccaccgagctcttctcggcgcgccgcgtcgactcgttcgagcgcgtctgcgcgcaggagatgcgcgcgctggcgatcggcctgttccggtgcgccggccgcgccgtcgccgtccgggagcacgtcgccggcgccacgctgcggaacatcctccgcatggctgtcggggagaagtggtcgggctgctacggcagcgccgagggcgaggcgttccggcgcacgctggacgaggcgttcgcggcgaccggggcggtgagcaacgtcggcgagtgggtgccgctgctgggctggctcgac

SEQ ID NO: 11248 - protein, 236 aa, Panicum virgatum
  misc_feature: Ceres CLONE 1727407
  misc_feature: SWISSPROT Homolog: EC 1.14.13.21 Flavonoid 3'-monooxygenase
MELAATLSMAMALVAVLVVFVLSSVVLPRGRRKALNLPPGPRGWPVLGSLGVLAGAAPPHRGLAALAARHGPLMHLRLGSYHTVVASSAETARLVLKTHNLAFADRPPTAAGEITSYGYRGIVHTPYGSYWRMARKLCATELFSARRVDSFERVCAQEMRALAIGLFRCAGRAVAVREHVAGATLRNILRMAVGEKWSGCYGSAEGEAFRRTLDEAFAATGAVSNVGEWVPLLGWL

SEQ ID NO: 11249 - DNA, 1806 bp, Panicum virgatum
  misc_feature: Ceres CLONE 1727423
  misc_feature: Encodes the peptide sequence at SEQ ID NO. 11250
agaagcttggggcagggtctcttcctccctagcacagctagcgcgcgccgcggccaccaccatgcagctcgccgagctctgcgccgaccccgtggtgctctcctgcgccttcctctgcctcctcctccacctcgcgctccgccgctcctcctccggccgcggccgcggccgcctcccaccggggcctcccggcctccccatcctcggcgcgctcccgctcgtcggcccggccccgcacgccgggctcgccgcgctggcgcgccggtacgggcccatcatgtacctcaagatgggcacggccggcgtggtggtggcgtcgtccccggccgcggcgcgcacgttcctcaaggcgctggacgcccggtacgccaaccggcccgcggtggcgagcgccgcggacatcacgtacgggtgccagaacatggtgttcgccaactacgggccccggtggaagctgatgcggaagctggccagcgtgcacctgctcggggcgcgcgcgctcgcggactgggcgggcgtgcgccgcgacgaggcgggccacctggtgcgcggggtggcggcggcggcggcggccgggcggcccgtcgtcgtgccggaggtgctcgtgtgcgcgctcgccaacatcgtcggccagatcaccgtcagcaggagggtgttcgacgcgcagggggacgagtccaacagctacaaggacatgatcgtgtcgctgctgacgggcgcgggcctgttcaacatcagcgacttcgtgccggcgctggcgcggctggacctgcagggcgtgcaggcgaagctgcggcggatccaccaccagttcgacggcctcatcaccgagctgctggcggagcacgcggcgacggccgccgaccgcgcgcgccgcggccgccaggacttcgtcgacaggctccgcgccagcatggacgccggcgccgacgacgagagcggcgagaccatcaccgaggtcaacatcaagggcctcatcttcgacatgttcacggcgggcacggacacgtcgtcgatcatcgtggagtgggcgatggcggaaatgctccagaacccgtcggtgatggcgcgcgcgcaggaggagctggaccgcgtggtcggccgcggccgccggctggaggagtcggacctggtggcgctcccgtacctgcaggccgtctgcaaggaggcgatgcggctgcacccgtcgacgccgctcagcctcccccacttctccttcgacgcctgcgacgacgtcgacggctaccgcgtcccggccaacacccgcctgctcgtcaacatctgggccatcggccgggacccggccgcgtgggaggcgccgctcgagttccggcccgagcggttcctccccggcggcgcggcggagaaggtggacccgctcgggaactacttcgagctcatcccgttcggcgccggccggaggatctgcgccgggaagctggccgggatggtgttcgtgcagtacttcctgggcacgctgctgcacgcgttcgagtggcgcctgccggagggggaggagaagctggacatggccgagaccttcgggctcgcgctgcccaaggccgtgccgctccgcgccgtcgtcacgccgcgcctcgtgccggaagcctacgcctgagctgctgattgtaagctgtggatacacgcggctgcatatggacatgcgcgcgtgttggtgtacaactgtacaaggatggtcgtatggtttttggtgttgcctagctacctgcgtacatatatattctgttatacggtcgatgatcgtacactcgattgcctggtagcatttgaactttgggttcggtc

SEQ ID NO: 11250 - protein, 518 aa, Panicum virgatum
  misc_feature: Ceres CLONE 1727423
  misc_feature (39)..(505): Pfam Name: p450 Pfam Description: Cytochrome P450
  misc_feature: SWISSPROT Homolog: EC 1.14.13.88 Flavonoid 3',5'-hydroxylase
MQLAELCADPVVLSCAFLCLLLHLALRRSSSGRGRGRLPPGPPGLPILGALPLVGPAPHAGLAALARRYGPIMYLKMGTAGVVVASSPAAARTFLKALDARYANRPAVASAADITYGCQNMVFANYGPRWKLMRKLASVHLLGARALADWAGVRRDEAGHLVRGVAAAAAAGRPVVVPEVLVCALANIVGQITVSRRVFDAQGDESNSYKDMIVSLLTGAGLFNISDFVPALARLDLQGVQAKLRRIHHQFDGLITELLAEHAATAADRARRGRQDFVDRLRASMDAGADDESGETITEVNIKGLIFDMFTAGTDTSSIIVEWAMAEMLQNPSVMARAQEELDRVVGRGRRLEESDLVALPYLQAVCKEAMRLHPSTPLSLPHFSFDACDDVDGYRVPANTRLLVNIWAIGRDPAAWEAPLEFRPERFLPGGAAEKVDPLGNYFELIPFGAGRRICAGKLAGMVFVQYFLGTLLHAFEWRLPEGEEKLDMAETFGLALPKAVPLRAVVTPRLVPEAYA

SEQ ID NO: 11251 - DNA, 1433 bp, Panicum virgatum
  misc_feature: Ceres CLONE 1727426
  misc_feature: Encodes the peptide sequence at SEQ ID NO. 11252
agaacaagaggaaggccaaaagggagccaaaaaggccaggccaaaaggcagaatccacgagacgagaccacgagagagaagcaggagggaggagaggagagtttgcgtccctccacttgccatctcccctactctcccgcttcgcgctcttcgtcatcttcctcttcctgcgcttgggggctctccattccaggtccagggttcagattcagattggggcgccgccgcagtcctaccgtgctgctctccctcacgacgacgaggatggggcaggacggccaccagatccgccgccacaagctcatcatcgacacggatcccggcatcgatgatagcatggcaatcctaatggcgttcagagaaccaagcgtggaaatcattgggttgacgaccatatttggcaatgtcagcacggagggtgcaacacgtaatgcgctgttgctgtgtgagagagcagggcattctgaagttccagtagcagagggaagccctgagcccctaaagggaggaaaaccccgtattgctgattttgttcatgggtcagatggcattggggatctgtttcttcctgaacccactactaagaaggttgaggaaagtgctgctgagttcttggtcaataaggtctctgagtttcctggagaggtctctgtactcgctttggggcccctgacaaatgtagcattggctgtcaaaagagacccttcctttgcaagcaaggtgaagaaaatagttgtactgggtggagctttctttgcggcaggaaatgtcaaccctgcagccgaagcaaatatccatggagatccagaagcagctgatatagtttttacctcaggagcagatattgttgtggttggcattaacataacgactcaagtctgctttacagatgaggatctcttggagctaagaaactcgaaagcgaagcatgcacagttcttgtccgatatgtgcaagttctacagggattggcatgccaagtctgatggtttccacggaattttccttcatgatcctgtgagctttatggctctagttcatcctgagtacttcacgttcaagaagggtgtggtgagagtggagacccagggcatttgcactggtcacactttgatggatcagggattgaaaaagtggaattcagagaatccatggtcaggctataaaccgatttcagtcgcatggactgtggatgtgccgaaggttatcagctttataaagaagctgctcatggcaccatgagaaactgcaaccatttaaaaatgccctcgctttctaatgtccaagaaaatttgacaaatacagacagagccctctatcccagctgccttgtaattagttgctggacagcaggaagctttcttcagtgttctgagaaacatgagaagcttccttgtgaaaggttattgaaagtaaattctgcataggacagc

SEQ ID NO: 11252 - protein, 325 aa, Panicum virgatum
  misc_feature: Ceres CLONE 1727426
  misc_feature (10)..(319): Pfam Name: IU_nuc_hydro Pfam Description: Inosine-uridine preferring nucleoside hydrolase
  misc_feature: SWISSPROT Homolog: EC 3.2.2.8 Ribosylpyrimidine nucleosidase
MGQDGHQIRRHKLIIDTDPGIDDSMAILMAFREPSVEIIGLTTIFGNVSTEGATRNALLLCERAGHSEVPVAEGSPEPLKGGKPRIADFVHGSDGIGDLFLPEPTTKKVEESAAEFLVNKVSEFPGEVSVLALGPLTNVALAVKRDPSFASKVKKIVVLGGAFFAAGNVNPAAEANIHGDPEAADIVFTSGADIVVVGINITTQVCFTDEDLLELRNSKAKHAQFLSDMCKFYRDWHAKSDGFHGIFLHDPVSFMALVHPEYFTFKKGVVRVETQGICTGHTLMDQGLKKWNSENPWSGYKPISVAWTVDVPKVISFIKKLLMAP

SEQ ID NO: 11253 - DNA, 1021 bp, Panicum virgatum
  misc_feature: Ceres CLONE 1727429
  misc_feature: Encodes the peptide sequence at SEQ ID NO. 11254
gagccgagccgagctcacagctccctgctcacctcccatggccgccgccgccgctgccgccggagcagccgcgactgccttctccagcgggcagaggatcccgcccggcacgcgtgccgccgcggtttccccacgcaccgaggcccccggcaagtaccgcggccgcgtcgtccctgctattcccaggaggaatgtgctgtcgacaatgttatccacctcaacagtcctacttttaggacccaagcagatcaccctagctgagactaccggcggcgcattcagggagtacatcgacacatttgatgggtacaccttcctgtaccccaaaagctggatccaggtgcgaggtgctggcgcagacatattcttcagggaccccttcgtcctggacgagaacatgtctgttgagatatcatccccttcgtcatcaaaatacaccagtgtcaaggatctcggccctccggagaaggctgcggagaaggttctgaagcagtacctgacggagttcatgtcgaccaggctaggcgttcggcgcgaatcgaacatcctgtcggcgtcatccaaggttgccgacgatggcaggctgtactacgaagttgaggtgaacataaaatcctatgcgagcaacaacgagctggcagtgatgccgcaggacagggtgcagagcttggagtgggaccggcgatacctgtcggtcctcggtgttgagaacaagcggctctacgagctccggttgcagacgccagagcaggttttcatgcaggaagaggaggaccttagaagagtcatggactccttcagggtcatcgagacggggtagtacggtgcagacagaaccaagcgcttgcagaacattgcaatgctttgcctgagggtagagcacggaatttttgtacaggcccggccctgaggggggttgagcagtgcacccgccccgggcctcggaatccaagaggccctccccatgtacatgtatagtatgtagagtacatatcatgagcaatacatggccatgttaccg

SEQ ID NO: 11254 - protein, 260 aa, Panicum virgatum
  misc_feature: Ceres CLONE 1727429
  misc_feature (43)..(257): Pfam Name: PsbP Pfam Description: PsbP
MAAAAAAAGAAATAFSSGQRIPPGTRAAAVSPRTEAPGKYRGRVVPAIPRRNVLSTMLSTSTVLLLGPKQITLAETTGGAFREYIDTFDGYTFLYPKSWIQVRGAGADIFFRDPFVLDENMSVEISSPSSSKYTSVKDLGPPEKAAEKVLKQYLTEFMSTRLGVRRESNILSASSKVADDGRLYYEVEVNIKSYASNNELAVMPQDRVQSLEWDRRYLSVLGVENKRLYELRLQTPEQVFMQEEEDLRRVMDSFRVIETG

SEQ ID NO: 11255 - DNA, 1755 bp, Panicum virgatum
  misc_feature: Ceres CLONE 1727437
  misc_feature: Encodes the peptide sequence at SEQ ID NO. 11256
ttcgatgtgagcgactcccaagcggagcttgactcttcaatccccttccccgcgcacgctttcttcggaccatccgccgccgccgacgccgccctcgtgccctcaccgtgccactcccgccggcgccagcctcctctcctccctctctgccgcgcgtcgcatcgcgcggctgccgtcgtcctggcggagcgcgggggcggctccggcccgatcagaggcgcccggtgaggcggcgcggggccgaccgtgggggaggcgcacggcggtggggcggcccgtgtagagaatgatctacacggcgattgacaccttctacctgacggacgagcagctgcgggactcgccgtcgcggaaggatgggatcagcgaggccaccgagaccgcgctccgcgtctacggatgcggcctcatccaggagagcggcatcctcctcaggctaccacaagcagtgatggccacagcacaagtattgtttcatcgcttttactgcaagaaatcatttgttcgatttagtgcaaagagagttgctgctagctgtgtttggctggcagggaagttggaggagagtcctagaaaatcgaagcatattatatttgtattccatagaatggaatgtaggagagaaaatttgccaattgcatatttagatgtcttctcaaagaaatactcagaactgaggcatcatctgataaggacagaacggcatctgttgaaggagatgggttttatttgccatgtcgaacacccccataagttcatatcgaactaccttgtaacgcttgaagcccctgagctgactcaagaggcatggaaccttgccaatgatagcttgaggacaactctgtgtgtgcgattcaagagtgaagtagtagcatgcggagttgtgtatgctgcagctaggagacgcggtattgcccttcctgaggatcctccgtggtggactgtcttcgatgctgatgaagctggaatccaagaagtttgccgggttcttgctcacctctacagcctccccaagtcagagtacataccagtatataaagacaatgattcctttactgttagaaggacaccagagccgcaggtttcaaaggaaagtcctgcaagtgctgttgctagcgataagggaacccctgtaccctcaagttctagccaggaaaaggattcggtgacaaaggctgcaccagacaaggtcaaggaaaaaagtgacgatgaaggtaaggcattgtctgctgaactcaatggaaaacaagatgcagcggcgaagttgaagaatgagaaatcggagtcaggtgttgaccggagtcgggaaagagaaagagagagatcaaaaggccgggaccgtgatggcaggggtagggattctgatcgtgatagcaggggccgtgactcggatcgtgagagggacaggagacgacgttctagggaaagaagttcaggacattcagacaaggagaggtcaaggcaccactcgtcacgagaccgtggtgactatagttcccactcatctcgtgaaaaggatcggcacaggcaccattgatcaatctgaggatccctgtccaccaagattcgctgcaaggagaccaacagaagaacgaagcaggagaatatgtagacaaaccaacctgggccttttgagcgctgctaagctaatatgcgccatgcacatggcaatggctttcccttacctctattattttggcacctggattctgtaacatgcaaggtaatcaatatctgctggggacttgaatttgt

SEQ ID NO: 11256 - protein, 416 aa, Panicum virgatum
  misc_feature: Ceres CLONE 1727437
  misc_feature (5)..(131): Pfam Name: Cyclin_N Pfam Description: Cyclin, N-terminal domain
MIYTAIDTFYLTDEQLRDSPSRKDGISEATETALRVYGCGLIQESGILLRLPQAVMATAQVLFHRFYCKKSFVRFSAKRVAASCVWLAGKLEESPRKSKHIIFVFHRMECRRENLPIAYLDVFSKKYSELRHHLIRTERHLLKEMGFICHVEHPHKFISNYLVTLEAPELTQEAWNLANDSLRTTLCVRFKSEVVACGVVYAAARRRGIALPEDPPWWTVFDADEAGIQEVCRVLAHLYSLPKSEYIPVYKDNDSFTVRRTPEPQVSKESPASAVASDKGTPVPSSSSQEKDSVTKAAPDKVKEKSDDEGKALSAELNGKQDAAAKLKNEKSESGVDRSRERERERSKGRDRDGRGRDSDRDSRGRDSDRERDRRRRSRERSSGHSDKERSRHHSSRDRGDYSSHSSREKDRHRHH

SEQ ID NO: 11257 - DNA, 1643 bp, Panicum virgatum
  misc_feature: Ceres CLONE 1727438
  misc_feature: Encodes the peptide sequence at SEQ ID NO. 11258
gtctcctcccacttcgccggcgcgggtaggccactcccgctactgcgaccgcgagctcgcctcggcctcgtcccccacccgctggtccgtaccacgcacgccgcagcgccggccatggacgccgtgctacctcccctcctcatcggcggcgtactctcagtctccgtctccaccgccaccaaagccgccagccgagccatttcagccccccaccgctcgccctccgccctccgtttgacctctgcccatcggggccggcacggcttccccctcctcgccactgcttcagagtcgccttccaccccgctagccgccgctttgtctgagagccactcgcgctctccctcaaggtgggtagtggtgatggatagccccccggcggccgcgggaggcagcggggtctcccgcgcggacgctgtggattattacgcctccacactggccggggtcgtggggagtgaggaggatgcgcagatgcgcatatacgaggcttcgtgggaggggagctacgagttccgctgcgagatcgacgaggaagcgtcaaaggagcttgcaaagatgcctggagtattatctgttcgtccagatatgggtcataaattggagatggataatgatggtttgagtctctcgacagaccttgtaagcatcagggatggtggttcaaaatcttcaagtgggaaaaatgagttttggcttgttcgaatggagaagcctggtgttgaagtcgtaacaaaggcacaaatggtggaccactatacccaaatccttatgaaagtattggggaacgaacaggatgcccacgttagcatatatcacatttcatgggaaagggattatggtttctgctgtcacattgatgaagaatgtgcaaaggagttggctgatgttcctggggtgttatctgttcgaccagatacaaactttggatcagacaacaaagattacaaaggtaacgaaggcatcaaatcatcagaagggactggagtggccaatatcaaaactaaaaggctctttgttacagggctttcattttatacatctgagaaaactttacgggcagcctttgagcctttcggtgagctggtagaagtaaagataataatggacaagatatctaaaagatcaaaaggatatgccttcatagaatacactacagaggaagctggaagtgccgctctgaaagcaatgaatggacagataataaacggctggatgataattgttgatgttgctaaaaccagatcaagagatcatcaatctggtcgacctaaccaaacatttcgaccaccctatcataccagatgactgtttagtgtacaaatttatgcagctgtagagtagagataagcgaccactagttgggacatgtcaagctgcctcttctgattgtagttcagtgcccttctcttttgctaattcttggaggatgctcagtggtaatgggccatggtcctaatgctctcttcacaatctaatatatttttagctcaaaattgtataagattaggcccttagattatctaggctaaacattaaggccctttaccacccctatgctcccagctaaatatgtaaatgcagctaaagtgtacaattactaatatctactacaacaatttattgaaaaaaatttctctgat

SEQ ID NO: 11258 - protein, 397 aa, Panicum virgatum
  misc_feature: Ceres CLONE 1727438
  misc_feature (300)..(371): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MDAVLPPLLIGGVLSVSVSTATKAASRAISAPHRSPSALRLTSAHRGRHGFPLLATASESPSTPLAAALSESHSRSPSRWVVVMDSPPAAAGGSGVSRADAVDYYASTLAGVVGSEEDAQMRIYEASWEGSYEFRCEIDEEASKELAKMPGVLSVRPDMGHKLEMDNDGLSLSTDLVSIRDGGSKSSSGKNEFWLVRMEKPGVEVVTKAQMVDHYTQILMKVLGNEQDAHVSIYHISWERDYGFCCHIDEECAKELADVPGVLSVRPDTNFGSDNKDYKGNEGIKSSEGTGVANIKTKRLFVTGLSFYTSEKTLRAAFEPFGELVEVKIIMDKISKRSKGYAFIEYTTEEAGSAALKAMNGQIINGWMIIVDVAKTRSRDHQSGRPNQTFRPPYHTR

SEQ ID NO: 11259 - DNA, 1486 bp, Panicum virgatum
  misc_feature: Ceres CLONE 1727439
  misc_feature: Encodes the peptide sequence at SEQ ID NO. 11260
aagcgaaagctcaagcaatcgaacaacagtcgcctaatccacactcaaatcaagcaccaaacagcctccagatcccccgatagaggtcacccaccgcagcctctgcagcgagatggctcccgagattgccggcaagatgaccgctaaggccgccgccgccgccgccgcggtgaagcccgcgaccagggcgtacgtgacgttcctggcgggtgacggcgactactggaagggcgtggtgggtctggccaagggcctgcgcaaggtcggctcggcgtacccgctggtggtcgccgtgctgcccgacgtgccggaggcccaccgccggatcctcgtctcgcagggctgcatcgtccgcgagatcgagcccgtgtacccgccggagaaccagacgcagttcgccatggcctactacgtcatcaactactccaagctccgcatctgggagttcgtggagtacgagcggatggtgtacctggacgcggacatccaggtgttcgataacatcgacgagctgttcgagctcgagaagggccacttctacgcggtgatggactgcttctgcgagaagacgtggagccacaccccgcagtacaagatcggctactgccagcagtgccccgacaaggtcgcgtggcccaccgccgagctcggccccccgccggcgctctacttcaacgccggcatgttcgtgcacgagcccagcatggccaccgccaaggccctgctcgagacgctccgcgtgaccccacccacccccttcgcggagcaggacttcttgaacatgttcttccgggagcagtacaagccgatcccgctcgtgtacaaccttgtgctggccatgctgtggaggcaccccgagaacgtgcagctggagaaggtgaaggtggtgcactactgcgcggcggggtcgaagccctggaggtacacgggcaaggaggccaacatggaccgcgaggacatcaagatgctggtgaagaagtggtgggacatctacaacgacgagagcctggacttcaagggcctgcccgccgccgacgacgacgacgaggtggaggcggtggccaagaagccgatccgcgcggcgctggcggaggccggcacggtcaagtacgtcaccgcgccgtcggccgcgtgatccccgtgctgcggctggagtgttcatcactcatcagaacataagaaagatcttactacgatgcctttagtttttctttctttcacttcccgttttgtttcctgatgaattagggtgtctgaattccgatcagttccgttccactgtgggtgtggtgtgagcttactataccattccaagtgtaagggttcggtcaggattgggctttgtgaacacgccccctctggtcacagccagagtatttgtcctgtgccgagggattattatgtttagtatttcggttggtaacttaattatgaagatactattacataataggaagccgcgagattatgggcatctactcttgtt

SEQ ID NO: 11260 - protein, 340 aa, Panicum virgatum
  misc_feature: Ceres CLONE 1727439
  misc_feature (28)..(273): Pfam Name: Glyco_transf_8 Pfam Description: Glycosyl transferase family 8
  misc_feature: SWISSPROT Homolog: EC 2.4.1.186 Glycogenin glucosyltransferase
  misc_feature: Useful for making plants with altered carbohydrate content
  misc_feature: Useful for making plants with altered cell wall content and/or composition
  misc_feature: Useful for making plants with modulated water use efficiency
MAPEIAGKMTAKAAAAAAAVKPATRAYVTFLAGDGDYWKGVVGLAKGLRKVGSAYPLVVAVLPDVPEAHRRILVSQGCIVREIEPVYPPENQTQFAMAYYVINYSKLRIWEFVEYERMVYLDADIQVFDNIDELFELEKGHFYAVMDCFCEKTWSHTPQYKIGYCQQCPDKVAWPTAELGPPPALYFNAGMFVHEPSMATAKALLETLRVTPPTPFAEQDFLNMFFREQYKPIPLVYNLVLAMLWRHPENVQLEKVKVVHYCAAGSKPWRYTGKEANMDREDIKMLVKKWWDIYNDESLDFKGLPAADDDDEVEAVAKKPIRAALAEAGTVKYVTAPSAA

SEQ ID NO: 11261 - DNA, 762 bp, Panicum virgatum
  misc_feature: Ceres CLONE 1727445
  misc_feature: Encodes the peptide sequence at SEQ ID NO. 11262
cccctcgcgccgcagggaggaggaggaggcgggggtcgcggcggcgaaggttccatccggttcctctctccccaggcctgccgatccgtgttcacgatggctctgcagcagcacgcggggtcggcgtccgggtcggcgtcggcgtcgagctccagctcggggctgcacccgctcgcgtcgccctcgtccttcgcggacaccacccacaccaaggtcttcgtcggcgggctcgcctgggagaccaacagcgacaggctccgccacttctacgagcgctgcggggacatcctcgaggccgtcgtcatcaccgaccgccactccggccgctccaagggctacggattcgtgacgttccgtgaacccgagtcggcgaggaaggcctgcgaggaccccacgccggtgatcgacggcaggcgggccaattgtaacctggcgtcgcttggtcgagcccagcatcccgtgccctttgggcggccaagatcagctgggtcctactttggtgtctcggttccaaggggcttttatctagggggttatggccagcaccgaccgcttccacttgggtactgccaaggattcccagttccccagtacagttacacttcatatggggccgaatacatctatccacagggtacattgaacccatacgccggtcagcaaaatattccgatatacggagtctcagctgcagcaaatgcatccaaccaaccatttagccaattgggtccatccatttctggtgggggcagtggttatttg

SEQ ID NO: 11262 - protein, 221 aa, Panicum virgatum
  misc_feature: Ceres CLONE 1727445
  misc_feature (40)..(110): Pfam Name: RRM_1 Pfam Description: RNA recognition motif. (a.k.a. RRM, RBD, or RNP domain)
MALQQHAGSASGSASASSSSSGLHPLASPSSFADTTHTKVFVGGLAWETNSDRLRHFYERCGDILEAVVITDRHSGRSKGYGFVTFREPESARKACEDPTPVIDGRRANCNLASLGRAQHPVPFGRPRSAGSYFGVSVPRGFYLGGYGQHRPLPLGYCQGFPVPQYSYTSYGAEYIYPQGTLNPYAGQQNIPIYGVSAAANASNQPFSQLGPSISGGGSGY

SEQ ID NO: 11263 - DNA, 650 bp, Panicum virgatum
  misc_feature: Ceres CLONE 1727445-R
aactgtgcacccaaacaatttgtaccttgaggtacccttagatttgcagcaggactaaaaagagcagtgttgccctactcgcagcatatgctcttacctggcaagaaatcatccttgcattcataaggttgtcgttatcatggtcaacagatgtacctggaaatcatgaggttgtccctatgggtgggggcaaatggtccaagagcgagggctgctcttgcagtttcgctcggtttacatcctatgtagaaatgtgtccgtgatcgtgatggagcatgaaacgacggatgcagccatgttgatcctgtatctgacgtctcatggtcatggagatatagcatatgctggaatggagtccagcatctgtattatggattaatccattgggaattagccatcatggccttcatatgactattcatctgagacatcaagtttgtgtgtcccaagtcaccacgcacttgcccaagtgtatccagtcctgtatcagtctgcagtcatcgtcgactcatcgtgttgtcttcattcaccagcctttggagctaactctggaggacctagctgtggtgctttcctgagagcttcctccgcttcgtcactcgtctgtaccaaatttctagtgttgtatgtcccaggtcaggtgtggttca

SEQ ID NO: 11264 - DNA, 1464 bp, Panicum virgatum
  misc_feature: Ceres CLONE 1727449
  misc_feature: Encodes the peptide sequence at SEQ ID NO. 11265
gaagcgatcccccccatctcccacatccaccaggatggccgacgcggcggccgccgtccccggcgatcccccggccagcgccaccgtgctggactcgctcggcgaggacatcacccgcatcgtctaccccgtctccgcctgcatgctcctcgtcgtccttctcgtctccctcctctcctcgccctcctccccgtcgcccctctccgcctccatcgccgccgccaccggcggaggggacgacatccccaccgcgctcttcaccgccctcaccttcgtcgtcgccgtcacggccgccaccttcctgctcgcgctcctcttctacctccgctgcacgccctgcctccgcgcctacctcggcttctccgcgctcgccgtcctgctcgtgctcggcggccaggtcgccctgctcctcatctcccgcctccgcctcccgctcgacgccgtctccttcgcgctcctcctccccaacgccgcgggggcgctcgcgctcgccgcgctggcgccggcctccgtccccatcgggctccaccaggccgcgctcgtcgccgtcgccgtgctcaccgccttctggttcacgctgctccccgaatggaccacctgggcgctgctcgtcgccatggccgtctacgacctcgccgccgtgctgctccctggtggccctctgagagtgctgcttgagctcgccatagagaggaacgaggagataccggcgctggtctacgaggcgaggccggtggatccccgacacggccgaaattggcgcttgtggagggaagggaggcagcctggcgcggatttggatgccagttccaccacggtcgaggcgattggggaggtattggggaggaatcttgatgccaattctggaaacagttcgtcgccccaagttcatgatgctgccactccaactgctaatgttaacaattcgaggcccagggcgacattgtgggctgctttgagctcagattctacagttgaacatgctggggaggcatccgcattgcaggagcatagagtggctgttgctgaaatgagggtacctttgatccagccacgtccagagagatctggggaagaggaggaagatgaagatggcattgggttgagctcatctggggcaatcaagctcgggttgggggacttcatattctacagtgttctggtcggtagggcggcgatgtatgactacatgacagtgtatgcctgctaccttgccatcattgctgggcttggcatcactctcctcctgctggcgttcttccgcaaggcattgcctgccctaccggtttccatcgcccttggcattgtgttttatgtgctcacaagaacattgcttgaggaatttgttgtgcaatgctccaccaatcttttgctgttctagcattaatggaacattgcttattgatgtactattgtagctcacatttgacactattactgtttgattagctcttaattttccgg

SEQ ID NO: 11265 - protein, 448 aa, Panicum virgatum
  misc_feature: Ceres CLONE 1727449
  misc_feature (14)..(439): Pfam Name: Presenilin Pfam Description: Presenilin
MADAAAAVPGDPPASATVLDSLGEDITRIVYPVSACMLLVVLLVSLLSSPSSPSPLSASIAAATGGGDDIPTALFTALTFVVAVTAATFLLALLFYLRCTPCLRAYLGFSALAVLLVLGGQVALLLISRLRLPLDAVSFALLLPNAAGALALAALAPASVPIGLHQAALVAVAVLTAFWFTLLPEWTTWALLVAMAVYDLAAVLLPGGPLRVLLELAIERNEEIPALVYEARPVDPRHGRNWRLWREGRQPGADLDASSTTVEAIGEVLGRNLDANSGNSSSPQVHDAATPTANVNNSRPRATLWAALSSDSTVEHAGEASALQEHRVAVAEMRVPLIQPRPERSGEEEEDEDGIGLSSSGAIKLGLGDFIFYSVLVGRAAMYDYMTVYACYLAIIAGLGITLLLLAFFRKALPALPVSIALGIVFYVLTRTLLEEFVVQCSTNLLLF

SEQ ID NO: 11266 - DNA, 2067 bp, Panicum virgatum
  misc_feature: Ceres CLONE 1727450
  misc_feature: Encodes the peptide sequence at SEQ ID NO. 11267
aaccaactcgtgcagctagcgctcgatcgaccacctcgtcggggggcctcgcgcatttacccccacgtccgtgtccatgcaacagccgacgagccgcgccaccaccgccgccggccagctccacgccgcgatggaggaagcggcctcgtcgctctcggtcctgcagctcgccttcacggcggcggtggcgaccgccgcgctggccgtcgccgtggccgctgcgaggtacaacaggcggtaccgggacctgcggctgccccccggcccccccgggtggcccgtcttcggcaacctcctccaggtcgccttctccgggaagctcttcatccactacatccgcgacctgcggcgggagtacgggcccatcctgacgctgcgcatgggggagcgcacactcgtgatcatcagcagcgcggagctcgcgcacgaggcgctggtcgagaagggccaggagttcgcgagccggccccgggagaacacgacgcgcaacatcttctcctccaacaagttcaccgtcaactcggcggtgtacgggcccgagtggcggtcgctgcggcggaacatggtgtccgggatgctgagcacgtcgcggctccgggagttccggcacgcgcggatgcgcgccatggaccggttcgtggcgcggatgcgcgccgaggccgcggcgtcccccgacggcgcgtccgtctgggtgctccggaacgcgcgcttcgcggtcttctgcatcctgctggacatgaccttcggcctgctggacctccacgaggagcacatcgtgcgcatcgacgccgtcatgaagcgcgtgctgctcgccgtcggcgtgcgcatggacgactacctcccgttcctccgccccttcttctggcggcaccagcgccgcgccctcgccgtccgccgcgagcaggtcgacaccctgctcccgctcatcaaccggcgccgcgccatgctccgcggcgcgtccccgcccggccccgacgtcgccgcgcccttctcgtacctcgactccctcctcgacctccgcgtcgagggccgcgacgccgcgcccagtgacgacgagctggtgacgctctgcgcggagctcatcaacggcgggaccgacaccacggccaccgcgatcgagtggggcatggcgcgcatcgtggacaacccgtccatccaggcccggctccacgaggagatcgcgcggcaggtcggcggcgcgcggccggtcgacgacagggacaccgacgccatgccgtacctccaggccttcgtgaaggagctcctccggaagcacccgcccacgtacttctcgctcacccacgccgccgcccggcccgggtgcaagctcgccgggtacgacgtgcccgcggacgcgaacctggacatcttcctgccgaccatctccgaggacccgaagctgtgggagcggccggcggagttcgaccccgaccggttcctgtccggcggcgaggcggcggacatgacggggtcggcggggatccggatgatcccgttcggcgcggggcggaggatctgccccgggctggccatgggcacgacgcacatcgcgctgatggtggcgcggatggtgcaggcgttcgagtggcgcgcgcacccgtcgcagccgccgccggacttcaaggacaaggtggagttcacggtggtgatggaccgcccgctgctcgccgcggtcaggcccaggagcctctccttctgatcggatcatcagctagcgtggcggcaccggccgacacgcacaacgtcgtcgtcgtcgttcgtacgtgtgcacgcgcggcagcacatgcatgcatggccgcgggccgtgggttgcatgctgccttgaatcctttccgatcatgacgcgtggcgtatgggtacttgcaagctatagctgctctctcctaccagcgtaccagtattgtgagctgtgaacgaacgcctccatgtctgtgcgtctcttgccgtgtgttgcgtggtggtgacgtggtgtagcatacaaaaaaaaaaatgctagcatgtgcgagtttataggaagtagtaattcacaatgtataagagtgaaccctttttatcccatgcatttct

SEQ ID NO: 11267 - protein, 522 aa, Panicum virgatum
  misc_feature: Ceres CLONE 1727450
  misc_feature (43)..(516): Pfam Name: p450 Pfam Description: Cytochrome P450
  misc_feature: SWISSPROT Homolog: EC 1.14.13.21 Flavonoid 3'-monooxygenase
MEEAASSLSVLQLAFTAAVATAALAVAVAAARYNRRYRDLRLPPGPPGWPVFGNLLQVAFSGKLFIHYIRDLRREYGPILTLRMGERTLVIISSAELAHEALVEKGQEFASRPRENTTRNIFSSNKFTVNSAVYGPEWRSLRRNMVSGMLSTSRLREFRHARMRAMDRFVARMRAEAAASPDGASVWVLRNARFAVFCILLDMTFGLLDLHEEHIVRIDAVMKRVLLAVGVRMDDYLPFLRPFFWRHQRRALAVRREQVDTLLPLINRRRAMLRGASPPGPDVAAPFSYLDSLLDLRVEGRDAAPSDDELVTLCAELINGGTDTTATAIEWGMARIVDNPSIQARLHEEIARQVGGARPVDDRDTDAMPYLQAFVKELLRKHPPTYFSLTHAAARPGCKLAGYDVPADANLDIFLPTISEDPKLWERPAEFDPDRFLSGGEAADMTGSAGIRMIPFGAGRRICPGLAMGTTHIALMVARMVQAFEWRAHPSQPPPDFKDKVEFTVVMDRPLLAAVRPRSLSF

SEQ ID NO: 11268 - DNA, 1106 bp, Panicum virgatum
  misc_feature: Ceres CLONE 1727464
  misc_feature: Encodes the peptide sequence at SEQ ID NO. 11269
gtccactgccgagccaaagcagcaacaagcctcctcaaagagagttcgagatcgcagctagagaccaccagcaaagcaaccgccaccgacgttccaagaaacgtaaccgaccatgatgatgatgggagagggagcgcacgcgccgccgtggcagcagcagcagcagccgccggccagcgccggcatggacggggacgacgcgtcgccgtacagcctcctggcggcgctgcggcattacctgccgtcgaacgaggccgcggcggcggcgtacgacgaggacgatgaggaggcggccctggcggcggtggacgcctacgcctgcgacgagttccggatgtacgagttcaaggtgcgccggtgctcgcgcgggcggagccacgactggatggactgcccgtacgcgcacccgggggagaaggcccgccgccgcgaccccaggcggtaccactactccggcaccgcgtgcccggacttccgcaagggcggctgcaagagcggtgacgcctgcgagttcgcgcacggcgtgttcgagtgctggctccacccggcgcgctaccggacgcagccctgcaaggacggcaccgcctgccgccgccgcgtctgcttcttcgcgcacacgccggaccagctccgcgtcctgccgccgcagcagtccagctccagccccaggagcgccgcgccgtcgccgctcgccgagtcgtacgacggctcgccgctccgccgccaggcgttcgagagctacctcaccaagaccggcatcatgtcctcgtccccgacgagcacgctcgtctcgccgccgaagtcgccgccctcggaatccccgccaatgtcaccggacgccgccggcgcgctccgccgcggctcctggccgggggtcggctcgcccgtcaacgaggtcctcgcctcgctgcgccagctccgcctcggcggcggcggctcgccgaggtcggcgccgtccggcggctcgttcctggccggctacccgttcgggtcccccaagtccccggccgcgctgtacagcctcccgtcccccccgaccagaccgtccccggtgacggtgaccaccccctccggcgccaccgtcatgaccgtggagcgcctcaacc

SEQ ID NO: 11269 - protein, 331 aa, Panicum virgatum
  misc_feature: Ceres CLONE 1727464
  misc_feature (113)..(138): Pfam Name: zf-CCCH Pfam Description: Zinc finger C-x8-C-x5-C-x3-H type (and similar)
MMMMGEGAHAPPWQQQQQPPASAGMDGDDASPYSLLAALRHYLPSNEAAAAAYDEDDEEAALAAVDAYACDEFRMYEFKVRRCSRGRSHDWMDCPYAHPGEKARRRDPRRYHYSGTACPDFRKGGCKSGDACEFAHGVFECWLHPARYRTQPCKDGTACRRRVCFFAHTPDQLRVLPPQQSSSSPRSAAPSPLAESYDGSPLRRQAFESYLTKTGIMSSSPTSTLVSPPKSPPSESPPMSPDAAGALRRGSWPGVGSPVNEVLASLRQLRLGGGGSPRSAPSGGSFLAGYPFGSPKSPAALYSLPSPPTRPSPVTVTTPSGATVMTVERLN

SEQ ID NO: 11270 - DNA, 723 bp, Panicum virgatum
  misc_feature: Ceres CLONE 1727464-R
cgcggagggcgcggcccctgccgccgccccggacgtcgggtgggtctcggacctcatcaactgaggggactcgatcgagaagccagcaccatccgtggctcctctgaacattgcccatccattgtaagtgggggaagaggaggcagcgctgcacatcaagagaagaaaacccaaaagcaaaactaaaaaaaaaagttattttttcttcttatttccaagattctcccgatccttgtacatgtgttcttccttcctatgtgaatattcttggatggttgttggagggaggggaggcagaaaagggttagatttgttttggggcttcagatggtggcatgttggagggagaaggagacaagttgccaacaaaacatggtagaaatggatgaagatgcggcgaaccaccgtgtatatgggttgtgtagatgtgcgtagtgtctggtgtttgtgtgtgtgtgtggagggggagcatgggaggcgacgatggcggcgatccaagactgaagaaggtgaccggatcctgcagatccacaccgccggccggcagcccggccgcctccggtgacctcgccgggcggtagcctggggagcttctaatttctacgaccgattccagaacgtcctaggttgatgtttactattttcttattccaccgttgattctgtaattcactctgtattttaccctatgtattttccttaattgatctagtactgcccacg

SEQ ID NO: 11271 - DNA, 2134 bp, Panicum virgatum
  misc_feature: Ceres CLONE 1727493
  misc_feature: Encodes the peptide sequence at SEQ ID NO. 11272
acgaacccgtacctgccccgccccggcccccgacgcaaccgcgtcgtctcgtccccgtccgaccaccgccgccgaaaccctacagccccccgccatggcggatccgccccccgtggcggcctccgcgtcgccggcgcagcccgaccagctcgccgccggagcctccgtctccacgccgcagaactccaaccctaaccccctcctctccccgcaaatccccccgtccccgaccgtctccgacctctccgcgcacatctcctccccgcagcagctcaacccggcgggcgcggccgcctcgggcggagggggatccatggactacccgccgcggccgccgcagctgcaggcgccctcgcccacgcaggcgggggccggagccggggggttcagccagatccaccgctcggggtcgacctcccgcatctccaccgccagccagcttccgcagtacgccgccatggcggctaggatgtacggcgctcagatgagcttctcgggcggcggtgggctggtgggccagcagcaacagcagcagctggcggggcgttcgcccatgcttgggcagggccagcttgggatgctgcaaggccaggggaacgcggcacattatgggattcagtcgcagatgatggcgcaggcaaggcaaaagggcatggtacaaggtactcaattgaataatgctaatacagctcaagcgctgcaagggatgcagcccatgggagtcatgggtactatggggatgaaccagatgagaccgaatggaactatcccctatggtgctcaacaacggtttgcccatgcacaaatgagacctcaggcatcccaacaagctgcactatctccgcagaaagtagccggtcaaggcttgtcgagaacagcgtcaattacagcattaaattcacaactgcctggatcatcgcaaaatggacagatggtggcaatgtctatgcctcagcaacagcaacagcaacagcagcagtggttgaagcaaatgcaatcatccatgggctcatcagtttctccacaatttcagcaccaacagagactcatgttaatgcagcaacttcagcagaagacgggattgagtcaacagcaacttgcacaagtccaacaacagcatccgcatctcagtgcccaacaactgattcagcagcaacattttctccagcagtttcagcagcagcagccactacaatctccaagggtttcagcatctggttcgcagaagtctgcgaaccttacgggttcacagccgggtacacctttgtctggtggaactatgactggtggaagtgcaagtcagggagctgaaggaactagccaacttcttgggaaaaggaagatacaagatctggttgcacaggtagaccccctaggcaaggttgaccctgaggtggaagatttacttttagaaattgccgatgacttcattgactcggtgactgcatttgcgtgcagcttggcaaagcataggaaatcatccgttgtggaagcgaaggatgtgttgctgcacttagaacaaaactggcatttgtctgttcctggattctcaagggaggataagaatcttcaaagaaactttgtaaagccttcggtagatccgcaacaaccagaaagtgatgctaccggtattagaggcacaggcaataaacttatggctaataactcggttgccaaccatcaaataagacctcccattgcagagccttcagcaatgccaacagcggggcccctgtcgaaagccccccgcttctaagtgttatgctgctctccctttgaaggaaaatttcctttttcaggacaatcaaaatggaaacagccagtaggctctaacacaaggattgcttgcaagtggaagcacaataaatccatgagcatctgtggcaaaccgcagatgcttgtgtacttacaggaaagcagttgctgactgaccgatcgtctcttgacagaccctccacctgggtcgtctgtaactttgttcctttttttttttgtgcctgtggatgtccccgtccgttgtatataaatgttttttgcaacggggcaccatcgtctccagttttgatgttgctatgtaggtgaatatgtacttaagtgagcgcaacttataattaatgacgtgtacttttaagtc

SEQ ID NO: 11272 - protein, 553 aa, Panicum virgatum
  misc_feature: Ceres CLONE 1727493
  misc_feature (413)..(480): Pfam Name: TFIID_20kDa Pfam Description: Transcription initiation factor TFIID subunit A
MADPPPVAASASPAQPDQLAAGASVSTPQNSNPNPLLSPQIPPSPTVSDLSAHISSPQQLNPAGAAASGGGGSMDYPPRPPQLQAPSPTQAGAGAGGFSQIHRSGSTSRISTASQLPQYAAMAARMYGAQMSFSGGGGLVGQQQQQQLAGRSPMLGQGQLGMLQGQGNAAHYGIQSQMMAQARQKGMVQGTQLNNANTAQALQGMQPMGVMGTMGMNQMRPNGTIPYGAQQRFAHAQMRPQASQQAALSPQKVAGQGLSRTASITALNSQLPGSSQNGQMVAMSMPQQQQQQQQQWLKQMQSSMGSSVSPQFQHQQRLMLMQQLQQKTGLSQQQLAQVQQQHPHLSAQQLIQQQHFLQQFQQQQPLQSPRVSASGSQKSANLTGSQPGTPLSGGTMTGGSASQGAEGTSQLLGKRKIQDLVAQVDPLGKVDPEVEDLLLEIADDFIDSVTAFACSLAKHRKSSVVEAKDVLLHLEQNWHLSVPGFSREDKNLQRNFVKPSVDPQQPESDATGIRGTGNKLMANNSVANHQIRPPIAEPSAMPTAGPLSKAPRF

SEQ ID NO: 11273 - DNA, 1525 bp, Panicum virgatum
  misc_feature: Ceres CLONE 1727499
  misc_feature: Encodes the peptide sequence at SEQ ID NO. 11274
atctccttcctcccccacaaaaacatttctcccccttcggctcttgccgccgctgcctctccccctttccgcctgccttcacccccttcccccctccctccttctagggtttcccccgccgccgccgccgcccgatccgaggcagatgccgcccgcagccatggcgccgccgccgccgccgccccaggcaccatccaactcaggggatccgctctacccggagctctggcgcgcctgtgccggcccgctcgtcaccgtcccgcgccccggtgacctcgtcttctacttcccgcagggccacatcgagcaggtggaggcgtccatgaaccaggtcgccggaaaccagatgcgcatctacgatctgccctccaaattgctctgccgagtgctcaacgtcgagctcaaggcggagacggagaccgacgaggtctacgcgcagatcatgctcatgccagagcctgagcaaaacgaggtggaggctgagaagtcgagttctggggctgccgccacgccgaggccagccgtcaggtccttctgcaagactctcaccgcgtccgacaccagcacacacggtggcttctctgtgctgcgccgccacgcagacgagtgtctccctcccctggatatgacccaatcacctccgacacaagagcttgtggcaaaggatctgcatggcatggagtggcgcttccggcacatctttcgtgggcaacctaggaggcatctcctccagagtggctggagtgtgtttgttagttctaaaaggcttgttgctggggacgccttcatcttcctcagaggagaaaatggtgaacttcgagttggtgttaggcgggctatgaggcagttgtctaacgtaccttcttcagtcatatctagccaaagcatgcacctcggagtccttgcaactgcatggcatgccatcaacactaaatccatattcactgtgtactacaaacctaggacgagtccctcagagttcatcataccatatgatcagtatatggagtcattgaagaacaattattctattgggatgagattcaggatgcggtttgaaggggaagaggcaccagagcagaggtttactggtactatagttgggtgtgaaaatcttgacccgttatggcctgattccagttggagatacttgaaggtgcgttgggatgagccttcaactatcccacgtcctgatagggtctctccgtggaagatagagcctgcttcatcacctcctgttaatccccttccactttcttctagagtaaagagacctagacaagctcctccgccttcaccagaatcatcagttcttacaaaagaaggtgcaagtaagattgatatcagttctgctcaaacacaacaacatcaaaactcggtcttgcaaggtcaagagcagatgaccttgaggaacaacatgactgagagtaccgactctgatgccactgttcagaagcctatgatgtggtcaccatcacccaatgggaaaacccacactagttttcagcagagaccctctatggat

SEQ ID NO: 11274 - protein, 459 aa, Panicum virgatum
  misc_feature: Ceres CLONE 1727499
  misc_feature (256)..(337): Pfam Name: Auxin_resp Pfam Description: Auxin response factor
  misc_feature (129)..(234): Pfam Name: B3 Pfam Description: B3 DNA binding domain
  misc_feature: Useful for making plants with modulated biomass
  misc_feature: Useful for making plants with modulated seed size
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: The sequence is a functional homolog of SEQ ID NO 298 in the 10/412,699 US patent application
  misc_feature: Useful for biocontainment applications
  misc_feature: Useful for making plants with modulated flowering time
  misc_feature: The sequence is a functional homolog of SEQ ID NO 300 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 100 in the 10/666,642 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
MPPAAMAPPPPPPQAPSNSGDPLYPELWRACAGPLVTVPRPGDLVFYFPQGHIEQVEASMNQVAGNQMRIYDLPSKLLCRVLNVELKAETETDEVYAQIMLMPEPEQNEVEAEKSSSGAAATPRPAVRSFCKTLTASDTSTHGGFSVLRRHADECLPPLDMTQSPPTQELVAKDLHGMEWRFRHIFRGQPRRHLLQSGWSVFVSSKRLVAGDAFIFLRGENGELRVGVRRAMRQLSNVPSSVISSQSMHLGVLATAWHAINTKSIFTVYYKPRTSPSEFIIPYDQYMESLKNNYSIGMRFRMRFEGEEAPEQRFTGTIVGCENLDPLWPDSSWRYLKVRWDEPSTIPRPDRVSPWKIEPASSPPVNPLPLSSRVKRPRQAPPPSPESSVLTKEGASKIDISSAQTQQHQNSVLQGQEQMTLRNNMTESTDSDATVQKPMMWSPSPNGKTHTSFQQRPSM

SEQ ID NO: 11275 - DNA, 589 bp, Panicum virgatum
  misc_feature: Ceres CLONE 1727499-R
  misc_feature: Encodes the peptide sequence at SEQ ID NO. 11276
acaaggagttgtacaaaggttcataagcaaggagttgcacttgacagatctgtggacctctctaagttcggtgactatgatgagctcaaagcagaactagacaaaatgtttgaatttgagggtgaattggtatctgctaacaagaattggcagattgtttatactgacaatgagggtgatatgatgcttgtgggagatgacccgtgggaagaattctgcagcatagtgcgcaagatctacatttacacaaaagaggaggtccagaagatgaactcgaaatcatctgccccgagaaaggaagaacctctagcatctggtgaagtatgtgcggccacaaatgagtaggacttgtctacctggggcaagcagtttagataactaggtcgtgtgaaggaagctgacgaagctgacgatgcatgaaagaggatctttgcattgtgccgggtccctgcccaagtaacacctcaaaccttttgtgtgtctgttgcaacccataccatccgtttgggtttagtagggagtgtagacctgtcttctctgcggtttgctcttggcagaatgtttaagcgccaaggttattatcatcgtt

SEQ ID NO: 11276 - protein, 114 aa, Panicum virgatum
  misc_feature: Ceres CLONE 1727499-R
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
  misc_feature: The sequence is a functional homolog of SEQ ID NO 298 in the 10/412,699 US patent application
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
  misc_feature: Useful for biocontainment applications
  misc_feature: Useful for making plants with modulated flowering time
  misc_feature: The sequence is a functional homolog of SEQ ID NO 300 in the 10/412,699 US patent application
TRSCTKVHKQGVALDRSVDLSKFGDYDELKAELDKMFEFEGELVSANKNWQIVYTDNEGDMMLVGDDPWEEFCSIVRKIYIYTKEEVQKMNSKSSAPRKEEPLASGEVCAATNE

SEQ ID NO: 11277 - DNA, 718 bp, Panicum virgatum
  misc_feature: Ceres CLONE 1727518
  misc_feature: Encodes the peptide sequence at SEQ ID NO. 11278
accagcgcttgcaacaactcatccatccagcaccgtatcgtgccctcatcacactcacgcacaatggctcgcgctcagcaggtcgtggcgatcgccgtcgttgccgccgtcgtgctgctcgccgccgcggccacctccgaggccgccgtgacctgcgggcaggtcaactccgccgccaggagcaccgccgacaggcgcgccgcatgcaactgcctcaagtccgccgcaggcagggtgagcggcctcaacgccggcaaagccgccagcatcccgtccaagtgcggagtcagcatcccctacaccatcagcccatccgtcgactgctccaaggtggcctaatatatatcgtgatgagttggttggagcctgctgccaagcacatccaccgatatatctagctatcgtctatatatgatcgatcgagttcttgctagctcgctgatgaataaaatctctccgccgtcgctcatcatgtgagagacacggccggatcggatgtgtcagtccctgctacgttttgtacgtgtctgctgcatgtacacctccatttccgtttcagagtctgtaccttgtccactaccttttaatacccgcgcgctctcatcccctccacacgtttccgcctccccgatccacaagccgccgcggccgccgccgccgccgccgacacagcaccgtcccccttcccctcgcagccctcgccgcggacgaggccgac

SEQ ID NO: 11278 - protein, 91 aa, Panicum virgatum
  misc_feature: Ceres CLONE 1727518
  misc_feature (4)..(87): Pfam Name: Tryp_alpha_amyl Pfam Description: Protease inhibitor/seed storage/LTP family
MARAQQVVAIAVVAAVVLLAAAATSEAAVTCGQVNSAARSTADRRAACNCLKSAAGRVSGLNAGKAASIPSKCGVSIPYTISPSVDCSKVA

SEQ ID NO: 11279 - DNA, 731 bp, Panicum virgatum
  misc_feature: Ceres CLONE 1727518-R
  misc_feature: Encodes the peptide sequence at SEQ ID NO. 11280
catctgtgagtccggataggaaacttctggcggtggttggagatgatcgggacgcacttcttgtggattcacgaaacgggaaggtaacctctaccctagtcggccatctggactactcattcgcaacggcatggcacccagatgggcgcaccttcgcaacagggaaccaggataaaacctgccgcgtctgggacatgcgcaacctgtcgacctcccttgcagtccttcggggcaacattggtgcgatccggtgcatccgctactcctccgatgggaggttcctggtgttctcggagcctgccgacttcgtgcacgtgtatagcgctgccgcggactacaagaagcggcaggagatcgacttctttggtgaggtgtctgggatcacgctcagccccgacgatgagtctctgttcgttggggtgtgcgaccgcgtctacgccagcttgatgcagtacaggatggcccatgcgttcaactatcttgactcgtacgtgtgaagaactgaatatctggagttgtctgtctggtgctggctatccgtcactgctctcagtgccggttctggtgtgcggttcagggaatgtatctgcctgttctcgtgcgcaggcccatggtgtacggcgagttgaggctcgggcgagtccgccgtgtaaatagttttgtagttgaagcacaatgtaaggaccggtactgtctgaacatatgactatggctgtgttcacttccctccc

SEQ ID NO: 11280 - protein, 164 aa, Panicum virgatum
  misc_feature: Ceres CLONE 1727518-R
  misc_feature (26)..(64): Pfam Name: WD40 Pfam Description: WD domain, G-beta repeat
  misc_feature: SWISSPROT Homolog: EC 2.3.1.48 Histone acetyltransferase
SVSPDRKLLAVVGDDRDALLVDSRNGKVTSTLVGHLDYSFATAWHPDGRTFATGNQDKTCRVWDMRNLSTSLAVLRGNIGAIRCIRYSSDGRFLVFSEPADFVHVYSAAADYKKRQEIDFFGEVSGITLSPDDESLFVGVCDRVYASLMQYRMAHAFNYLDSYV

SEQ ID NO: 11281 - DNA, 1408 bp, Panicum virgatum
  misc_feature: Ceres CLONE 1727524
  misc_feature: Encodes the peptide sequence at SEQ ID NO. 11282
aaaaaaccaagttcatcgtgctcgcatcgtccagtcaggcctccgtagtggtgccgtggcggctgccgcccgcctccaatctcagcctccgtagagaaagagggaggaagagacctggacagcgctgcggcgtcgaaggggacacgatgcagtggtacttagtggccgcgctcctcaccgtcctcaccagctcccagggtatattgactactctctcccagagcaatggcaagtataagtatgactatgcaaccattcccttcctagcagaactcttcaagttgtctgtatcaagtttcttcctttggaacgaatgcaagtcttcatccccaccaaggatgacaaaggagtggaggagtgtgcggctatatcttgttccttcaataatatacctcgtccataacaatgtgcagttcgcaaccttgacctatgttgatccatctacctatcagataatggggaacttgaaaattgtcacaaccggaattttgttcaggcttgtcctaaaaaggaagttatcaaatctacaatggatggcgattgttttgcttgctgttggtacaactactagccaggtcaaaggatgtggagatggaccatgtgattcgcttttctcagcaccattacagggttacatgcttggtatactttctgcttgtctttcagcactagctggtgtctacacagaatacttgatgaagaagaacaatgatagtttgtactggcaaaatgtacagttatatacgtttggagttatattcaacatggggtggctaatttatggcgatttcaaagctggatttgagttgggtccatggtggcagcgcctatttaatggctattctgtcacaacatggatggttgtgtttaatttagggtccactggtctactagtatcatggttgatgaagtattcagacaatatagtcaaggtgtactcaacttcaatggccatgctatcaacgatggttttatccatataccttttcagtgtgaaagcaacaattcagcttttcttaggcattatcatctgcataatttcgctgcagatgtattttatgcctacccacatgcttgttgaattgccacaaacattacctgttacatcaaagtaggcttatggcactttagctaacctgatcggagtgtagaacactgtttatctgggggcaagaatctgtttgattgacctgtttgggcaaatttgtggctggaatctcaactgatgtggttagtttcacgatgcagaaaaggtgaattaacagtgaagtgagcttgttataccaatgtataaaaactttaactcctacaagctctcctactgtttttcaggtaaaagatgggaggctgattggtattgttttgtcttagggaaaagggaatgaaagcaaactttttgagttttttc

SEQ ID NO: 11282 - protein, 322 aa, Panicum virgatum
  misc_feature: Ceres CLONE 1727524
  misc_feature (67)..(296): Pfam Name: Nuc_sug_transp Pfam Description: Nucleotide-sugar transporter
MQWYLVAALLTVLTSSQGILTTLSQSNGKYKYDYATIPFLAELFKLSVSSFFLWNECKSSSPPRMTKEWRSVRLYLVPSIIYLVHNNVQFATLTYVDPSTYQIMGNLKIVTTGILFRLVLKRKLSNLQWMAIVLLAVGTTTSQVKGCGDGPCDSLFSAPLQGYMLGILSACLSALAGVYTEYLMKKNNDSLYWQNVQLYTFGVIFNMGWLIYGDFKAGFELGPWWQRLFNGYSVTTWMVVFNLGSTGLLVSWLMKYSDNIVKVYSTSMAMLSTMVLSIYLFSVKATIQLFLGIIICIISLQMYFMPTHMLVELPQTLPVTSK

SEQ ID NO: 11283 - DNA, 1866 bp, Panicum virgatum
  misc_feature: Ceres CLONE 1727530
  misc_feature: Encodes the peptide sequence at SEQ ID NO. 11284
gttcctctccggtaggctctcccgacctcacctggtgccgcagagcagtcgccgccgccgccagctgaagcagaagatggcgtcgtcggcgtccaccctcgagatcgaggcccgcgacgtggtgaagatagtgttgcagttctgcaaggagaactcactgcagcagacgttccagacgctgcaaaatgagtgccaggtctccctcaacactgtcgacagcatcgacaccttcatcgccgacatcaatgccgggcgctgggacgcggtgctgccccaggtcgcgcagctcaagctgccgcgcaagaagctcgaggacctctatgagcagattgtgttggagatggccgagctccgggagcttgacacggcccgcgccatcctccggcagacacaggtcatgggcgtcatgaagcaggagcagcctgagcgctacctccgccttgaacacctccttgtgcgcacgtatttcgaccccaatgaggcctaccaagaatccaccaaggagaagcggcgagcacagatcgctcaagctgttgcttctgaagtctcagtagtcccgccatctcggcttatggcattgattggtcaggctttgaaatggcagcaacaccaaggactgttgcctcctggcacacagtttgatttgttcagaggaactgctgctatgaagcaagatgaagaagagacataccctactactttgtctcatcaaataaagtttgggaagaaaacccatcccgaatgtgctcggttttcacctgatggtcagtaccttgtttcatgctcagtggatggaatcattgaagtctgggattatattagcgggaagcttaaaaaggatcttcaatatcaagctgatgaaagttttatgatgcacgatgatgctgtgctatgtgttgattttagtagagattctgaaatgctggcatccgggtcacaggatggaaagattaaggtttggcgaatacgaactggccagtgcttgcgacgccttgagcgctcacattcgaaaggtgttacaagtgtgacattctcacgtgacggaacccagatattgagtacatcctttgacactactgcgagagtacatggcctcaagtctggaaagatgctgaaagagttccgaggtcataattcctacgtgaattatgccatctttactgctgatggtaaccgcgttattacagcttccagtgattgtactgttaaggtctgggatgcaaaaacaacagattgcttgcatactttcaagccaccacctcctttgaggggaggagatgcatctgttaattctgtccatttatttcccaaaaataccgaccacattgttgtctgtagtaagacttcggcaatattcatcacgactttacaaggacaggttgtaaagactttctcatcaggtaaacgggaagggggagactttgttgcagcttcagtttccccaaaaggagaatggctatattgtgttggtgaagacatgaacatgtattgctttagctaccagtctggtaaactggatcatctaatgaaggtccatgagaaggatgtcataggcattacacaccatcctcataggaatttggttgccacctatgcggaagattgtacgatgaagatatggaagccttgatttttgtatacttgtttgtattaatcctgtatttttaggcaacatggttatccagctgtctaaagtgctaattaaataggccgtatttgattttgcaatttagagatctgaaaggtatttaataggtaattatcgactccttggtgcatgtagaaccaatgtgttccattgtatcgtgtcctagttttagtatctctgaatggtttacaaagctgattatgatggctcttttcagc

SEQ ID NO: 11284 - protein, 517 aa, Panicum virgatum
  misc_feature: Ceres CLONE 1727530
  misc_feature (343)..(381): Pfam Name: WD40 Pfam Description: WD domain, G-beta repeat
  misc_feature (258)..(296): Pfam Name: WD40 Pfam Description: WD domain, G-beta repeat
  misc_feature (300)..(339): Pfam Name: WD40 Pfam Description: WD domain, G-beta repeat
  misc_feature (208)..(246): Pfam Name: WD40 Pfam Description: WD domain, G-beta repeat
  misc_feature (478)..(516): Pfam Name: WD40 Pfam Description: WD domain, G-beta repeat
  misc_feature: SWISSPROT Homolog: EC 2.7.11.7 [Myosin heavy-chain] kinase
MASSASTLEIEARDVVKIVLQFCKENSLQQTFQTLQNECQVSLNTVDSIDTFIADINAGRWDAVLPQVAQLKLPRKKLEDLYEQIVLEMAELRELDTARAILRQTQVMGVMKQEQPERYLRLEHLLVRTYFDPNEAYQESTKEKRRAQIAQAVASEVSVVPPSRLMALIGQALKWQQHQGLLPPGTQFDLFRGTAAMKQDEEETYPTTLSHQIKFGKKTHPECARFSPDGQYLVSCSVDGIIEVWDYISGKLKKDLQYQADESFMMHDDAVLCVDFSRDSEMLASGSQDGKIKVWRIRTGQCLRRLERSHSKGVTSVTFSRDGTQILSTSFDTTARVHGLKSGKMLKEFRGHNSYVNYAIFTADGNRVITASSDCTVKVWDAKTTDCLHTFKPPPPLRGGDASVNSVHLFPKNTDHIVVCSKTSAIFITTLQGQVVKTFSSGKREGGDFVAASVSPKGEWLYCVGEDMNMYCFSYQSGKLDHLMKVHEKDVIGITHHPHRNLVATYAEDCTMKIWKP

SEQ ID NO: 11285 - DNA, 2566 bp, Panicum virgatum
  misc_feature: Ceres CLONE 1727542
  misc_feature: Encodes the peptide sequence at SEQ ID NO. 11286
gaaacgaggcctctgcggctctgcctccggtcctccacctccactccccaagcctcccactcctctagatcgccggcccctcgctcggctcggccatggggggcggttccgcgctgtccctcgtcgcggctgccgtctgcctctccctcgccgtcctcgcgcctgctgtctccggagatggtgccacgttagagtcagttccagaccttgtgaaggcaatgtacatagacattgaaagtttcccttgtgtgaggctgctgaatctttctggtgaaattggctgttcaaatcctggaagtgaaaagatcattgcaccgattgtaagattaacaaaaggcagtgatcaattggttcaaccatccactgttcttcttcccatagatcagatgtcaaatttctttctgagggtatccaatgatccagaatttctccagaaggtgtctggtgtactgatcgagtcaaatggtgcaaacaataacttgcaagagttgtcgccggatggaaaatttccacaagatgcttttgcaccctactcaaatcacagccacgattggaatcctgctggatcaggtattatgtggaacagatatgactttcctgtatttctactctcagaggagagcacacaggttctgcaaaaggtctctgaaaagaataagaagactgacaatggatataaagcaaatgttgcagaattcgaccttgttatgcagacaactaaagctcaaacacatgattcaacatcctgcctcaaagagcgctcatgcttgcccttaggaggacacagtgtatgggcttcattaccgccaattaaaaatggatctacagaacatccgaaaccaataatattggctatcacatcgcaagactctgcatcattttttcgggaccgtagtatcggttcagattctcccatatctggattgattgccttgctcactgctgttgatgctctttctcacattcatgatctaagcaaccttaagaaacagcttgtgtttgctgtttttaatggtgaagcctggggttatcttggtagccggaaattcttacaggaattagataaaggtgctgattctgtgaatggaattaacagcttaatgattgaccaggtactggagatcggttctgttggcaaggctgtaattgaggaatatccatcattttatgcgcatgctgcagggaattcatcagcttcaaagaaaatattagatgcactgcaaagtgccagcgagtcacttggttctgacaattttaaagtaaaacaagcagcttcatcaaatcctggtgttccaccatcgtcattaatgtctttcataagaaagaatatgtcaacttctggagttgtgttggaggactttgattcccacttttccaatagattttatcatagctacttggataaccctgcaaacgtcaattcttcatcaatagcagcagctgctgctttggttgccaggtcgctgtatattcttgctagtgctgactcagttgtcgatctcatgacactgaacactataaaagtgaatgtttcattagttgaggaacttattggatgtctacttacttgcatgcctggtctttcttgcggccttgtgaaaagcttcatttccccaagcagcagttcttgcccaagtcattatgttggtgtttttctggatgatccttctggcacacagtttccttcatatgcagatgacacctctcggtttgtatggaacttcttggcagacagaacttctactttagcgggtaataaaagctcttgtactggaaagtgtggtgatgaaggtgaagtatgcgtaggggcagaggtggagggtggaggtagatgcgttgtgtctacaaccaggtatgttccagcatattcaacacgggtgaagtttgaggacaatgcatggcatgtacttccagcaaactcgtcagatccaatgggcgtggtggatcctgtgtggactgaaagctactggaacacaattggcctccgggtctatgcagtgcaagattcaacttacgattggcttatccttcttgcggggctcagtatcactgccgcatcgtattgtgccgtgcacgtcggcagagcatacatttccaaggtcgtcaagtgcgactgaagcattattgacctgctccacggactctgggaacccccggtctatatgttctgggattttgagctggacaaccgagctaattcagttggcgatttgtagaacattacaacacatcagcacatgtgatggggtgattgaactgccgagaaaaccacaaggaattatggagccgtccagctgagtagccgcctatggacgttagctcctcatcattgtgccgaggtgcccttgtcttgggccggcacctgtaatatggaaaggtgcccctggcacgcttggcactgaactggttggtggattatcagacgcctctagctctaggtgtatgtttccaggaacgtgcgtctttctgggtttgtcgaccattgggtgaatgctacatatctatccagttttggttgcgtatgcctgttcctcacgactccattgatttgcacactccaattatc

SEQ ID NO: 11286 - protein, 673 aa, Panicum virgatum
  misc_feature: Ceres CLONE 1727542
  misc_feature (249)..(458): Pfam Name: Nicastrin Pfam Description: Nicastrin
MGGGSALSLVAAAVCLSLAVLAPAVSGDGATLESVPDLVKAMYIDIESFPCVRLLNLSGEIGCSNPGSEKIIAPIVRLTKGSDQLVQPSTVLLPIDQMSNFFLRVSNDPEFLQKVSGVLIESNGANNNLQELSPDGKFPQDAFAPYSNHSHDWNPAGSGIMWNRYDFPVFLLSEESTQVLQKVSEKNKKTDNGYKANVAEFDLVMQTTKAQTHDSTSCLKERSCLPLGGHSVWASLPPIKNGSTEHPKPIILAITSQDSASFFRDRSIGSDSPISGLIALLTAVDALSHIHDLSNLKKQLVFAVFNGEAWGYLGSRKFLQELDKGADSVNGINSLMIDQVLEIGSVGKAVIEEYPSFYAHAAGNSSASKKILDALQSASESLGSDNFKVKQAASSNPGVPPSSLMSFIRKNMSTSGVVLEDFDSHFSNRFYHSYLDNPANVNSSSIAAAAALVARSLYILASADSVVDLMTLNTIKVNVSLVEELIGCLLTCMPGLSCGLVKSFISPSSSSCPSHYVGVFLDDPSGTQFPSYADDTSRFVWNFLADRTSTLAGNKSSCTGKCGDEGEVCVGAEVEGGGRCVVSTTRYVPAYSTRVKFEDNAWHVLPANSSDPMGVVDPVWTESYWNTIGLRVYAVQDSTYDWLILLAGLSITAASYCAVHVGRAYISKVVKCD

SEQ ID NO: 11287 - DNA, 2092 bp, Panicum virgatum
  misc_feature: Ceres CLONE 1727545
  misc_feature: Encodes the peptide sequence at SEQ ID NO. 11288
acgcacgccaccgcgcccgcctgcctctgcctgtcgtctgcggcggccgccccgcctgcctccgccttctcctcccgtcgcctcgggatccccagagcagcagctcggcataggggaatgtcccggggggcgctgccaccgcctccccgggccgcgagagtcgccgccgcatttactcgccagctagacggggcacgcctcgcgagagcccccagcccggcccagagggagcggctggcagtgactatatagcctggtcgccggagcagggagggctcgatccggagccgagcgcggggagtggcgcctcctccttgccgcgcagttcttgctcgtcccgcgtcgcgatgggggctgcggctgcccgcggccgccgggtgctgctggccctcggcctcgcgctgctcgtggcgctccgtggctgcgcggcccaagggggcgaggacggcggcggcggctcggacgccccggccgcggcgacggcgccgatggaggagaaggagcgggcggcgctgtacgctgccatcgagggcttcgtcggcaaggggtggaacggctccgggctctaccccgacccctgcggctggtcgcccatccagggggtgtcatgtgatctgttcaacggcttgtggtacccaacggcgatcagcattggcccagttcttgacaactcgctgcagtgcgcccctgacgcccggttcagcccccagctgttcgacctgaggcgccttaggacgctctccttctacagctgctgcccggcgagcaaccccacggccatccccgccgccggctgggagaagctctcggggagcctcgagacgctcgagttccgcaccaacccgggcctcaccggcgccatcccggtctcccttggccgccttgccagcctgcagtccctggtgctcgtcgagaacaacctgactggacccgtgcccgccgagctcggcgcgctgctgaagctgaggcggctggtgctgtccgggaacgggctgtcggggccgatcccggcgacgctcggtaacgcccgccgccacgacgagctgctgatcgtggacctgagcaagaaccatctaacggggtctctgcctgcatcgctaggtggcctgagggggctcctcaagatggacctgagcaataaccagctggacggcagcatcccgccagagctcggcgcgctcgggaacctcacgctgctggacctcaggaacaacagcctcaccggcggggtgccccagttcgtgcagggcatgacgtcgctgcaggacctgctactctcgaacaacccgctgggcgggagcctgccggcgaccgggtgggagaagctgagcggcgcgctcgcgacgctggacctgtccaacgccggcctgaccggcgccataccggagtccatggcgtcgctggccaggctgcggttccttgcgctggaccacaaccggctgacgggccccgtgccggcggggctcgcggagctgcccagcctcggggccctgtacctgaacggcaacaacctgacgggcgcgctggagttcgcgccggggttctaccggcggatggggcggcggttcgcgtcgtgggacaacccggggctgtgctacgacgtcgcggccgtggacgcggcgcacgcgccggcgggggtggtggtgtgcaaggacctgcaggagcccagcgtcgtcccgcgggacggcacggaggagggcgggggcaggaagcccgaggcgagctcgagcctcgcggcgtcgtcggcggtggtcgggttctcggcagccaggggcggcgggttctggtccgtggtggccgttcagggcaccgtggcggcggttcttgggttggtgctcctatagcagcggcaggttcagacagatggaacgggagaagaacatggagaaacttgtaggtagttgagcgcaaaccagtttctgcgtgttctgtgatcttttggcccttttttggctggtgcttctgctcatcatggatggatggacgtgttgtcgtggttagttgaaagccagattacagtagagtgtgagttctgtgtaattagcctgtgttctcctctgatgttgcaacatgacgtggataattagccggc

SEQ ID NO: 11288 - protein, 498 aa, Panicum virgatum
  misc_feature: Ceres CLONE 1727545
  misc_feature: SWISSPROT Homolog: EC 2.7.11.1 Non-specific serine/threonine protein kinase
MGAAAARGRRVLLALGLALLVALRGCAAQGGEDGGGGSDAPAAATAPMEEKERAALYAAIEGFVGKGWNGSGLYPDPCGWSPIQGVSCDLFNGLWYPTAISIGPVLDNSLQCAPDARFSPQLFDLRRLRTLSFYSCCPASNPTAIPAAGWEKLSGSLETLEFRTNPGLTGAIPVSLGRLASLQSLVLVENNLTGPVPAELGALLKLRRLVLSGNGLSGPIPATLGNARRHDELLIVDLSKNHLTGSLPASLGGLRGLLKMDLSNNQLDGSIPPELGALGNLTLLDLRNNSLTGGVPQFVQGMTSLQDLLLSNNPLGGSLPATGWEKLSGALATLDLSNAGLTGAIPESMASLARLRFLALDHNRLTGPVPAGLAELPSLGALYLNGNNLTGALEFAPGFYRRMGRRFASWDNPGLCYDVAAVDAAHAPAGVVVCKDLQEPSVVPRDGTEEGGGRKPEASSSLAASSAVVGFSAARGGGFWSVVAVQGTVAAVLGLVLL

SEQ ID NO: 11289 - DNA, 1856 bp, Panicum virgatum
  misc_feature: Ceres CLONE 1727548
  misc_feature: Encodes the peptide sequence at SEQ ID NO. 11290
aagaaccaccctatcctctcctccctctgcttcccctgttctccggccggccatggccatgtccatggcgatgtccaaggccctcgcggcgcgtcatgcgactcatttgcagcaccgcctcgtggcgtcaagctcccaggcggcgccgcggctgccacctctcccgcgccggccgagcctcgccctcgcggtgacagttgcctcgcccccgcgcccgcggcgactcctaccggcgagccccaggtcctcgtcgagtgagtcggacctttcccccacgccgcagtcggaacgcaccatgacggcatgggacctagccagtctctgggtcgggctcgtcgtcggcgtgccttcctactacctcgcgggcagcctcgtcgacctcggcatgtccgcgctccagggcgtcgccaccgtggcactcgcaaacctcgtcgtcctcggcacgctcgtgctcacggcagcgccggcggtcacgcacggactgccgttcccggtgctcgcgcgcgccgccttcggcgtccgcggcgcgcacgtcccggccgtcatccgcgcgctcgtcggctgcgggtggttcgggatcgagtcctggattgggggacgcgccatcttcctgctcctgccgtcccggctcaagtcgtaccagccgctgctcgcaccggtgcccggactcggcgcggcgccgctcgagttcgcgtgcttcctcgccttctgggccgcgcagctcggcatcatcatgcacggcatggagggcatccgcaagctggagaagttctcggcgccggtgctcatcgtgctcacatcggcgctgctggcctgggcctacacttcagccggtggcttcgggcgcatcctctcgctgccgccgaggctcacaggcgcagagttctggaaggtcttcttcccgtcgcttaccgcgaacatcagcttctgggcgacggtggccatcaacataccggacttcgcgcggtacgcgcggagccaggcggatcaggtgctcggccaagccgggctgccggtgttcatgggcatgttcaccttcgccgggctcgccatcacctccgccaccgaggccatcttcggccacgtcatctccgacccgatcgagctcctcggccgcatcggcgggccggcgacgacgttccttgccatcttcggcatcggcctcgcgaccgtcacgaccaacattgccgccaacgtcgtcgcgccggcgaacgcgctggtcagcatgagcccgcggaggttcacgttcgccaagggggcgctcgtcaccgcgctgctcggcatcgcgttccagccgtggcggttgctcagctccagcgagagcttcgtgtacacatggctgctcggctactcggcgctcatgggtcccatcggaggggtcatcctcgccgaccactacattgtgcggcgaaccgctctggacgtcgacgcgctctactcggaggacagcggcggcccttactacttccagagtggcttcaacgtcgcggccatggcggcaatggcagccggagttgcgcctatcgtgccgggatttctgcacaaggttggggtgctaccgggtgtctcgaagacatttgtcacggcgtacaacaatgcctggttcgtgagctttttcgtcgccggcgccgtctacagcctgctctgcggccggagaggggtacaggggaaacaacacctcaattgatactaggctgaacttgtaaaaaaaatagcaggatacagttaaagtgccgaattggtgtttttcaggtaaatcgtagatctgtcaaacttgcatcagtaaatacatgtaaattttggtgataaatacccttatatgctgaccaaaatagcattttactaggtgccacctg

SEQ ID NO: 11290 - protein, 544 aa, Panicum virgatum
  misc_feature: Ceres CLONE 1727548
  misc_feature (74)..(520): Pfam Name: Transp_cyt_pur Pfam Description: Permease for cytosine/purines, uracil, thiamine, allantoin
MAMSMAMSKALAARHATHLQHRLVASSSQAAPRLPPLPRRPSLALAVTVASPPRPRRLLPASPRSSSSESDLSPTPQSERTMTAWDLASLWVGLVVGVPSYYLAGSLVDLGMSALQGVATVALANLVVLGTLVLTAAPAVTHGLPFPVLARAAFGVRGAHVPAVIRALVGCGWFGIESWIGGRAIFLLLPSRLKSYQPLLAPVPGLGAAPLEFACFLAFWAAQLGIIMHGMEGIRKLEKFSAPVLIVLTSALLAWAYTSAGGFGRILSLPPRLTGAEFWKVFFPSLTANISFWATVAINIPDFARYARSQADQVLGQAGLPVFMGMFTFAGLAITSATEAIFGHVISDPIELLGRIGGPATTFLAIFGIGLATVTTNIAANVVAPANALVSMSPRRFTFAKGALVTALLGIAFQPWRLLSSSESFVYTWLLGYSALMGPIGGVILADHYIVRRTALDVDALYSEDSGGPYYFQSGFNVAAMAAMAAGVAPIVPGFLHKVGVLPGVSKTFVTAYNNAWFVSFFVAGAVYSLLCGRRGVQGKQHLN

SEQ ID NO: 11291 - DNA, 2285 bp, Panicum virgatum
  misc_feature: Ceres CLONE 1727549
  misc_feature: Encodes the peptide sequence at SEQ ID NO. 11292
gcccccctcaaaatcctccaaccaatcccaccagcttctcatctcaaatccgccccgaaacctcccaccgcccgcccgggtcgtgcgcaatcggcagctgcccggcgctcccggatcgagaaaggaggccgctttggtggttctggcgggcgaatctagcggcgattcgctcagatttggatttagggttttggaggtggtagtgggcttctgccgccgggagagatgtcggcagctgtggcgtgcgcggagagggcgactaacgagatgctcatcggcccggactgggcggtcaacatcgagctctgcgacatcatcaacatggatcctggacaagcaaaagatacactgaagctcctaaaaaaacgtcttggaagcaagaattcgaaagtgcaaattctgacactttatgtgctggagacactaagcaaaaattgtggggatgttgttcaccaactgatcgttgaacgtgacatattaagtgaaatggttaagatagtaaagaaaaagccagatttaaatgttcgggagaagatattgagtttgattgacacatggcaagtggcttttggaggttcttctggaagatatccccagtatcatgcagcttaccaagaactcagggctgcaggtgttgattttcctcctcgtgaggaaaattcggtcccactttttacacctcctaaaactcagccattgagacatccacatttatatccacctccaggtcaaagctatgaagatgctgccatagaagcttctcttcaatcagccccttctgtacctgccctgagtctaagtgagattcaaagtgctcgtggaattgtggatgtgctagatgagatgttaaatgctctggaccacaggcatcctgagggtgtgagggaggaggtcattgttgaccttgttgggcagtgccgatcgtatcaatctcgtgtcatggatcttgttaacagtaccggtgatgagagccttttatttcaggctctaggactaaatgatgaattacagcgtgttgttcagcgccacgatgacatagcaaagggggttcctcctggtacaggagcaacggcccctgcttctgcaaatgtaaaccaagggactgctcctcctaggtccactggggtttcattttctccacttttaaacgtacacgaggatgatgagccagaaaatgagttctctgtgctttcccgcaggtctgcaagggatggcacagcggcccagagcaatccaccttctgctccgagaagtgaaaggccatacacaagcccacttcttcctcccccgccagcatctaagatgcctgtttacagagaggcaagcaatattgactaccttagtggggactcctacaagtcagaaaaggtttcagatgatttcatcaacccaaccgcccctgccaatatatccacgtcatcccattctaaggcagaagcatatccaccaccaagctacggtagcaggacagacagtgtgtctgatgactttataaacccaactgcacccagcttctccgcgccttctcatcctaaaagtgaggagccaacacgttcatctgcgaagcagcaggagagcctacctgatgatgacttcataaacccaaccgctcttcctggtttctcatcgccagctaccaaaggttatgaagattccagggaagatgttccgaaggctccttgggaaccacaggctgctgcgggttccctacccccgcctccagcgaggtatggccagaggcagcagtactttgagcagaatgtgtattctggcgggagcaatggaggcggctacgatggacttgtgacgcagacagagaatctctccctcaaccagaatgagaagagcagcgcctcatcacggccagcggcatcccgccagacgaagcccgaggactccctcttcaaggacctcgttgactttgcgaaggccaagccgtcatcaccgtcgaaaccagccaacagccgccggactcgctgagccaacgcgtgtagcacgctcacaaagcttagcgggcctagatgatactgtcaaaataagagccatttgaagactggattccttttgggtcgccaattgttccgattgcattttcgagaatttagagttgaggatttcagatactatactgggccatgatccagtgtgtgcgcgcgcgatgtgtagttagctgctctcaaacttccattgctgttggcttcaccacccattttttttttttctcacttagctgtgtatatatatgctactcggatttgacagtgatattcatagtctgagtttgc

SEQ ID NO: 11292 - protein, 584 aa, Panicum virgatum
  misc_feature: Ceres CLONE 1727549
  misc_feature (2)..(136): Pfam Name: VHS Pfam Description: VHS domain
  misc_feature (184)..(281): Pfam Name: GAT Pfam Description: GAT domain
MSAAVACAERATNEMLIGPDWAVNIELCDIINMDPGQAKDTLKLLKKRLGSKNSKVQILTLYVLETLSKNCGDVVHQLIVERDILSEMVKIVKKKPDLNVREKILSLIDTWQVAFGGSSGRYPQYHAAYQELRAAGVDFPPREENSVPLFTPPKTQPLRHPHLYPPPGQSYEDAAIEASLQSAPSVPALSLSEIQSARGIVDVLDEMLNALDHRHPEGVREEVIVDLVGQCRSYQSRVMDLVNSTGDESLLFQALGLNDELQRVVQRHDDIAKGVPPGTGATAPASANVNQGTAPPRSTGVSFSPLLNVHEDDEPENEFSVLSRRSARDGTAAQSNPPSAPRSERPYTSPLLPPPPASKMPVYREASNIDYLSGDSYKSEKVSDDFINPTAPANISTSSHSKAEAYPPPSYGSRTDSVSDDFINPTAPSFSAPSHPKSEEPTRSSAKQQESLPDDDFINPTALPGFSSPATKGYEDSREDVPKAPWEPQAAAGSLPPPPARYGQRQQYFEQNVYSGGSNGGGYDGLVTQTENLSLNQNEKSSASSRPAASRQTKPEDSLFKDLVDFAKAKPSSPSKPANSRRTR

SEQ ID NO: 11293 - DNA, 1642 bp, Panicum virgatum
  misc_feature: Ceres CLONE 1727550
  misc_feature: Encodes the peptide sequence at SEQ ID NO. 11294
gttttcagctcgcggaacgggcggcagagtcccagtcctctcgctttctcctccccgtgattcggctcgcttccatcgggttcgattagggagccagagccagagggagggaatcgccccgcgcctgctccagcagcccagctctccgtccatttcctctccgccccgccgattcgccggatcgggccgtcgtggtgatgccgctggcggagtcgccccagtggcgccggaaggccaccgatttcttctctacatccagcttcaagctgaagcaagcaggacaatcagctggggataatttagctgatgttgctgggaaggttgggtccgtggtgaagagtcgatgggctgtcttccaggaggctaggcagcagcagcagcagcgtccaccgggtgagacagtgcaggagcgtttcatcactgctgctgcctccactgggttgcttttcaggaagggcatttcagagacaaaggagaaggttgctgtggggaaggtcaaagtcgaagaggctgctaaaaagactgcagataaaagcaagactattttgaacaatattgaacgctggcagaagggagtcgcaagcactgatgtatttggtgttcctattgaagccactgtacagcgagagcagtctggtaaagctgtgcccttgatgcttgtgaggtgtgcagactacctggttatatcaggcttgaataatgagtacttattcaaatctgaaggtgacagaaaagttcttcagcagttagtttctctttacaatgaagattcaggcgcatctttacctgaaggtgtcagtcccattgatgtaggagcactggtgaagtgctaccttgccagcatccctgaaccgctcactacatttgcgctttatgatgagcttagagatgcgagggttagcattcctgatcttaggaacatactgaagaagcttccaaatgttaactacatgacactagaatttgttacagcattgctacttcgagtaagccgtaaatcatcacttaacaagatggactctggtagccttgctgtggaatttgcgcctttgatcatgtggcggcaaggcgatgctagcacggatttgcgtaaccacctcaagtttactttgaaaccgcctcctaaaattgtagacacaacatcaaataccactgcatgggaccttttagatgaggatgatgaggatgcttcatcccagatccccttggatgatgcttcgcccccagactacagctccatcgaggtcatccagtgtctgatcgagcaccacaatgccattttcacggatgcaaatgaaacagtatggagatgattggtatcttttctgtagatctttctggtgttagctcgtgctatgtacaagttccaggtaggagggtgggttactgctcgttattgttaggataagcattttggccggaacatttttggattaggtttgtatatacactagtactaattcttcacgggaagaaatctctgtaggatctggtcatgccttaccaataataatgtacttggatgtgaaccagatggtcgtggtgtgtggatgaatttgctgattttttcagttggtaggtgttgcataggaatgcttgtgtatcatctacggttgactggtatacatgatgaattggcgac

SEQ ID NO: 11294 - protein, 371 aa, Panicum virgatum
  misc_feature: Ceres CLONE 1727550
  misc_feature (151)..(295): Pfam Name: RhoGAP Pfam Description: RhoGAP domain
  misc_feature: SWISSPROT Homolog: EC 2.7.11.1 Non-specific serine/threonine protein kinase
MPLAESPQWRRKATDFFSTSSFKLKQAGQSAGDNLADVAGKVGSVVKSRWAVFQEARQQQQQRPPGETVQERFITAAASTGLLFRKGISETKEKVAVGKVKVEEAAKKTADKSKTILNNIERWQKGVASTDVFGVPIEATVQREQSGKAVPLMLVRCADYLVISGLNNEYLFKSEGDRKVLQQLVSLYNEDSGASLPEGVSPIDVGALVKCYLASIPEPLTTFALYDELRDARVSIPDLRNILKKLPNVNYMTLEFVTALLLRVSRKSSLNKMDSGSLAVEFAPLIMWRQGDASTDLRNHLKFTLKPPPKIVDTTSNTTAWDLLDEDDEDASSQIPLDDASPPDYSSIEVIQCLIEHHNAIFTDANETVWR

SEQ ID NO: 11295 - DNA, 742 bp, Panicum virgatum
  misc_feature: Ceres CLONE 1727551
  misc_feature: Encodes the peptide sequence at SEQ ID NO. 11296
tttccgcgctgcgcttgtaaacatctatccagcagagcgcagcaggatggtgtacgcgctcctgctggtcgccttggcggccgtcgccgccgcggcggtgctccgccactacctcccgctgctccgcggcggcctccccaagggcagcttcggctggcccctcatcggcgagaccatcggcttcctccacgcgcacccgtccaacaccgccggcggcttcctcaaggagcacgtcgccaggtacgggacggtgttcaagtcgcacctcttcggctcgccggcggtggtctcctgcgacgaggagctcaaccacttcgtgctgcacaacgaggagcgcctgttcgagtgcagctaccccggcgccatccgcaccatcctcggcgagtcctccgcgctggtggtcaccggcgagcgccaccgccagatccggagcatgttcctcgccctcgtcgcctccacggggctcaaggcctcctacgtcgccagcgtcgacgagtccgcgcgctccctcatcgcgtcctggcgcggccgcgagaccatcagcttctgcgaggaggcgaggaagttcccctacaaggtgatcatggagcaggtgctgggcctgccgccggacggcccggtggccctccggatcctggaagagtaccagatcttcatgaaggggatcatctccctccctatcaccctccccgggacagcattttccaaggccgtcaaggcaaggaagaggatatccgagacc

SEQ ID NO: 11296 - protein, 231 aa, Panicum virgatum
  misc_feature: Ceres CLONE 1727551
  misc_feature: SWISSPROT Homolog: EC 1.14.13.77 Taxane 13-alpha-hydroxylase
  misc_feature: Useful for making plants with modulated oxidative stress sensitivity
MVYALLLVALAAVAAAAVLRHYLPLLRGGLPKGSFGWPLIGETIGFLHAHPSNTAGGFLKEHVARYGTVFKSHLFGSPAVVSCDEELNHFVLHNEERLFECSYPGAIRTILGESSALVVTGERHRQIRSMFLALVASTGLKASYVASVDESARSLIASWRGRETISFCEEARKFPYKVIMEQVLGLPPDGPVALRILEEYQIFMKGIISLPITLPGTAFSKAVKARKRISE

SEQ ID NO: 11297 - DNA, 754 bp, Panicum virgatum
  misc_feature: Ceres CLONE 1727551-R
  misc_feature: Encodes the peptide sequence at SEQ ID NO. 11298
tcgtgttatcaatgagggactgagatgtggcaacatcgtcaagctagtgcacaggaaggttctcaaggacgtcacctacaaaggatacgtgatcccggctggttggaaaatcctgcccatcttgggtgctgtccacgtggacccatcgcatcatctggaacccgagcagtttcagcctcgcagatgggaggggctgaaccagccggctggcaagagcttcgcgccgttcggaggtggactgcggctctgccctggatcggagattgtcaaagtggaggctgctttcttcctgcaccaccttgtgctcaactacaggtggaggatgggtgaagaggacgctcccatgctgcaccagtacgtggaattcaagaagggcctgcccatacagctcgagccggtcagctgatgctcatcaagcctttgcctcgctcgctcttcgtcaagactccaagagagatgaaataagttgagacgtcggacccccgccagccagccagtcctgaatcgcgatttacaagtcacaaaaaaacaaaaaataaataaaataaaaatagctgtctacgtttatgtaattttattttttacgcgtaatttactgttattatgatgcataggcatcatggtttatgtatcacccgagatgggggacacgtacggtacggggtttggcacgagtcatgcaggtctcaaacctgaacctccagttgtagcactcgccatatctatcatatcctcccgttggttttccattgct

SEQ ID NO: 11298 - protein, 134 aa, Panicum virgatum
  misc_feature: Ceres CLONE 1727551-R
  misc_feature: SWISSPROT Homolog: EC 1.14.13.93 (+)-abscisic acid 8'-hydroxylase
  misc_feature: Useful for making plants with modulated oxidative stress sensitivity
RVINEGLRCGNIVKLVHRKVLKDVTYKGYVIPAGWKILPILGAVHVDPSHHLEPEQFQPRRWEGLNQPAGKSFAPFGGGLRLCPGSEIVKVEAAFFLHHLVLNYRWRMGEEDAPMLHQYVEFKKGLPIQLEPVS

SEQ ID NO: 11299 - DNA, 1683 bp, Panicum virgatum
  misc_feature: Ceres CLONE 1727552
  misc_feature: Encodes the peptide sequence at SEQ ID NO. 11300
agcttccagtaagcttccggaacaaaagcctccgccgccggcggcagcccacgatccatggcttccggggagggggactacggagacgcggccaccatgctggcgctgcggcagctgtacgcggggtacgcctaggcagacgtggcgtcgctcgatccggcagccgtggccgcggccgcggccggcgccgccgtgcgcgtgcgcgtgcgcggcgcggcgcaggcggtgcgcgccgtggggcggcgcgtggcgttcctcgtgctgcggcagggggcggccaccgtgcagtgcgtggtggccggcggcgggatggcgcggttcgcggccgggctgagccgggagtccgtggtggacgtggccggcgtcgtgtcgctaccccgggagcccgtccgcggcaccacccagcagctcgtggagatccacgtggagaaactccactgcatcagcagggccgtccccaacctcccgatcagcgtcgacgacgccgcgcggagcgaggaagacgtcgcaagagccaaagctgcaggggagcagctcgttcatgtcgggcaggacaagcggctggactaccgggtcatcgacctccgcactgccgccaaccaggccatcttccgcgtccagtgccaagtcgaaaacatgttcaggcaggtgctgctgtctgaagggttcgtgggcatccacacgccgaagctgatcggcgggtcgagcgagggcggcgcggcggtgttcaagctggactacaacgggcagccggcgtgcctggcgcagtcgccgcagctgcacaagcagatggcggtgtgcggcgggttcgagcgcgtgttcgaggtcggccccgtgttcagggccgagggctccgacacccaccgccacctctgcgagttcgtcggcctcgacgtcgagatggtgctcagggaccattactctgaggtgtgcgacgtcgttgacaggctgttcgtcgccatgtttgatcacctgaacaagaactgcgcccgggagctcgaggccatccataggcagtaccccttcaaaccgttgaagtacttggagacgacgctgcgcctcgactacgaccaaggcatccggatgctgcaggaagccggggtccacgtggaccccatgggggacctcaacacggaggccgagaagaagctgggtgagctcgttcgagacaagtacgacacggagttctacatgctctgccggtacccgtcggcggtgaggccgttctacaccatgccctgctccgacgacccgcgctacagctgctccttcgacgtcttcgtccgcggcgaggagatcatctccggggcgcagagggtgcacgacccggagctcctggcggcgcaggcgcaggcgcggggcatcgacgtccgcaccatcgccgcctacgtcgactcgttccggtacggcgcgccaccgcacggcgggttcggagtcgggctggagcgggtcgtgatgctcttctgcggcctcggcaacatcaggaagacgtcgctcttcccgcgcgaccccagaaggctggcgccgtgacgacgacggcgctcacggcttgccctgtgcatgccaaaatgcacattaataataagcttacatgtatgtttatgggggactggattgcttctcccaactttgctctggattgactctgcgacatgagaaaaagaaaatacatgggcacaagac

SEQ ID NO: 11300 - protein, 406 aa, Panicum virgatum
  misc_feature: Ceres CLONE 1727552
  misc_feature (80)..(402): Pfam Name: tRNA-synt_2 Pfam Description: tRNA synthetases class II (D, K and N)
  misc_feature: SWISSPROT Homolog: EC 6.1.1.12 Aspartate--tRNA ligase
MARFAAGLSRESVVDVAGVVSLPREPVRGTTQQLVEIHVEKLHCISRAVPNLPISVDDAARSEEDVARAKAAGEQLVHVGQDKRLDYRVIDLRTAANQAIFRVQCQVENMFRQVLLSEGFVGIHTPKLIGGSSEGGAAVFKLDYNGQPACLAQSPQLHKQMAVCGGFERVFEVGPVFRAEGSDTHRHLCEFVGLDVEMVLRDHYSEVCDVVDRLFVAMFDHLNKNCARELEAIHRQYPFKPLKYLETTLRLDYDQGIRMLQEAGVHVDPMGDLNTEAEKKLGELVRDKYDTEFYMLCRYPSAVRPFYTMPCSDDPRYSCSFDVFVRGEEIISGAQRVHDPELLAAQAQARGIDVRTIAAYVDSFRYGAPPHGGFGVGLERVVMLFCGLGNIRKTSLFPRDPRRLAP

SEQ ID NO: 11301 - DNA, 1723 bp, Panicum virgatum
  misc_feature: Ceres CLONE 1727568
  misc_feature: Encodes the peptide sequence at SEQ ID NO. 11302
cggcggtgggtgggagagcgagaggaagggtttccccgaaatcagggaagcagcgagaaatggagatcgactccggcggcggcggcggcggagcgaagaggcaaagggtggataagcaaggggaccgatgcgaagcggtggacgcaggtgcggtaccggtggaccgcatctcggtgctgccggacgagctgcagctgcgcatcctgacgcacctctcgctcaagtacgcgatccgcacgggcgcggtcgcgcgcgggtggcgcgacctgtggaagcgccggtgggagcaccgcgctgtcgtcgaggtctacgtcggattccgccacgacgtgcggagggagctagacgcgctggagcgcgagccgcgcccgcgccgccgcctcgaccgcttctccttcgtcgtcgatatctgcaagctcaagtcctcggagctccggcgcttcaccgaatacgccgccgagtgccgcgtcgaggacctgcacgtcgagacgcggaacagaacgctcgagcgcaagctcaatttccacctgccgctgtgcagcccgctcctcgcgcgcctctcgctccgccgaatcggcatctcaaccatgtactacaaaggcgcccagccgttccgcgctctcgtagtcattcggctccactcaatctcaattggccatgcgtctttcacgaaaatgatggcgctgtgccccaacctcatcactctcgacctgctccactgcgaatgtggcaacttcttctactcggtggccatgccgcagaacctgaggaatctcaccgtcgcgtactgtaatgggatcgccagtgtgaactttgagcttgggcctagcttgcgctccttccgctacagcggtgacttcggcaaagcgcccttttcatcccttccactggacactgtgctttctgatctttatatttggtttactctctcagtatcagaacagtgcattatcgagaagttccataattctctcccgaaggatttatcgggtctcaacgtcctcaccatcaattacaaagcccttccggttgcatcttccatgcccaatctcaacttacacagtttgagagaactacagctatgcatgttcaaaatggaagctgctaacatagctgacatctatgtgttcctcaagacctgccaatgtccgaatttggagaggctctttgtgcagttcccctcatttgtttatggtaagcccatggaaggttctactgatgaggtaacagaagaaccaccggaggatggcttagacaaccttttgatggtaaagttcaggaacttcaactggctccgcgctgaggtgcagctagtgagttttttgttgaggaaagctaattccctggataaactgttaatagtctctccccgtgtcactccgctggatttgcctgatgtacaagaagccaaccttttacttgtcaaagaagctttggccaatggcaagataatgctgagtaagtctgacgatgctgcaactcaaccataccattctgagcgccctagttgatgactagtcgagtcagagccctacgcttagtaatatcaacatatcagaccattattatgaagaaatatgtatgctccttaattcattttcttgaatgttactgataacgaagtatttaaatggtattttcatacatgcttactttcctgtcctcataccacttgcgtcatgtatttgaaacattatccatataagtcgaagcagcttcatat

SEQ ID NO: 11302 - protein, 483 aa, Panicum virgatum
  misc_feature: Ceres CLONE 1727568
  misc_feature (35)..(82): Pfam Name: F-box Pfam Description: F-box domain
MEIDSGGGGGGAKRQRVDKQGDRCEAVDAGAVPVDRISVLPDELQLRILTHLSLKYAIRTGAVARGWRDLWKRRWEHRAVVEVYVGFRHDVRRELDALEREPRPRRRLDRFSFVVDICKLKSSELRRFTEYAAECRVEDLHVETRNRTLERKLNFHLPLCSPLLARLSLRRIGISTMYYKGAQPFRALVVIRLHSISIGHASFTKMMALCPNLITLDLLHCECGNFFYSVAMPQNLRNLTVAYCNGIASVNFELGPSLRSFRYSGDFGKAPFSSLPLDTVLSDLYIWFTLSVSEQCIIEKFHNSLPKDLSGLNVLTINYKALPVASSMPNLNLHSLRELQLCMFKMEAANIADIYVFLKTCQCPNLERLFVQFPSFVYGKPMEGSTDEVTEEPPEDGLDNLLMVKFRNFNWLRAEVQLVSFLLRKANSLDKLLIVSPRVTPLDLPDVQEANLLLVKEALANGKIMLSKSDDAATQPYHSERPS

SEQ ID NO: 11303 - DNA, 729 bp, Panicum virgatum
  misc_feature: Ceres CLONE 1727573
  misc_feature: Encodes the peptide sequence at SEQ ID NO. 11304
aaggaggagcagattccttcctcccttccccccccccccccctacccctcctcgtcgaaaccctagccccgcctcgccgccggaggtggtggccgcctgtccaacgcccagccctagttgttcgctgctccctcccggagccgtcgcgaccgccgccggatccggatcggccggccgccatgtccaaggccagggtctacaccgacgtcaacgtgctgcgccccaaggagtactgggactacgaggcgctcaccgtccaatggggtgagcaggatgactatgaagttgtcaggaaagttggtagaggaaagtacagcgaagtctttgagggcatcaatgttaacaacaataagaaatgcatcatcaagatcctgaagcctgtgaagaaaaagaagatcaaaagagaaattaaaatccttcagaatctttgtggaggccctaatattgtgaagctgcttgatattgttagggatcagcactcaaaaacacccagcctgatctttgaatatgtcaacaacacagatttcaaagtgctgtacccaacattgacagattatgacattcgctattacatctacgagttactcaaggcattagattactgccattcacaaggtattatgcaccgagatgtgaagcctcacaatgttatgatagatcatgagcttcgtaaactccggctgatagattggggccttgctgaattctatcattcccggcaaggaatat

SEQ ID NO: 11304 - protein, 183 aa, Panicum virgatum
  misc_feature: Ceres CLONE 1727573
  misc_feature (34)..(183): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 1 in US patent 7038110
  misc_feature: Useful for making plants with modulated flowering time
MSKARVYTDVNVLRPKEYWDYEALTVQWGEQDDYEVVRKVGRGKYSEVFEGINVNNNKKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHSRQGI

SEQ ID NO: 11305 - DNA, 659 bp, Panicum virgatum
  misc_feature: Ceres CLONE 1727573-R
  misc_feature: Encodes the peptide sequence at SEQ ID NO. 11306
ggagtcttggctgcatgtttgctggaatgatatttcgtaaggaaccatttttctatggccatgacaaccatgatcagcttgttaagattgctaaggtacttggaacagatgggctgaatgcttatttgaacaagtacagaattgagcttgaccctcagcttgaagccctcgttggaaggcatagcaggaaaccctggtcgaagtttattaatgcggataaccaacacctagtatctcctgaggccatagatttcctcgacaagcttctgcgttatgatcaccaggacaggcttactgcacgtgaagcaatggtgcacccatacttccaacaagtgagagccgcagaaaatagcaggacacgcgcataacaggcaagggcagagatacgctaacagatcatcagctgcaatccatcgatcttcaagtcatataatagcggttgggtcattgacagaaacaaaagattgcgagggagcctctgttgtagcctgtctttaaccgcattttgagaaggaacgcaaatttattctggttgtgagcttgagatgtgattgcgaacattattcatgtaaggtgtttgccataaaaggttatctgttcgcagattgtaatactgtattgttgatcttgtaaagaataccaaccttttgtttggactc

SEQ ID NO: 11306 - protein, 121 aa, Panicum virgatum
  misc_feature: Ceres CLONE 1727573-R
  misc_feature: SWISSPROT Homolog: EC 2.7.11.1 Non-specific serine/threonine protein kinase
  misc_feature: The sequence is a functional homolog of SEQ ID NO 1 in US patent 7038110
SLGCMFAGMIFRKEPFFYGHDNHDQLVKIAKVLGTDGLNAYLNKYRIELDPQLEALVGRHSRKPWSKFINADNQHLVSPEAIDFLDKLLRYDHQDRLTAREAMVHPYFQQVRAAENSRTRA

SEQ ID NO: 11307 - DNA, 1692 bp, Panicum virgatum
  misc_feature: Ceres CLONE 1727582
  misc_feature: Encodes the peptide sequence at SEQ ID NO. 11308
atcctctgcacaatcgcgtcacctccgagcacgcgcaccctcccaccgccagccgcgtgcgcctccggcggccaccgccaccgacccacccgcctcccccgccggccggccgcgatgtcgccccgcggcggccagtcctacgggttcccgatctactgcgcggcctggctgcccctcgcccacatcctcaaacccgacccgcccgccgccgacgcgggcgcggacgcggacgcctcctcggcagcctccccctcctctccgccggccccgatggccgcgctcggcggcggcggcggggagggccggagcggcgtgcccaacaagctcgtcgtggccgcgctggacccggcgggggaagaggcggccctctcccccgaggcggtggttgaggtgaagaccaaggaggaggtgccgtacaggatggccgtccaccctcgcggcgacggcgtgctctgcgccttccccaacggatgcaggttgtatcgatgggaatcacaggaaggagatgaaccacataagctagctttggagcctgaccatgaagcattaacagatctaaaagatgtcggtttgcaattggctgtatcattcagtggagaaggttcaatactagccaccggtggtgaggatggacatttaagggttttcacatggcctgccatggagtccgttctcacagaagctgatactaaaacatcaattaaggatcttagtttcagttcagatgagaagtttcttgctgtgaataggagcagtggcccatgtagagtgtgggatttgctgtcatctgaagttgtagctaatttgccaagagaatcaggagaaatatttggattctgcagattctctaataagattgacagcagtaacatcttatttataacagcaatgcaaggtgattatgggaaaataatatcttggaatactacctcatggacaagagttggatcaaagaaaataactcgtgaggctatttcagctttcgctgtgtcgcctgatggtgctcttcttgcaattggaacaattgaaggaaccattattgtagtagggtcaaaaggtatgcgaacactcataacagttaaaaaggcacatcttggcattgtaactacgctcgccttctcccaggattccagaacattgctgtcaacttcctttgactcaactgcaagggtgacatcagttgggtccccaaagagtaatggtacaggtgtatggcccatgctactagttatcattctagcaattttggtatactactgtatgcagcacaaggaagagcttttggcaatgttgcccgcgttgagatagatttttgttcaggaacactactgatatcacatttacctgcctttgtgattacctgatcgtctgcttgagatataagcggtattctttagagattgagcaaatttggtctcaggccaactgcgattattcttcgggaacagcaaaaggtgtttacgcctttaccatgccatgcttgtataaaaaggggcatgtactcatgttgtcgaagttttgtaagttgatggccgcgagttatagtcatctgtagctatgtttaatcttgcttcacttgcgagttatggggagattgtcccaagagtccaatatagagttcgaaaacagtttactttgtatgctcaaacaatttattacacttattaaagctgtatgaaaaatgttcttatc

SEQ ID NO: 11308 - protein, 397 aa, Panicum virgatum
  misc_feature: Ceres CLONE 1727582
  misc_feature (317)..(355): Pfam Name: WD40 Pfam Description: WD domain, G-beta repeat
MSPRGGQSYGFPIYCAAWLPLAHILKPDPPAADAGADADASSAASPSSPPAPMAALGGGGGEGRSGVPNKLVVAALDPAGEEAALSPEAVVEVKTKEEVPYRMAVHPRGDGVLCAFPNGCRLYRWESQEGDEPHKLALEPDHEALTDLKDVGLQLAVSFSGEGSILATGGEDGHLRVFTWPAMESVLTEADTKTSIKDLSFSSDEKFLAVNRSSGPCRVWDLLSSEVVANLPRESGEIFGFCRFSNKIDSSNILFITAMQGDYGKIISWNTTSWTRVGSKKITREAISAFAVSPDGALLAIGTIEGTIIVVGSKGMRTLITVKKAHLGIVTTLAFSQDSRTLLSTSFDSTARVTSVGSPKSNGTGVWPMLLVIILAILVYYCMQHKEELLAMLPALR

SEQ ID NO: 11309 - DNA, 2084 bp, Panicum virgatum
  misc_feature: Ceres CLONE 1727596
  misc_feature: Encodes the peptide sequence at SEQ ID NO. 11310
atcccgcgccaccggttcccgccatgccgccaccaccgccgcagcggccggctccctcccgcgccggccgcgtgaacctcttctccgccccgccgtctcccctctccaatcgccgctacccgcagcaccggtccctccccctcccgtcactcccccctcgtcgccgccaccccaggaaccccgccgagcagcgttcccaagaacaacaggaaccagcagacggcggtccgagagagaccaccagcaacgacagctccgccttccgcacggcccacctccgcaccgcgtaccgcaagcccgtgcccccggtcgcggccgccggcgatggcgaggccctcctcgccgccgacccggccgacgccgcctcgggccgcgccgtcgtcgtggggccctcgggcctctccttccgcctccccggcgcgccgttcgacttccagttcagctactccgaggcgccccgcgcgccgccgctcgccatccgggagcccgcgttcctgcccttcgcgccgccgaccatgccgcggccctggacgggcaaggcgccgctgctcaccaaggaggagaaggcgcgccgccggggcgtgcggctgcacacgccactcgggcaggagccgccgcagaccgtgagcccgcacgggatcatgatggaggtcagggggaggaggcagagggacctggccagggtgagccccggcgacggcaggaccagggacgaggtgctcggcgagccgctcactcccgccgaggtgcgcgagctcgtcaagcctcacatctcgcacaaccgacagctcaatattggaagagatggcttgactcacaatatgttggaaatgatacattgtcattggaggcggcaggaaatctgtaaagttagatgccgaggcgttccaactgttgatatgaacaatctctgttatcatcttgaggagaagtcaggtggaaaggttattcacagagtaggtgacgttgtttttctatatcgaggaagacattatgacccacggactcgtcctcgctatcccctaatgctctggaaacctgctactcctgtatatccaaaactcatcaaggaagtcccagaagggcttacaaaagaagaagcagatgaagtgagaagaaaagggcgcgatctgccgccaatttgtaaattagcaaagaatggaatatatatcactcttgtcaaggatgtgcgagatgcctttgaaggacatgacctggtgaagattgattgtgagggtttgaatccaagtgactacaaaaagataggggcaaaactaagggatcttgttccttgtgttcttttatcatttgataatgaacagatattaatgtacagaggcaaagaatggaaatcaagatactcgaagcctctgactctcattccaaaagttccaaagaattatctgacagtgtcatctgatgtgagtggttcagatgccgatgaagccaccgatgtgagcgctcaagtcacggtaagagaagcagtaaggcccaaaatgtttaaattgtggaagagtgcagtggactcgtctctggcattgctgctggatgatgctgaagcaaacgatctcacacccgattcactcctgacgagggttgaggagttcagcatcacatctcaggcagtggagcactcatttccagctctggttgtgaccaatcacgaggtggacaccgaatgtctaagtgccgagtacatgaacgatgagtctgaaacgagcattgctgccggaaaccaagaggaccatcttgatcaatcacctgatctcagcaacgacgaacactttgaacttgacatgctcgagtgcctggagtcatcgtcgccattaggatcgctgccgatcgacactatgatagagcagctgaacagtgagtgaactaaaacagtagttcataactgctgattatctgattgcattcttggattgtgtatccattctatgctccgaccgcatcctggcggtcgcaattgctgagaatcttcagggatccgccatttgcaaacatgatgtaaagaaactaactgcagtatgtgaatccacttgtgcaccatttgtaaagaagtggcctgcacctagctccgt

SEQ ID NO: 11310 - protein, 617 aa, Panicum virgatum
  misc_feature: Ceres CLONE 1727596
  misc_feature (237)..(320): Pfam Name: CRS1_YhbY Pfam Description: CRS1 / YhbY domain
  misc_feature (355)..(438): Pfam Name: CRS1_YhbY Pfam Description: CRS1 / YhbY domain
MPPPPPQRPAPSRAGRVNLFSAPPSPLSNRRYPQHRSLPLPSLPPRRRHPRNPAEQRSQEQQEPADGGPRETTSNDSSAFRTAHLRTAYRKPVPPVAAAGDGEALLAADPADAASGRAVVVGPSGLSFRLPGAPFDFQFSYSEAPRAPPLAIREPAFLPFAPPTMPRPWTGKAPLLTKEEKARRRGVRLHTPLGQEPPQTVSPHGIMMEVRGRRQRDLARVSPGDGRTRDEVLGEPLTPAEVRELVKPHISHNRQLNIGRDGLTHNMLEMIHCHWRRQEICKVRCRGVPTVDMNNLCYHLEEKSGGKVIHRVGDVVFLYRGRHYDPRTRPRYPLMLWKPATPVYPKLIKEVPEGLTKEEADEVRRKGRDLPPICKLAKNGIYITLVKDVRDAFEGHDLVKIDCEGLNPSDYKKIGAKLRDLVPCVLLSFDNEQILMYRGKEWKSRYSKPLTLIPKVPKNYLTVSSDVSGSDADEATDVSAQVTVREAVRPKMFKLWKSAVDSSLALLLDDAEANDLTPDSLLTRVEEFSITSQAVEHSFPALVVTNHEVDTECLSAEYMNDESETSIAAGNQEDHLDQSPDLSNDEHFELDMLECLESSSPLGSLPIDTMIEQLNSE

SEQ ID NO: 11311 - DNA, 704 bp, Panicum virgatum
  misc_feature: Ceres CLONE 1727598
  misc_feature: Encodes the peptide sequence at SEQ ID NO. 11312
cgatccctgcggctttctttccttttcctacccagcctgcggcgcccaggcaagcaagcagcagcgtccgtccatggccggcggggacgacgacgcgcacggcgggtccgggggccggctggagagcatcctggcggacgcgtcggcgccgcgggcgcggcgcgcgtgggcggcgggcgccatcgagctgcgcctgctgacgcgcctggcggcgccggcggtggtcatgtacatgatcaactacctcatgtccatgtccacgcagatcttcgccggccacctcggcaacctcgagctcgctgccgcctcgctcggcaacaccggcatccagatcttcgcctacggcctcatgctgggcatgggcagcgcggtggaaacgctctgcggccaggcctacggcgcccagaagtacgagatgctcggcatctacctgcagcgctccgccgtgctcctgtgcgccaccggcgtgcccctggccgtgatctacgccttctccgagccgctcctggtgctcctggggcagtcgccggcgatcgcccgcgccgccgccgtcttcgtctacggcctggtcccgcagatcttcgcctacgccatcaacttccccatccagaagttcatgcaggcgcagagcatcgtgctcccgagcgcctacatctccaccgccacgctcgcgctgcacgtgctcctgagctgggccgtcgtct

SEQ ID NO: 11312 - protein, 210 aa, Panicum virgatum
  misc_feature: Ceres CLONE 1727598
  misc_feature (48)..(208): Pfam Name: MatE Pfam Description: MatE
MAGGDDDAHGGSGGRLESILADASAPRARRAWAAGAIELRLLTRLAAPAVVMYMINYLMSMSTQIFAGHLGNLELAAASLGNTGIQIFAYGLMLGMGSAVETLCGQAYGAQKYEMLGIYLQRSAVLLCATGVPLAVIYAFSEPLLVLLGQSPAIARAAAVFVYGLVPQIFAYAINFPIQKFMQAQSIVLPSAYISTATLALHVLLSWAVV

SEQ ID NO: 11313 - DNA, 731 bp, Panicum virgatum
  misc_feature: Ceres CLONE 1727598-R
gtgaggggtgagcaatgagcttggtgccggcaacccaaagtctgcgtatttctccgtgtgggtcgtgactgcgctctctgcgctaatcagcatcatcattagcattgtgatcctctgcttgcgcaactacatcagctacttgttcacggagggtgaggtggtctcaaatgcagtggcagatctctgcccgctgcttgccgtcacgctcatcctcaatggcatccaacccgttctgtcaggtgtcgctgttggatgtggatggcaacagttcgtggcctacgtgaacatcggctgttactacattgttggcgtgccccttggcgcccttctcgggttcgtcttcaagctcggcgtaaagggtatttggggtggtatgattggaggaacttgcatgcagacggccattttgctgtgggtcaccttgagaacagattggaacaaagaggtagaagaagcacagaaaaggctgaacagatgggaggataagaagacggagcccctgcttgcgggagtccgcaatggcaattaactgaaaccgtgaggatcaatcggttatttcgacatccatccatcaccgtgcaagtacaagcctttctccggagtgcttagattctctctcttttcttacagtatcagtggtaccaagccgctgagaaattacatgcaccgataaatgttactcgcatgtcgcaaatttttagtgaaatgaaaaggaagattttagaaaacag

SEQ ID NO: 11314 - DNA, 2983 bp, Panicum virgatum
  misc_feature: Ceres CLONE 1727599
  misc_feature: Encodes the peptide sequence at SEQ ID NO. 11315
agtcccctgcgccccttccccgccgtccctctccctgcgccgcctctgctcgggctccggcgtggcggcgtgcctcacccctgccctggagtacgccgccgcccaggaaccgcgccggcccctctgccgcccaggaaccgcgccggccctcttcccaagtgccggcggcggctagatctggcgggggctgtaggtcgaggaatacccgctgctgcctcactcgtttttggtacacggactgacggactaggttgtttttttttgttgttgtaacagaacaagtcccccaaaattccaaaaccccacgtctcatcgcgccgccgccagtgccgctaccgccgagaaatccgcggcgatggccatggcccggcgttcaggctcccatctcctctcctccttccgccctttctccctcctcctccagccgcccctcgctgatgccccttcgccggcggcctcggccgcggtggcctcagctcggcgggctctgtcgtcggcgtcggccctgcgggcgcgggacgagaaggacgcggcgcggtggcgggagtcgatggaccggatgcggaacatcggcatctccgcgcacatcgactccgggaagacgacgctgacagagcgggtcctctactacaccggccggatccacgagattcacgaggttcgcgggcgcgacggtgttggcgccaagatggattccatggacctcgagcgcgaaaagggaatcaccatccagtccgctgccacctactgcacctggaaggggtaccaggttaatattattgatactccaggtcatgtggatttcaccattgaggttgaaagggcactccgtgttcttgatggtgctatacttgtgctatgtagtgttggtggcgtacaaagtcagtcgatcactgttgatcggcaaatgagaagatatgaaattccaagggttgcgttcattaacaagttggaccgtatgggagctgatccatggaaggttcttaaccaggcacgttccaagctccggcaccacaatgcagctgtacaagtacccataggattagaagaggagttcgagggtcttgttgatcttgtagaaatgaaggcttataagttcgagggttctagtggccagaatgtcactgcatatgatgtcccatcgaacatggcagatttagtcaatgagaagcgacgtgaacttattgaagttgtttccgaagtagacgatcaacttgctgaagcttttctcaacgatgagccaataacagctaatcagcttaaggcggctattcgaagagcaacagtggcacggaagttcataccagtctacatgggaagtgcattcaaaaataagggtgttcaaccacttcttgatggtgtgctggactatctaccatgcccattggaggttgacaactacgcccttgatcaaaacaattcgaaagagaaggtattattggctgggactccagctgagccacttgtggcattagcatttaagctagaagaaggccgttttggtcagctgacatatctaagaatctatgatggtgtgattcggaagggtgacttcatatacaatgtcaatacagggaagaaaatcaaagttcctcgcttggtaaggatgcactccaatgagatggaggatattcaagaagcacatgctggccaaattgttgctgtttttggtgttgattgtgcatcaggcgatacatttactgatggaacagtgaaatatactatgacttcaatgaatgtccctgaacctgtgatgtctttggcagtttcgcctatatctaaagattctggaggacaattttcaaaagctcttaatcgcttccaaaaggaggatcctactttccgtgtcggtttggatccggagagtggacagacaattatttcagggatgggtgagctgcatttggatatatatgttgaacgtattaagagagagtacaaggtggatgcgaaggtaggaaaacctcgtgttaacttcagggaaactatcactcagcgcgctgaatttgattacttgcacaaaaagcaatctggtggtcaaggtcaatatggacgagtttgtgggtacgttgaacctcttccatcaggttctggtggtaaatttgaatttgacaacatgattatcggacaagcaattccttcaaactttataccagcaatagagaagggttttagggaagcttgtaattcgggttcattgattgggcatcctgttgaaaatatcagaattgtactgactgatggggcttcacatcaagtggattccagtgaacttgcttttaagctagctgctatctatgcttttagacagtgttacactgctgccaaacctgtaatattagaacctgtgatgaaggttgaactgaaatttccgaccgagttccagggaacagtaactggcgacatgaacaagagaaaagggatcatagttggaaatgagcaggaaggtgacgacacaattgtagtttgccatgttcctctaaacaatatgtttggatacgcaacagcgattcgatcagtgactcaggggaaaggagaatttacaatggagtatctagagcacaatattgtctcgcaagatgtacagatgcaattagtgaattcatacaaggcggccaagggcacagagtgactcttctggattacagaggaacaaattttgtttacagtttatatgttaatttgcaatgattcatactaaatggtttgaagcaaatatacaagcatgcttagggatggcaatgggtacccgaaatccgaaacccgacggatttttgctccattagggtacgggtttgggtcaacttttagacccgtgagtttgttaatgggcacaaagtcctacccgttgggtttatgggcatgggtttgttcctataatacccaaattcgtgaacccatgggttttttaaacccgatccaacatagagcaattgtcattttattttgtgagattataacaaatttaacatctctttcctac

SEQ ID NO: 11315 - protein, 758 aa, Panicum virgatum
  misc_feature: Ceres CLONE 1727599
  misc_feature (67)..(342): Pfam Name: GTP_EFTU Pfam Description: Elongation factor Tu GTP binding domain
  misc_feature (537)..(658): Pfam Name: EFG_IV Pfam Description: Elongation factor G, domain IV
  misc_feature (660)..(747): Pfam Name: EFG_C Pfam Description: Elongation factor G C-terminus
  misc_feature (383)..(449): Pfam Name: GTP_EFTU_D2 Pfam Description: Elongation factor Tu domain 2
  misc_feature: SWISSPROT Homolog: EC 2.7.7.4 Sulfate adenylyltransferase
MAMARRSGSHLLSSFRPFSLLLQPPLADAPSPAASAAVASARRALSSASALRARDEKDAARWRESMDRMRNIGISAHIDSGKTTLTERVLYYTGRIHEIHEVRGRDGVGAKMDSMDLEREKGITIQSAATYCTWKGYQVNIIDTPGHVDFTIEVERALRVLDGAILVLCSVGGVQSQSITVDRQMRRYEIPRVAFINKLDRMGADPWKVLNQARSKLRHHNAAVQVPIGLEEEFEGLVDLVEMKAYKFEGSSGQNVTAYDVPSNMADLVNEKRRELIEVVSEVDDQLAEAFLNDEPITANQLKAAIRRATVARKFIPVYMGSAFKNKGVQPLLDGVLDYLPCPLEVDNYALDQNNSKEKVLLAGTPAEPLVALAFKLEEGRFGQLTYLRIYDGVIRKGDFIYNVNTGKKIKVPRLVRMHSNEMEDIQEAHAGQIVAVFGVDCASGDTFTDGTVKYTMTSMNVPEPVMSLAVSPISKDSGGQFSKALNRFQKEDPTFRVGLDPESGQTIISGMGELHLDIYVERIKREYKVDAKVGKPRVNFRETITQRAEFDYLHKKQSGGQGQYGRVCGYVEPLPSGSGGKFEFDNMIIGQAIPSNFIPAIEKGFREACNSGSLIGHPVENIRIVLTDGASHQVDSSELAFKLAAIYAFRQCYTAAKPVILEPVMKVELKFPTEFQGTVTGDMNKRKGIIVGNEQEGDDTIVVCHVPLNNMFGYATAIRSVTQGKGEFTMEYLEHNIVSQDVQMQLVNSYKAAKGTE

SEQ ID NO: 11316 - DNA, 2114 bp, Panicum virgatum
  misc_feature: Ceres CLONE 1727604
  misc_feature: Encodes the peptide sequence at SEQ ID NO. 11317
atcccgctacggttctcttgttcttgttcgtctcgtctccccccttctccagtctccacacaacccgctcgctctcccgcacccgcatcgcgattcccttgtccaaggttggatagggttagggtttggcctccgtctgccccgtcgatggctgctgcggcggccgcgcgtcagaggtgaggcgaggtgggcgcgtggttgattggttcgaggaggaggaggaagcagagggatggacccggacttctcgcgggcgagcggggggccgagcttcgagttcgccttcaactcggtcaacttttccgaccgggtgctgcggatcgagattgtcgccggggacgacgcccccggggccaagggcgccgccggcgagggctgctcatcgctcgccgactgggcgcgccaccgcaagcggcgacgggaggagctccgacgcggcaaagaatcaggagtaaactgcaaagttgaagctgaagaatgcgatacctatgaggaaggcaatgaggagcctgtagctatgatagaagaatctccacctgatattgagcaagatggtgaggatggagaaagcagtgattcatcctggagtatggaatgtactcagattttgaaagtgaagtctatctatatcagctctgcaattttagctgcaaagagccctttcttttacaagcttttctcaaatggaatgaaagaatctgatcagaggcatgcaactcttagaataactgcttcagaggaaaatgcccttatggagcttctaagctttatgtatagtggcaagttgacaacaaatcagccaactctcctgctggatatattgatgattgctgacaaatttgaggtcgtttcatgtatgaggcactgcagtcaattgcttagaagcttgcctatgaccacagagtctgcattgctttatcttgatctcccctccagcatttcgatggctactgcagttcagccattgactgacactgctaaggaattccttgccaataaatacaaagatttgaccaagttccaagatgaagcaatgaccattcctctcgctggaattgaagccatactttggagtaatgaccttcaggtagcatcagaggatgctatctacgattttgtgatcaagtgggcacgtgctcaatacccaaaattggaggaaagacgtgagatcttgggcactcgtttgctgccccttgtccggttctgccatatgacctgcaggaagttgcggaaggttcttgcatgcagtgatctgaatcacgagcaggcaactaaatgcgtcacagaggcacttctttacaaagctgatgcaccacatcggcagcgtgcccttgcagcagatgtgacgacctgtaggaaatatgctgagcgagcttacaaatatcgtccgcttaaggttgtgaagtttgatcgaccatatccgcagtgcatagcatacttggacctgaagcgtgaggagtgcagccgacttttcccatctgggcggatatactcgcaagcatttcatctagctggacagggcttcttcctatcagcacactgtaacatggatcagcaaagcgcgttccattgttttggtctcttcctggggatgcaagagaaaggctcaacaagtgttactgttgattatgagtttgctgcaaggacaaggccatcaggtgagtttgtcagcaagtataagggctactacaccttcactggtgggaaggcggttggctatcggaatctctttgcgattccttggccttcgtttatggctgatgacagcctcttcttcattgacggggtactacatctgagagctgagttgaccataaagcaaccttagactgccgatggtgtgttactaactgcatctgtgctgtcgtgactaaactgtgcaatgatgggctgcagtgtgtaaaatcttgtgtgattcagacatgatgttttttactcacaactaaatagacaatttggaaacgagaactctaaattccttttgtgtttacaataaaagtggagcatgtcatgttctgcactggcattgaaccaaggaatgtaattccgctgatcaaaaatgtgtattgaatgggctacattggctaagtactcgagaaaagaaacttttgctc

SEQ ID NO: 11317 - protein, 531 aa, Panicum virgatum
  misc_feature: Ceres CLONE 1727604
  misc_feature (119)..(220): Pfam Name: BTB Pfam Description: BTB/POZ domain
  misc_feature (229)..(337): Pfam Name: BACK Pfam Description: BTB And C-terminal Kelch
MDPDFSRASGGPSFEFAFNSVNFSDRVLRIEIVAGDDAPGAKGAAGEGCSSLADWARHRKRRREELRRGKESGVNCKVEAEECDTYEEGNEEPVAMIEESPPDIEQDGEDGESSDSSWSMECTQILKVKSIYISSAILAAKSPFFYKLFSNGMKESDQRHATLRITASEENALMELLSFMYSGKLTTNQPTLLLDILMIADKFEVVSCMRHCSQLLRSLPMTTESALLYLDLPSSISMATAVQPLTDTAKEFLANKYKDLTKFQDEAMTIPLAGIEAILWSNDLQVASEDAIYDFVIKWARAQYPKLEERREILGTRLLPLVRFCHMTCRKLRKVLACSDLNHEQATKCVTEALLYKADAPHRQRALAADVTTCRKYAERAYKYRPLKVVKFDRPYPQCIAYLDLKREECSRLFPSGRIYSQAFHLAGQGFFLSAHCNMDQQSAFHCFGLFLGMQEKGSTSVTVDYEFAARTRPSGEFVSKYKGYYTFTGGKAVGYRNLFAIPWPSFMADDSLFFIDGVLHLRAELTIKQP

SEQ ID NO: 11318 - DNA, 2227 bp, Panicum virgatum
  misc_feature: Ceres CLONE 1727608
  misc_feature: Encodes the peptide sequence at SEQ ID NO. 11319
aatcctgctaggccactctgtggcggcggaaccttcgagacctcttgagaattggggatccaacgccgctgagctcctcccagttttataaaatctcaactgggcttcccctgcccttaatccccatcaaaccccacagacttttccgcgagcgccctcctgacctccggccttcccagccgccaagccttcgagaaccctccggagctcgctcgatccgatcgcaccccgcgcgggctgccgccatggccgacgaggcgaaggccaagggtaatgcggcgttctccgccggccgctacgaggaggcggcgcggcacttctcggacgccatcgcgctcgccccgggcaaccacgtcctctactccaaccgctccgccgcgctcgcctcgctctaccgctactccgacgctctcgccgacgcgcagaagaccgtcgagctcaagcccgactgggccaagggctactcgcggctcggcgccgcgcacctcggcctcggcgacgccgccagcgccgtcgccgcctacgagaaggggctcgcgctcgaccccaccaacgagggcctcaaggcggggctcgaggacgccaagaaggccgccgccgccccgccgcgccgcgggccgtccgggcccgacgccatcggccagatgttccagggccccgagctgtggaccaagatcgcggccgaccccaccacacgcgcctaccttgaccagcccgactttatgcagatgctgcgcgaggtgcagaggaacccaagcagcctcaacatgtacctctccgatccccgcataatgcaggtgctcagcctcatgcttaacatcaagatccagagacccgaggcctccgagccgtcgccgtctaccccgccgccgccgccgccgcagcagcagcagcagcagcagcagcagcagcaggcgcctcctcatgagacgaaggcgagggaggttgagccggagccagagccagagcctatggatttgactgacgaggaaaaggaacggaaggagaggaaagcagctgctcagaaggagaaggaagcaggtaacgcagcttacaagaagaaggactttgagaccgcaattcagcactacactaaagccttggagcttgacgatgaggatatttcctatctgactaaccgagcagcagtctacattgagatgggaaagtacgatgaatgcattaaggactgtgataaggctgtggagagggggagagaacttcgtgctgatttcaagatgatctcaagggcactgacaaggaaaggaactgctctagtcaaacttgctaagtgctctaaggattttgatatcgccattgagacctttcagaaggctctaactgagcaccggaatccagacactcttaaaaagttaaatgaggctgagaaggcaaagaaagagttggagcaacaagaatactatgatccaaagttagctgatgaggaaagagagaaaggtaacgagttcttcaagcagcaaaaatacccagaagcaataaaacattacacggaggctcttaggagaaacccgaaggatcctagggtatacagcaatagagctgcatgctacaccaagttaggagccatgcctgaaggtcttaaagacgcagagaagtgtcttgagctagatcccaccttcacaaaagggtacacacggaaaggtgcaattcaattcttcatgaaagaatatgacaaggccatggaaacctatcaggctggcctaaagcatgatcctaataaccaggaactgcttgatggtgttaggaggtgcattgaacagatcaacaaggccaacagaggagaaataagccaggacgaattgcaagaaagacagaataaagctatgcaagacccagaaatccagaacatccttacagatcctatcatgcgacaggtgctaattgatttccaggagaaccccagggccgctcaggagcacctgaaaaaccctggagttatgcagaagattcagaaactcgtaagcgctggaatagtccagatgagataatgatgcgattgtacccacctgtttgtgtcttgtgctgggcttgttaattcacatgcccccgttcgtatcttccaaaaatgtagccgtggcaaaggttcatcaacttattgggggttagtgtcgtccttttcccattggagtgtaagggcagttgacattggattattcatgcttgtggtactgagttataggcgacgtcgttttctattgatcatccc

SEQ ID NO: 11319 - protein, 587 aa, Panicum virgatum
  misc_feature: Ceres CLONE 1727608
  misc_feature (2)..(35): Pfam Name: TPR_1 Pfam Description: Tetratricopeptide repeat
  misc_feature (70)..(103): Pfam Name: TPR_1 Pfam Description: Tetratricopeptide repeat
  misc_feature (259)..(292): Pfam Name: TPR_1 Pfam Description: Tetratricopeptide repeat
  misc_feature (293)..(326): Pfam Name: TPR_1 Pfam Description: Tetratricopeptide repeat
  misc_feature (398)..(431): Pfam Name: TPR_1 Pfam Description: Tetratricopeptide repeat
  misc_feature (432)..(465): Pfam Name: TPR_1 Pfam Description: Tetratricopeptide repeat
  misc_feature (466)..(499): Pfam Name: TPR_1 Pfam Description: Tetratricopeptide repeat
  misc_feature: SWISSPROT Homolog: EC 3.1.3.16 Phosphoprotein phosphatase
MADEAKAKGNAAFSAGRYEEAARHFSDAIALAPGNHVLYSNRSAALASLYRYSDALADAQKTVELKPDWAKGYSRLGAAHLGLGDAASAVAAYEKGLALDPTNEGLKAGLEDAKKAAAAPPRRGPSGPDAIGQMFQGPELWTKIAADPTTRAYLDQPDFMQMLREVQRNPSSLNMYLSDPRIMQVLSLMLNIKIQRPEASEPSPSTPPPPPPQQQQQQQQQQQAPPHETKAREVEPEPEPEPMDLTDEEKERKERKAAAQKEKEAGNAAYKKKDFETAIQHYTKALELDDEDISYLTNRAAVYIEMGKYDECIKDCDKAVERGRELRADFKMISRALTRKGTALVKLAKCSKDFDIAIETFQKALTEHRNPDTLKKLNEAEKAKKELEQQEYYDPKLADEEREKGNEFFKQQKYPEAIKHYTEALRRNPKDPRVYSNRAACYTKLGAMPEGLKDAEKCLELDPTFTKGYTRKGAIQFFMKEYDKAMETYQAGLKHDPNNQELLDGVRRCIEQINKANRGEISQDELQERQNKAMQDPEIQNILTDPIMRQVLIDFQENPRAAQEHLKNPGVMQKIQKLVSAGIVQMR

SEQ ID NO: 11320 - DNA, 2259 bp, Panicum virgatum
  misc_feature: Ceres CLONE 1727624
  misc_feature: Encodes the peptide sequence at SEQ ID NO. 11321
agatccacctcggaaccatctgggcatctggattccggactactcgtacttgactagggggattggcctcacggcgaggtggcggcgggggagatggagagcctggcgcagcgcgcggcgctgctccgggagtcgctgcacaagagccagcaggccacggacgccgtcgtatccatcctcggctccttcgacagccgcctctccgcgctcgactccgccatgcgccccatccaggtcaggacgcacgccgtccggacggcgcacgagaacatcgaccggacgctgcgctccgcggatgtcatcctcacgcagttcgatcgaactcgagaggcggagcgtgaaatacagaaggggccgcatgagaaccttcaaggttttctagatgcagttgatcggttgagaagtattgagcgtttctttagctcaaataggagttaccgcagtagtgatggggtgctcaaccatgtgaattccctcctttctaaggcccttgtgaagatggagggagaattccagaatcaattgtcccagcgcagcaaacctatggagcctgatcgtctttttgattgtcttccaagtacacttcgaccgtcctctgaatcccagcccgaaggtgggaaaaacccatcatccgaaaatcagcaaagcccagaggctgctgtatacagtcctcctgctcttattgagccaaagtttgttccattactctctaaattggcacaacagttggttcaggctggatgccaacagcaatgctcagaaatatacagtgaagctcgcgcttcagctttagaatcaagtttgaagaacttgggtgttgaaaaactgagcaaagatgaagtgcagaaaatgccttgggagattttggaatctaaaataggaaactggattcatttcatgcgaattgctgtcaaactcctttttgctggggagcgccagctttgcgaccaagtatttgaatgcagtcaatctttgagggataagtgctttgctgcaataacaaagaacagtttggctacactactcagttttggagaggcaattgctatgagtaaacgatcaccagagaaactgtttgttctgctagacatgtacgaaataatgtgcgaacttcaaacagagattgacaccatctttgttggagaatcatgttcacaaatgcgtgactctgcactgagtttgacgaaatgcctagcacaaacggcgcagaagactttcagtgactttgaagaagcggttgaaaaggatgcaacaaagaatatacatactgatggaacagttcatcctttaacgagctatgtgatcaactatgttaaatttttatttgactaccagtccactctaaaacagcttttccaagagttcaaaaaggaagatggaacaggttctgagttggcagctgtaaccatgaaaatcatgcaagctttacagaataatttggatgcaaaagcaaagcaatacaaggatcctgctttgatgcacatatttttgatgaacaacattcactacatcgtcaaatctgtccgcagatcagaagccaaggatttgttgggtgatgactggatccaaagacatcggaggattgtacaacagaacgcaaatcaatatagaaggattgcttggtcaaaggtgttgcaatgcctctctggtcaaggtttgacttcatcaggaggtagtggtcaagtagggagtgagggtggcaatagcagtggagcttcaagagcagctgtcaaggagagattcaggtctttcaatgtgttatttgaggagatctatcagaagcaatgtagctggtccgttccagatactgagttgcgagagtcattaagacttgcggttgctgaaattctgttgcctgcgtacagatctttcatcaaacgttttgggccactcattgagaacagcaaagcgcctggaaaatacgtcaagcacacgcccgagcaacttgagctgctgctaggcaatttgttcgaggggaaacaagaacgtgcttgatagtctctagctgcttaccatacctcaacaatgatgcgatgctgctctacgtaaactggagcccctgtcaacattgttcggcgatctatccatgggcgtcaaacagctactatccacaccattccttgatccggtgcttgatttgtatagaatgtatttcagttatgtctggtaggtagtaggcatattttttttaatcctgacattttgatgttcttgcagtgtgcaaagaaaccgctggcaatgcctagtgtcaattggatc

SEQ ID NO: 11321 - protein, 633 aa, Panicum virgatum
  misc_feature: Ceres CLONE 1727624
  misc_feature (38)..(627): Pfam Name: Exo70 Pfam Description: Exo70 exocyst complex subunit
MESLAQRAALLRESLHKSQQATDAVVSILGSFDSRLSALDSAMRPIQVRTHAVRTAHENIDRTLRSADVILTQFDRTREAEREIQKGPHENLQGFLDAVDRLRSIERFFSSNRSYRSSDGVLNHVNSLLSKALVKMEGEFQNQLSQRSKPMEPDRLFDCLPSTLRPSSESQPEGGKNPSSENQQSPEAAVYSPPALIEPKFVPLLSKLAQQLVQAGCQQQCSEIYSEARASALESSLKNLGVEKLSKDEVQKMPWEILESKIGNWIHFMRIAVKLLFAGERQLCDQVFECSQSLRDKCFAAITKNSLATLLSFGEAIAMSKRSPEKLFVLLDMYEIMCELQTEIDTIFVGESCSQMRDSALSLTKCLAQTAQKTFSDFEEAVEKDATKNIHTDGTVHPLTSYVINYVKFLFDYQSTLKQLFQEFKKEDGTGSELAAVTMKIMQALQNNLDAKAKQYKDPALMHIFLMNNIHYIVKSVRRSEAKDLLGDDWIQRHRRIVQQNANQYRRIAWSKVLQCLSGQGLTSSGGSGQVGSEGGNSSGASRAAVKERFRSFNVLFEEIYQKQCSWSVPDTELRESLRLAVAEILLPAYRSFIKRFGPLIENSKAPGKYVKHTPEQLELLLGNLFEGKQERA

SEQ ID NO: 11322 - DNA, 1711 bp, Panicum virgatum
  misc_feature: Ceres CLONE 1727628
  misc_feature: Encodes the peptide sequence at SEQ ID NO. 11323
agctggctccttgctgagagggggagaaggcggaggagatgaagacccggagctccgcgaggggggagcccaggcgcctcgggaatgtggctctcctggccctcatgctctgctccgtcgtcgccctctccctcatccgggggaggttcgccccaatcgtcaacagtgccggagatgccatcaaatccgaagaggaggcggccgcggtgagcaaggcggccgtcaacattgacaccggcgacggcgccgacgaggccgccgcggaagctgctgcggaggagaaagacaaggaggaggcccagcccaagcccaccgccgcggccgccaagccggtgtgctacgagacgagccaccgctccgacacctgcgaggcggccggcgacgtgcgcgtgatggggagcagccagacagtgtacgtcgacacgctggaccgggagtggaagaccaagccgtactgccggaagcacgacaacttcgcgctgtcccacgtcaaggagtggaccctcaagccgctcccctccggcgcggcgccgcggtgcacggtcaacagcacggccaccgccttcgtgctctccaccggcgggttcacgggcaaccccttccacgactacacggacgtgctgatcccggccttcatcacggcgcaccatttgggcggcgaggtgcagttcctggtgagcagctacaagtcgtggtgggtgaaccggtacatccagatcttccagcagatgagccggcacgaggtggtggacatcgacgccgacgacgatgtccggtgctaccgtaacgtggtggtggggccgacgttccaccgggagctcggcgtggacgcgtccaagacgccgtcgggctactccacggccgacttccgcaagatgctgcgcgacgcgttcgggctggagcgcgcgacggccacgccgagcggcgaccagtgggacatccggcgccggccgcggctgctgatcatctcgcggcgcccctcccgcggccgcgcgttcatgaacgagcgcgcgatggccgacatggcggcgagcctcgggttcgacgtgcggatcggggagcccgacacgagcacggacacgtccaagttcgcgcggctggtgaactcgtgcgacgtgatggtgggcgtgcacggcgccgggctgaccaacatggtgttcctgccggccggcgccgtggtggtgcaggtggtgccgtacgggcggctcgagtggctggcccggaacacgttcgcggagccgtcggcggggatggaggtccactacctggagtacgcggtgcagctggacgagacgacgctgagcgagcagtacccgagcgaccacccggcgctgagggatcccatggccatccacaagcaggggtggaacgcgctcaagaccacgtacctggacaagcagaacgtgcggccgcacctggggcgcctcaagaacaccttcctccaggcgctcaagatgctgccgcacggacgggacgattaggaaggaggtgatctagacatcggatattagagggtagatgtatagcttaattaatgataattactacttttttggcttgttttttcttctttatttgttcgtatgagtaagagggcgcgcttcagtagcagccgcaagcaagtagtagtggcagtgcgactgtgaatgggatcgcagggacaaattctagtgtttaactgtttataagttatctttttcttttcttttcc

SEQ ID NO: 11323 - protein, 480 aa, Panicum virgatum
  misc_feature: Ceres CLONE 1727628
  misc_feature: Useful for making plants with altered carbohydrate content
MKTRSSARGEPRRLGNVALLALMLCSVVALSLIRGRFAPIVNSAGDAIKSEEEAAAVSKAAVNIDTGDGADEAAAEAAAEEKDKEEAQPKPTAAAAKPVCYETSHRSDTCEAAGDVRVMGSSQTVYVDTLDREWKTKPYCRKHDNFALSHVKEWTLKPLPSGAAPRCTVNSTATAFVLSTGGFTGNPFHDYTDVLIPAFITAHHLGGEVQFLVSSYKSWWVNRYIQIFQQMSRHEVVDIDADDDVRCYRNVVVGPTFHRELGVDASKTPSGYSTADFRKMLRDAFGLERATATPSGDQWDIRRRPRLLIISRRPSRGRAFMNERAMADMAASLGFDVRIGEPDTSTDTSKFARLVNSCDVMVGVHGAGLTNMVFLPAGAVVVQVVPYGRLEWLARNTFAEPSAGMEVHYLEYAVQLDETTLSEQYPSDHPALRDPMAIHKQGWNALKTTYLDKQNVRPHLGRLKNTFLQALKMLPHGRDD

SEQ ID NO: 11324 - DNA, 1833 bp, Panicum virgatum
  misc_feature: Ceres CLONE 1727630
  misc_feature: Encodes the peptide sequence at SEQ ID NO. 11325
agtggctctgcgactgccgccgcagcgctcctcttgccttcggtgagttgtggtctttccgctccgcccgcgcattccgtcgaacaccgcgccctctagggctctacctcaatctcatcctcatctccgccttcccaatccccatcacgtaaaccctagcccttctccccgccactgccacccctccaccatctgcgcgggagatgcggaagaggtagcctacgccgatggcctgctgcttccttcgcgccgccgcggcgccccgcctcctcctctgccgcaccgccgcctcccagcagctcccgtcgccactcaccgtactcagaaagggtttttcggagcagtcagttctgccaatcagagactcgattgagagttttcaaggaccatcagtgcagaatactccacggattccactgtatgatgacagcatatcctcaggcatattggacacattgtcgaatccgacagagggtgtcactcgtgccgatccttcaaatggcagaataatgctagttgatggaacgtcagtgatgtaccgatcctactacaagatattagcacagctgcagcatggccaattggagcatgctgatggaaatggggattgggttttaactatattcaaagctctatccctgcttcttgacatgctggagttcgttccatctcatgctgcagttgtgtttgaccatgatggagttccatatggtcattatactgccatgccatccaaagaatgtcacatggcaaaagggatgacctttcgtcatatgttgtaccctgcttacaagagtaaccgcaccccaacaccggacacggttgtccagggcatgcaatacttgaaggcatccattaaggcgatgtcaatcaaagtaattgaggttccaggtgttgaagctgatgatgttattggtaccctggctgtaaacagtgtgtcggctggttacaaggtacggattgtctctcctgataaagacttcttccaaattttgtcaccttctttgcgtttgctcaggattgctccgcgtggttcagggatggtttcatttggagttgaagatttcgtcaagagatatgcagcactgaaaccctcgcagtttgttgatgttgtcgcactttctggagacaaagctgacaatatacctggagttgaggggataggagatgttaatgcagtgaagctgataactaagtttggttctttagaaaatctactgaaatctgtggatgaagttgaggatgaacgaattaaacaggctctgatgtctcaaggagaacaggctatcctttgcaaaagcttggccactctgcggtctgatcttcctccttatatggttcctttcaagacagctgaccttgtatttcagaagccgcaggatgatgggaccaaattcataaagctcttacgagctctggaagcatatgcagagggctcctcagcagacccaatcatcagaagagcaacctatctttggaacaagcttaaatcatgataatgctggtatttccagcagtgattataaaggaattttgccaaggttaaggttcggattagaagactggaagcccagacggtgctgttctggttccaaaatattcaatgcctttgacttcatgtggactctgcgctcagccatatccaaattgcaaacatcaaattgttggcataggtgtgccgaagtgcataaatccagggtgccgctgctcaggcaagcagctcaagtgttcataccacgaaactaactttagctagctctgtagataaaattcacaacgttgctcatgtatccaccctttttttttaagaggaaggctcacgcaatcgatctg

SEQ ID NO: 11325 - protein, 422 aa, Panicum virgatum
  misc_feature: Ceres CLONE 1727630
  misc_feature (92)..(284): Pfam Name: 5_3_exonuc_N Pfam Description: 5'-3' exonuclease, N-terminal resolvase-like domain
  misc_feature (287)..(390): Pfam Name: 5_3_exonuc Pfam Description: 5'-3' exonuclease, C-terminal SAM fold
  misc_feature: SWISSPROT Homolog: EC 2.7.7.7 DNA-directed DNA polymerase
MACCFLRAAAAPRLLLCRTAASQQLPSPLTVLRKGFSEQSVLPIRDSIESFQGPSVQNTPRIPLYDDSISSGILDTLSNPTEGVTRADPSNGRIMLVDGTSVMYRSYYKILAQLQHGQLEHADGNGDWVLTIFKALSLLLDMLEFVPSHAAVVFDHDGVPYGHYTAMPSKECHMAKGMTFRHMLYPAYKSNRTPTPDTVVQGMQYLKASIKAMSIKVIEVPGVEADDVIGTLAVNSVSAGYKVRIVSPDKDFFQILSPSLRLLRIAPRGSGMVSFGVEDFVKRYAALKPSQFVDVVALSGDKADNIPGVEGIGDVNAVKLITKFGSLENLLKSVDEVEDERIKQALMSQGEQAILCKSLATLRSDLPPYMVPFKTADLVFQKPQDDGTKFIKLLRALEAYAEGSSADPIIRRATYLWNKLKS

SEQ ID NO: 11326 - DNA, 1823 bp, Panicum virgatum
  misc_feature: Ceres CLONE 1727635
  misc_feature: Encodes the peptide sequence at SEQ ID NO. 11327
cctatagcttgccggatatggggggtggagggatgggggcaccgttggagctagcctcacctcccttcacctgcactccatcgaggggctggctgtcgtcccgatctatctataaaacgagccgagtggggcggaggcggaaccctaagccgagcaacgcagagaaaggcgtcttcgtactcgcctctctccgcgactcgaagctttccccccaacccccggattccccaccgccgccgccgccccacccttccgtcgacaccatgagggagtgcatctcgatccacatcggtcaggccggtatccaggtcggaaacgcgtgctgggagctctactgcctcgagcatggcattcaggctgatggccagatgcctggtgacaagaccattggaggaggtgatgatgctttcaacaccttcttcagtgagactggcgctgggaagcacgtcccccgtgctgtatttgttgaccttgagcccactgtgattgatgaagtgaggactggcacttaccgccagctcttccaccctgagcagctcatcagtggcaatgaggatgctgccaacaacttcgcccgtggtcactacaccattggcaaggagattgttgacctgtgccttgaccgcatcaggaagcttgccgacaactgtactggtctccagggcttccttgtcttcaacgctgttggtggaggaacaggctctggccttggttccctcctccttgagcgcctgtctgttgactatggcaagaagtccaagctcgggttcactgtgtacccatctccccaggtctccacttcagtggttgagccatacaacagtgtcctgtccacccactccctcctggagcacactgatgttgctgtcctgctcgacaatgaggccatctatgacatctgccgtcgctccctcgacattgagcgcccaacctacactaacctcaacaggcttgtgtcccaggtcatctcatctctgactgcctccctgaggttcgatggtgctctcaacgtggatgtgaacgagttccagaccaacctggtgccctacccaaggatccacttcatgctttcgtcctatgcaccagtcatctctgctgagaaggcctatcacgagcagctgtctgttgctgagatcaccaacagcgccttcgagccttcctccatgatggccaagtgcgacccgcgccatggcaagtacatggcctgctgcctcatgtaccgtggtgatgtggtgcccaaggatgtgaacgctgctgtcgcaaccatcaagaccaagcgcaccatccagtttgttgactggtgccctactgggttcaagtgtggcatcaactaccagccacccagtgtggtgcccggcggtgacctcgccaaggtgcagcgcgctgtgtgcatgatctccaactccaccagtgtggttgaggtgttctcccgcattgaccacaagttcgacctcatgtacgccaagcgtgccttcgtgcactggtatgttggtgagggcatggaggagggtgagttctctgaggcccgtgaggaccttgctgcccttgagaaggactacgaggaggttggcgctgagttcgacgagggcgaggaaggcgacgagggtgatgagtactagatgatgatatgcttcctgctgctgtgtcaggcatgtgtgctgcagttatcctgtgatctgcccgaggggctcgtgcttatcctgttatgtgtgtcggtttgaacaatctgcttccgtgtgtcgtttacaacatcttgtgttgtaagacttggtttaatcctgcttcgtttctggattactataaatccttttatgtttcgtgtc

SEQ ID NO: 11327 - protein, 451 aa, Panicum virgatum
  misc_feature: Ceres CLONE 1727635
  misc_feature (49)..(246): Pfam Name: Tubulin Pfam Description: Tubulin/FtsZ family, GTPase domain
  misc_feature (248)..(393): Pfam Name: Tubulin_C Pfam Description: Tubulin/FtsZ family, C-terminal domain
  misc_feature: Useful for making plants with altered cell wall content and/or composition
MRECISIHIGQAGIQVGNACWELYCLEHGIQADGQMPGDKTIGGGDDAFNTFFSETGAGKHVPRAVFVDLEPTVIDEVRTGTYRQLFHPEQLISGNEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDEGEEGDEGDEY

SEQ ID NO: 11328 - DNA, 722 bp, Panicum virgatum
  misc_feature: Ceres CLONE 1727636-R
  misc_feature: Encodes the peptide sequence at SEQ ID NO. 11329
tccctgaccgcatgccccatgtctgggcagaccgccatgctactgagaaccggatgcgcctccatgccctacgggcgattcgagagaggaagatggatggcgtagttgtatttgcagatgacagcaatgttcatagcatggagctttttgatgaggtgcagaaggtccagtggatgggtgctgtatccgttggaatcctagcacatactggagcggcagaccaacgacgcctcagcgtggaggacaagcagaacatgcctcttccagtccagggccctgcttgcaactcctctgggcatctggctggatggcacacgtttaactcattgccgttttctgggaagactgccacagtggttggtgaggcagcccctgttctgcccaggggtttggagtgggctggctttgtgttgaactcgagaatgctgtggaagaaggcagagggcaagcctgactgggtgaaggatcttgatgctgttggtgagaatggagaggagattgagaacccacttactctattgaatgatccgtcctctgttgaaccactggggaactgtgggaagaaggtcctactgtggtggctccgtgtggaagctcgggctgatagcaagtttcctcaggggtgagttcctttttttagtattttcagtatatattttcatcggcgttttttatcatcaagctatgttaattggaaaagctaccgtgttctattagcaacc

SEQ ID NO: 11329 - protein, 207 aa, Panicum virgatum
  misc_feature: Ceres CLONE 1727636-R
  misc_feature (6)..(198): Pfam Name: Glyco_transf_43 Pfam Description: Glycosyltransferase family 43
  misc_feature: SWISSPROT Homolog: EC 2.4.1.135 Galactosylgalactosylxylosylprotein 3-beta-glucuronosyltransferase
PDRMPHVWADRHATENRMRLHALRAIRERKMDGVVVFADDSNVHSMELFDEVQKVQWMGAVSVGILAHTGAADQRRLSVEDKQNMPLPVQGPACNSSGHLAGWHTFNSLPFSGKTATVVGEAAPVLPRGLEWAGFVLNSRMLWKKAEGKPDWVKDLDAVGENGEEIENPLTLLNDPSSVEPLGNCGKKVLLWWLRVEARADSKFPQG

SEQ ID NO: 11330 - DNA, 766 bp, Panicum virgatum
  misc_feature: Ceres CLONE 1727636
gcggtcggtcgattcggttcgagccggccggagctcggaggggcggagcccagatccgggtgccggcggcgatgatgaagtcgctgctgccgcagagccagctgcgtcgctcgtcggcgcggccgtcgggggccgccgccgccgcgggcggagacggggccgcggccgacggcggcggggccggggcgcgggcgcccgcctcgtccaccttctggttcctgctccacgcgctctgctgcctcatctcgctcttcctcggattccgcttctcgcggctcctcttcttcctgctcttctccaccaccgcgctctaccactccaccacctcctcctcctccgccgcggtcctgcgcgccaccacgacgaccacaaccaccacgaccacgacgaccaccaccaccaacaccttcacgctctccttcgccgccgcgaacccaccgccctccaaccccgccaaccgcaccgcgctggaggcggcagcggcggcggacaagggcgcgacctccgggaacccccagagccacgtggtggtggggcggcacgagattcggatccgcccgtggccgcacccggaccccgtcgaggtgatgcgggcgcaccggatcatggagcgcgtgcaggaggagcagcgccgctggtacggcgtcaaggagccgaggcaggtgctcgtcgtcacgccgacctactcccgcgcgttccaggcgctccacctcaccggcctactccactccctccgcaacgtgccgtacccgcttacctggatcgt

SEQ ID NO: 11331 - DNA, 2176 bp, Panicum virgatum
  misc_feature: Ceres CLONE 1727647
  misc_feature: Encodes the peptide sequence at SEQ ID NO. 11332
accaagtgcccatgctctgctcggctgcttcagctcccggtgacgccgccgcgcgattggtcccgccgcgaggctgccgcggctgatcggccaggactctcggatggcaccggcgtccgcgatggagctggaagcgccgccaccggcagcagcggcggcggcggcggccaaggagatcaagtcgccggaggtgctgtcgtcgctgcagcgcaagaagctgggcgcgcacttcctcgagagcgacgagcgccgcttctccggcgccgccaggacgcccctgggcggcgggtacgagccgccgccgccgccggcctccgcggccggcacgacgccggtcaacatccgcggcgagcccatcgcggacctgtcgcgtaccggtgggtgggtggccgccctcttcatcttcggcaacgagatggcggagcgcatggcctacttcggcctctccgtcaacatggtcgtcttcatgttcaaggtcatgcaccgccccttcaccagctccgccaacgccgtcaacaatttcctcggcatctcccaggcctcctccgtgctgggcggcttcctcgccgacgcctacctcggccgctactggaccatcgccatcttcaccaccatgtacctgctcggcctcgtcgcgctcaccgtcagcgccagcgtgccggcgctcgtgccgtcccaggagggctgcgacaagctcgccatgctgctgggcgcctgcgcgcccgccgagccctggcagatggcctacctccacacggcgctctacgtcacggcgttcggcgccgccgggatccggccctgcgtctcttccttcggcgccgaccagttcgacgagcggagccccgggtacaagcgccgtctcgatcgcttcttcaacctcttctacctcgccgtcacgcttggcgccatcgccgccttcacggcggtcgtgtacatccagatgcaccgtggctgggccgcggcgttcggcacgctggcgctcgccatgggcacctccaacgcgctcttcttcgtgggcacgccgctgtaccgccaccgcgtgccggggggcagcccgctgacgcgggtggcgcaggtgctcgtcgccgccttccggaagcggcacgcggccttcgacagcggcggcttcgtcggcctctacgaggtcgccggcgccaagtccgctgtccggggcagcgccaagatcgaccacaccgacgacttcaggtggcttgacaaggcggcgctgcagctggagggcgacctcgccggcggcgaggcggcgcccgacccgtggcggctctgcacggtgacgcaggtggaggaggtgaagatcctgctgcggctgctgccggtgccggcgtgcacggtgatgctcagcgtggtgctcaccgagttcctcaccctgtcggtgcagcaggcctacacgctcaacacccgcgtggcggcgctgcacctcccggtgacgtgcatgccggtgttcccctgcctggccatcttcctcgtcctcgcgctctactaccagaccttcgcgccgctggcgcgccgcctcacgggccacccgcacggcgcctcccagctccagcgcgtcggcctcggcctcgtcttctccatcctctccgtcgcctgggcggggctcttcgagcgctaccgccgcggctacgccgtccggcacggctacctcgccctcttcctctcgccgatgccgggcctcagcgcctactggctgctcatccagtactgcctcatcggcgtcgccgaggtgttctgcctcgtcgcgctcctcgagttcctctaccaggaggcgcccgacgcgatgcgcagcgttggctccgcctacgctgccgtcgccggcggcctcgggtgcttcatggcgtcggcgctcaacaccgccgtcgacgccgcgacgagggacgacagggccgggcgcccgtcgtggctggcgcagaacatcaacgtcggcaggttcgactacctctactggctgctcgccgtgctcagcacgatcaacctgctcgtcttcatctacgtcgccaagcggtacaagtacagggtcaggatcgacgcgcaggacacaggtgtgaataagcactagcttttggcgcgagaaggatttgaatttggttgtggattttgcttcactgaatttgctgtacaaacgcattacaaggagtaccataacattggccattttttc

SEQ ID NO: 11332 - protein, 650 aa, Panicum virgatum
  misc_feature: Ceres CLONE 1727647
  misc_feature (156)..(571): Pfam Name: PTR2 Pfam Description: POT family
MELEAPPPAAAAAAAAKEIKSPEVLSSLQRKKLGAHFLESDERRFSGAARTPLGGGYEPPPPPASAAGTTPVNIRGEPIADLSRTGGWVAALFIFGNEMAERMAYFGLSVNMVVFMFKVMHRPFTSSANAVNNFLGISQASSVLGGFLADAYLGRYWTIAIFTTMYLLGLVALTVSASVPALVPSQEGCDKLAMLLGACAPAEPWQMAYLHTALYVTAFGAAGIRPCVSSFGADQFDERSPGYKRRLDRFFNLFYLAVTLGAIAAFTAVVYIQMHRGWAAAFGTLALAMGTSNALFFVGTPLYRHRVPGGSPLTRVAQVLVAAFRKRHAAFDSGGFVGLYEVAGAKSAVRGSAKIDHTDDFRWLDKAALQLEGDLAGGEAAPDPWRLCTVTQVEEVKILLRLLPVPACTVMLSVVLTEFLTLSVQQAYTLNTRVAALHLPVTCMPVFPCLAIFLVLALYYQTFAPLARRLTGHPHGASQLQRVGLGLVFSILSVAWAGLFERYRRGYAVRHGYLALFLSPMPGLSAYWLLIQYCLIGVAEVFCLVALLEFLYQEAPDAMRSVGSAYAAVAGGLGCFMASALNTAVDAATRDDRAGRPSWLAQNINVGRFDYLYWLLAVLSTINLLVFIYVAKRYKYRVRIDAQDTGVNKH

SEQ ID NO: 11333 - DNA, 2613 bp, Panicum virgatum
  misc_feature: Ceres CLONE 1727649
  misc_feature: Encodes the peptide sequence at SEQ ID NO. 11334
catttcgcagttccagctctctctctctctcaaaccaagaacaagcgagcgacctcgggctcggggggcgcgcgcacgcccgccatgaggctgctcgtcccggacggcgcgcggcgccagcggctgctgcagtgcgaggcgcgcgcgccgccgccccccgcgccgccggcggcggcggggggaggaggaggaggaggagggaggacggtggtggtggggatcaggcgggacaccgccagccgggagctgctcacctgggcgctcgtcaaggtcgccaatgccggggaccgcgtcgtcgcgctccacgtcgccgcgcagcacgtcgccgccgccgccgacggattgctcatggggctggatgagcggagcagggccgcggattcgctctcgtcggtgctcgccatctacgacggtttctgcaacctcaagcagattaatttggagctcaaggtctgcggaggatcatctattcgcaaaactctggtcaaagaagcagcttcctgtggcgctgcacatctcatcctcggtgttgccaagaattccaggtccttcggatcctcctccacatcagttgccaagtactgctcaaagagagtcccggcaggctgctcggttcttgcagtgaacaatggtaaagttgtttaccataaagatgcgggccatgggatgctacctgaattataccaaagcacaatacctgagacaccaaggaggagctaccggaagctcttgtcgtccatgattggggagaaactttgggaggaacatggaaaggacaacaggtccatttctcgtgccatcaccatgccaatgaggtctcccgcgttgccaaaagaagtttcactagcattggttccggtgaagggttgccggcgcgaatcacaagaagtagcaactggctggcctctcctgaggaagaagttcttgccagaccggaaagcttccctgcctgacaagtcaaagatgtctgtggtgcagtgggcgatgcggctgccgagtaggtattcagcagtttcaccagtccattcggaatgcaacagaaccacaagaccagactccatgagtaccagtcatattcttcgtgaccgggtggttgtcccattgaggagcaattcaggaaagtcttctgtagtaatcgaagaattggagaaggaaactccagaggaactgaccttgctcaaagagaaattcccatccatttattcttccttcagttacagagagctggcaaagatcacctctaatttctcaacagagtgtgtaattggagaaggtggtactagtcatgtttacagaggctgtttggcaaatggcagggagttagcagtgaagatcctgaagtattctgatgaggtactcaaggagtttgtatcagagattgagattgttagttctctcagacacaagaatgtgatatccctgatcagtttctgcttcgagaatgatgaccttctgttagtgtacgagtacctgcaaagaggcagcctggaagagatactgcatggtgaaaaaggatgcaagaatatatttggttggactgagaggttcagtgtggctgtgggagttgctcatgctctggattatctccacggtaatgacaacagtcatcaggtgatccatagagatgtcaagtcatcaaacatcctcatctcggactgctttgagccaaagttatcggactttggtctcgcagtctgggctgctgacgtgacatctcagatgacatgcaatgatgttgcaggaacttttggatacttggctcccgaatacttcatgcatggcaaggtgaacaacaaaattgatgtgtatgcttttggtgtcgtccttcttgagctcatctcgggcaggaaaccactttgcactggttgtccgaaagggcaggagagcctggtgatgtgggcaaattccatcatacaaggaggaaagctcgcacaacttgtagatcccaacttacctactgaaggccgctctgatgaagttgagaggatgacccttgctgcttccctctgcatcagacaagcacctcagaaccgtcctcaaattgatgttgttctgaagcttctcaaaggcgacattgatatactcaagtgggcacgatcacaagtcggactgtcatacgaggttgacgctgatgaatgtgtgatgacaccaccagtaaaagggagtaacgccaacatccaatcctacatcaacctcgcattcgatgtggatgacgactctgcctctgtcaccagcaccgacttcatcgcagccaacacttccttggaagagtatctgaagggaagatggagccggtcctcgagctttgactgacagatccatggcggagctatcccttgatagtgtatagatcccttcttttatttaagttgcattacatttttgcgccttggatgtgagttggcacatgcgatgccctccaccaggaatttcatttgatcatatatggcttagttactgcttttttttatgtggggtctttttttccctctccgatgggaccctttttactgtctgaagagtgaacagactcgtcatacccagttattctcatccaaagggttgagaaataaagtaggaggcatatgaaattgtgggtttcttcccgcaccg

SEQ ID NO: 11334 - protein, 742 aa, Panicum virgatum
  misc_feature: Ceres CLONE 1727649
  misc_feature (388)..(660): Pfam Name: Pkinase Pfam Description: Protein kinase domain
  misc_feature (39)..(181): Pfam Name: Usp Pfam Description: Universal stress protein family
  misc_feature: SWISSPROT Homolog: EC 2.7.11.1 Non-specific serine/threonine protein kinase
MRLLVPDGARRQRLLQCEARAPPPPAPPAAAGGGGGGGGRTVVVGIRRDTASRELLTWALVKVANAGDRVVALHVAAQHVAAAADGLLMGLDERSRAADSLSSVLAIYDGFCNLKQINLELKVCGGSSIRKTLVKEAASCGAAHLILGVAKNSRSFGSSSTSVAKYCSKRVPAGCSVLAVNNGKVVYHKDAGHGMLPELYQSTIPETPRRSYRKLLSSMIGEKLWEEHGKDNRSISRAITMPMRSPALPKEVSLALVPVKGCRRESQEVATGWPLLRKKFLPDRKASLPDKSKMSVVQWAMRLPSRYSAVSPVHSECNRTTRPDSMSTSHILRDRVVVPLRSNSGKSSVVIEELEKETPEELTLLKEKFPSIYSSFSYRELAKITSNFSTECVIGEGGTSHVYRGCLANGRELAVKILKYSDEVLKEFVSEIEIVSSLRHKNVISLISFCFENDDLLLVYEYLQRGSLEEILHGEKGCKNIFGWTERFSVAVGVAHALDYLHGNDNSHQVIHRDVKSSNILISDCFEPKLSDFGLAVWAADVTSQMTCNDVAGTFGYLAPEYFMHGKVNNKIDVYAFGVVLLELISGRKPLCTGCPKGQESLVMWANSIIQGGKLAQLVDPNLPTEGRSDEVERMTLAASLCIRQAPQNRPQIDVVLKLLKGDIDILKWARSQVGLSYEVDADECVMTPPVKGSNANIQSYINLAFDVDDDSASVTSTDFIAANTSLEEYLKGRWSRSSSFD

SEQ ID NO: 11335 - DNA, 1610 bp, Panicum virgatum
  misc_feature: Ceres CLONE 1727656
  misc_feature: Encodes the peptide sequence at SEQ ID NO. 11336
acccatgaaacctagggtagcggccgaggctgctgctgctggcggcggcggcggcgggagccaggaacagccgccggagtccggggccgacctcatcagcagcctcccggacgccacactcgccaccataatctccctcctccccaccggcgacggcgcgcgcacgcaggccttggccacgcggtggcgccacctctggcgcgccgccccgctcaacctctgcgacgacgacatcccttggcgggcatccagcggcgacgtcttctcccgcgtcctctcggcgcaccgcggcggcagccccgtccgccgcctctccctcggctggcgcagctggtgcggcggccgctaccccgacctcgacgcctggctccggtcccccgcgctcgacggcctgcgggagctcgagctctggcacgggttcgcgcacccggcgccgatgccgccggccgcgttctggctcgcgccgtcgctccgcgtcctcgccctcagcggcggcgtcagcaacatctgcgtcggcgagttcgtccagttcccggcagaggacgtggacaggctccacttcccccgcctcgagcagctcacgctgaagtgcgtcgacattgccgaggccgtgctccacaccctgctgtccaaatgccccgtgcttgagagcttggtgctcagccaaaatgagggcttccatcgcctccggatcagctcccctacccttcgaagctttggcgtttcggatgaccgcgaagagctctgggatcttgagaggctgaaacaagtcgtcatcgaggatgcccctctcctggaaaggttcttcatcaggcattcggaagagggagatggtctatcggttcgcatagccggggcgcccaaactcgagttcttgggatctctaacctctggcattactacacttgagctaggaagtactgttctgaaggaaactttgcctgtcaactcaacgacggtggtgtggactgtcaaggttttggttgtgcacatgtctcctcctagtattgatgatgctattagccttatgaaatgctttccctgcttgcagaagctatatgccttgatatttctggacaaggagtcaaaaagagcacgagttcatgatccaagtgattatctggaatgccttgatctgcatctgaagaaattagtactgataaattatcgagggataaagagagacatggaatttgccaagttctttcttttgaaagctagagtgctaaaaatgatggaattggcaacccgccgtcagagctgtgattcgaaatatttgactacacagggtaccaaactgcagctgaagagcagagcctctaaagatgcccaagttctcttttcatgccatagctattcaaatgattccatgcacatcaagcatatgcatgatctgagcactgttgatccctttgatcagtcgttgtgtagctgtaaaagtatccagtttctttgagctggtatcctgcaaaccatagatggaatattaatggtttctgcttacattcagaagactgtttctgcttacattcagaagactgcatggatatattatctgatgtcaatcttactttgtttctgctttaccataagaagactgtttgatgctt

SEQ ID NO: 11336 - protein, 483 aa, Panicum virgatum
  misc_feature: Ceres CLONE 1727656
  misc_feature (366)..(415): Pfam Name: FBD Pfam Description: FBD
MKPRVAAEAAAAGGGGGGSQEQPPESGADLISSLPDATLATIISLLPTGDGARTQALATRWRHLWRAAPLNLCDDDIPWRASSGDVFSRVLSAHRGGSPVRRLSLGWRSWCGGRYPDLDAWLRSPALDGLRELELWHGFAHPAPMPPAAFWLAPSLRVLALSGGVSNICVGEFVQFPAEDVDRLHFPRLEQLTLKCVDIAEAVLHTLLSKCPVLESLVLSQNEGFHRLRISSPTLRSFGVSDDREELWDLERLKQVVIEDAPLLERFFIRHSEEGDGLSVRIAGAPKLEFLGSLTSGITTLELGSTVLKETLPVNSTTVVWTVKVLVVHMSPPSIDDAISLMKCFPCLQKLYALIFLDKESKRARVHDPSDYLECLDLHLKKLVLINYRGIKRDMEFAKFFLLKARVLKMMELATRRQSCDSKYLTTQGTKLQLKSRASKDAQVLFSCHSYSNDSMHIKHMHDLSTVDPFDQSLCSCKSIQFL

SEQ ID NO: 11337 - DNA, 1622 bp, Panicum virgatum
  misc_feature: Ceres CLONE 1727664
  misc_feature: Encodes the peptide sequence at SEQ ID NO. 11338
gagaaatgaattaaatcatccgggaaacaaagaggcttcctctccttccccaaactatcctcctctgcctctccctctccccgatccgatccgtagtggctcgcgtcccggttcctcgccggcggcagcggcgctgggcgagcggcggcggctgggagaggtcttcgtctgcgcttcgccggcggcgatcatccactaggtcggttggcggcggcggcggcggcgggagatggaggcggacgccgggaagctgttcatcggcggcatctcgtgggacaccaacgaggaccgccttcgagagtacttcgacaagtatggtgaggtggtggaggcggtcatcatgcgcgaccgggccaccggccgcgctcgaggcttcgggttcatcgtgttcgccgaccctgctgtcgccgagcaggtgattatggagaagcacatgatcgacggccggatggtggaggcgaagaaagctgtccccagagatgatcagcatgctctgagcaagagcggtggcagcactcatggatcgccagggcccagtcgcacgaagaagatatttgtcggtggtttggcttccaccgtgaccgaagcagacttcaggaagtactttgagcagtttgggacgatcactgatgttgtggtgatgtatgaccacaacacacagcgtcctagagggtttgggttcatcacctatgattcagaagatgccgtggacaaggcattgttcaagacgttccatgaactgaatggtaagatggtcgaggtgaagcgggctgttcctaaggaactatcacctggacctagtatgcgctctcctgtcggtggattcagagccaatatcctcaatggatatacccaaggttataatccgagcccagtgggtggctacgggatgaggatggatgcaaggtttgggcttttgtcaggagggcgcagtggttatccatcttttggtggtagttatggaattggtatgaattttgacccagggatgaacccaggtattggaggtggctctagtttcaacaatagtctccagtatggacggcagcttaatccatactacaatggaaactctggtagattcaatagcagcattagctatggtggagtgaacgacaataatggatcagtgtttaactcactggctcggaacctatggggtaattcggggcttaattactcttccaactccgcaagctctaattcctttgtgtcatctggaaatgagggccttagtggaattgggaacaacaatgtgaactggggaaaccctcctgtgcctgctcaaggggctagcggtggctctggttatggtactggaaactttggctatggatccagtgaaaacaactttggtctgggttccagtgcttatggaaggaatgttggatcaggtggtgtcaataccttcaaccaatcaaccaatgggtatgcgaggaactttggagattcgtcagcaggtggtggctccatctacagagacacaacttggagatctggatcttctgagcttgatggaaccagcccatttggttatgggcttggcaattcagcttcagatgttacagcaaagagctcagcaggttacatggggcattgactgatagaggaatgacgccgcc

SEQ ID NO: 11338 - protein, 456 aa, Panicum virgatum
  misc_feature: Ceres CLONE 1727664
  misc_feature (108)..(178): Pfam Name: RRM_1 Pfam Description: RNA recognition motif. (a.k.a. RRM, RBD, or RNP domain)
  misc_feature (8)..(77): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MEADAGKLFIGGISWDTNEDRLREYFDKYGEVVEAVIMRDRATGRARGFGFIVFADPAVAEQVIMEKHMIDGRMVEAKKAVPRDDQHALSKSGGSTHGSPGPSRTKKIFVGGLASTVTEADFRKYFEQFGTITDVVVMYDHNTQRPRGFGFITYDSEDAVDKALFKTFHELNGKMVEVKRAVPKELSPGPSMRSPVGGFRANILNGYTQGYNPSPVGGYGMRMDARFGLLSGGRSGYPSFGGSYGIGMNFDPGMNPGIGGGSSFNNSLQYGRQLNPYYNGNSGRFNSSISYGGVNDNNGSVFNSLARNLWGNSGLNYSSNSASSNSFVSSGNEGLSGIGNNNVNWGNPPVPAQGASGGSGYGTGNFGYGSSENNFGLGSSAYGRNVGSGGVNTFNQSTNGYARNFGDSSAGGGSIYRDTTWRSGSSELDGTSPFGYGLGNSASDVTAKSSAGYMGH

SEQ ID NO: 11339 - DNA, 618 bp, Panicum virgatum
  misc_feature: Ceres CLONE 1727664-R
tttcacatacaacatttctcataatagtttcaggagaggactgaaggtgcatcaggtgcaaattttgaacctcacatgattcacagagatgggttagttaatagagctaaccaggggagtcggtcaaagtggtcagatatatatatatccttggaggaccttttcaaacgtatttgcgttttatgtaaggcttgagattgtgggttttcggatttcctacagcgagagagtttaggttttggcaaccttgggtgttttttggtcggatgagatgatgtgaagttaagattgcgggatatatataatctgcagagtgttcagttgtacggcggcgctgccccccatatagacccaccccttttgtcgggtttttgtcggtatagtagagaaaactgctctagtagcgtccttcggatttgtgtgctagctgttgttatcagaggatgataagttttcaccttttcttggttttttatcctgtcttactgaagtgtatgtaccagaggtctggtctgtgtttttccctagcgcaaacttttgaggggatgcccccttctgggccccggagaataataatgctgctacaatatattctaattcatttggaaggctttttcc

SEQ ID NO: 11340 - DNA, 2138 bp, Panicum virgatum
  misc_feature: Ceres CLONE 1727675
  misc_feature: Encodes the peptide sequence at SEQ ID NO. 11341
gagggttttaagcacctcttcctcaccgcgaagccaaactccccgacacgatctggccgcgggaagatggcgactccgccgccgcctctccgccgcgccacccccctcctcctcctcgccgtcctcgtcggcgccctcgcctccaccgcccgcgccgatctcgtcatcaccagggcagatcggagggttgatctgacttcacatatcgttcgcgtcctcgcttccctcaaggttgaaaatgttggaccagacccagtctctcaagttttactatcttttcccaacatccaagcaaagaacttagcagctataagagcatttggcactgaaggaaaagtgaagggtccaagtactgttctgccaattgaagttgttcagccttctagagctcccccagagctaactttcttttcagcattgctacccaaacctttggaaaagggaaagattctacacttggatgtcctgactgtattcacacactctcttcaaccattcccagaagaaatcacgcaagctgaagcacaacttgttgtctatcaggatagtgctcattatctgtcaccttaccctgttaaggtacagacacttgctatcagattgcccggcggaagggttgaatcatacacaaggcatccaagtgcaaaacttgtggattcagaactgaaatatggatcatctgaagagcttcccccgttttcctacttacctgtgatcgtgcactttgagaacaacaatccttttgcagtcgcgaaggaagttataagggagattgagatatctcactggggaaatgtacagattacggaatactacaacattgcccacggtggtgccagactcaagggtgaattttccaggattgattatcagtccagaccttacgtaagaggtgtttcatcttttaggaatcttattgcgagactgcctccaagggcccactctatttattacagagatgagatcggtaatatttcgacatcacatttgtggagtgattccaagaagacccacctggaaattgaaccaaggtttccattgtttggtgggtggcaaacaaccttcactgttggttatggtttaccacttgaagactttgttttctattctgatggaaagaggtttctcaacatcacttttggttctccaattgaggaaattctcattgaaaagcttatagtaaaggttgtactacctgaagggtcaaaggatatcgaagtttcagctccctttccaacaaatcagtcgcaagaggtgaagtattcacaccttgacattgttggaaggccagttgttgtcttggagaagcctgatgttattccagagcataatttgtatttccaggtttactacaaattcaacaatatatccttgctccgagagccgttgatgcttattactggtttcttcctcctgtttgtggcctgtattgtttacatgcgcactgatatgtcaatttccaagagttctccttcttacttggccaagctgcaatgggatgaggtgcaagccactgttcagaaaatccagggtatctttgagcaatgcttagcagttcatgataaactggaggcctcattgcgtgatttatctaggactggggacattcagtcttgcaaggctgctcgtaaagctgctgatgcacagtttaaggagctatcgaaagagctgaagccattgttgacatctctacagtcatctccccagtcttatcagatatggccaaaggtagaggatttgatcagaaaggagagagagatgcaggagaagcttatgacaaggcattccactgttgtcgacagctttgagaagaagctgcgtgggcaagatgtagagaacaggattgctttgcagcagcagaaaattgcggccctgaggcaggaggtcgaatctcttttagagtacatcagtgagatttgagctaatctgtgccgtcatatatcttaggcaattaggatgtctttgctgggtttacccgatgttgaaatctaatacactgagattgcgttagtaaccatccaatttcccagttggggcctggaaatcgcaacgaccatatgtaacatgataatcttctagagttgactaaattttgcatttgatgataatatcacaaggaaccttcatcttttggactg

SEQ ID NO: 11341 - protein, 617 aa, Panicum virgatum
  misc_feature: Ceres CLONE 1727675
  misc_feature (31)..(459): Pfam Name: Ribophorin_I Pfam Description: Ribophorin I
  misc_feature: SWISSPROT Homolog: EC 2.4.1.119 Dolichyl-diphosphooligosaccharide--protein glycotransferase
MATPPPPLRRATPLLLLAVLVGALASTARADLVITRADRRVDLTSHIVRVLASLKVENVGPDPVSQVLLSFPNIQAKNLAAIRAFGTEGKVKGPSTVLPIEVVQPSRAPPELTFFSALLPKPLEKGKILHLDVLTVFTHSLQPFPEEITQAEAQLVVYQDSAHYLSPYPVKVQTLAIRLPGGRVESYTRHPSAKLVDSELKYGSSEELPPFSYLPVIVHFENNNPFAVAKEVIREIEISHWGNVQITEYYNIAHGGARLKGEFSRIDYQSRPYVRGVSSFRNLIARLPPRAHSIYYRDEIGNISTSHLWSDSKKTHLEIEPRFPLFGGWQTTFTVGYGLPLEDFVFYSDGKRFLNITFGSPIEEILIEKLIVKVVLPEGSKDIEVSAPFPTNQSQEVKYSHLDIVGRPVVVLEKPDVIPEHNLYFQVYYKFNNISLLREPLMLITGFFLLFVACIVYMRTDMSISKSSPSYLAKLQWDEVQATVQKIQGIFEQCLAVHDKLEASLRDLSRTGDIQSCKAARKAADAQFKELSKELKPLLTSLQSSPQSYQIWPKVEDLIRKEREMQEKLMTRHSTVVDSFEKKLRGQDVENRIALQQQKIAALRQEVESLLEYISEI

SEQ ID NO: 11342 - DNA, 1709 bp, Panicum virgatum
  misc_feature: Ceres CLONE 1727676
  misc_feature: Encodes the peptide sequence at SEQ ID NO. 11343
aagcgtggatctcaagtagcggcagctcggctcatgcgaattgccagagcttgctgccatcatggttgacttgaggcgcgcgcgcgctcttctcgccgccggcatcctcctcgccggcgtggtcggcatcgtcgtgctcggcgccggcgaggagcagttcgtgtactcgggcttcgccggcgcgcggctgaccctggacggcacggccgtcatcacgccgacggggatgctggagttgaccaacggcacgccgcagctcatgggccacgcggtgtacccgacgccgatgccgttccggcggtcccccgacgggcccgtgcgctccttctcggcgtcgttcgtcttcggcatcatcccgccctacgctgacctcagcggccacggcatcgtcttcttcgccggcaacaacagcttctccaccgcgctgcccagccagtaccttggcttcctcaactcctccaacaacggcaacgccagcaaccacatcttcggcgtcgagctcgacactatccgcagcaccgagtttaaggaccccaacgacaaccacgtcggcatcgacatcaacagcctcacgtccgccaacgtgagcgacgccggctaccacgacgacggcaccggcgcgttccacagcctgtccctcatcagcgccaaggccatgcaagtctgggtggactacgacgccgcgaccgcgcagatcgacgtgttcctggctcccctgaagatggccaagccttccagggctctggtgtcggccaagcaaaacctctcggatgtgctcgtggagccggtgtacgtgggcttctcgtccgccacgggcacggtgcggtcgcgccactacgtgctcggttggagcttcgccatggacggccctgctccggccatcaacatcgccggcctgcccaagctgccaaggttcggccccaagccacggtccaaggtcctggacatcgtgctgccgatcggcaccgcgacgttcgtcctcggcgtggtcgccgtcgtcgtcgtcctcgtccggaggcggctcaagtacgccgagttgcgagaagactgggaggtcgagttcgggccgcaccggttcacgtacaaggacctcttccgcgcgacagagggattcaagagcaagaagctgctcgggatcgggggattcgggagggtgtacaagggagtgctcccgaaatcgaaaatggaggtcgccgtgaagcgggtgtcacacgaatcaaggcagggcataaaggagttcgtcgccgaggtcgtcagcattggccgcctccggcaccgcaacctcgtgcagctgctcggctactgccggcgcaaaggtgaacttctcctggtctacgactacatgcccaacggcagcctcgacaagtacctgtacggcaaggaggagaaggccacgttggattgggggcagaggttccggatcatcaagggggtggcatcagggttgctctacatccacgaagattgggagcaggtcgtcatccaccgcgacatcaaggcgagcaatgtgcttctcgacagcgagatgaacgggcggcagggccgtaccggtaaattcaagggccctgtgcgaaacaatggactgggctctagtggcctagtgcaggatcgcgaataccaagcgatagcagccggcaagcgcgataagcgcgatgtgctgtgtgaaagtacaaatgttagaagtcacacgtgtgactggcagttaaatc

SEQ ID NO: 11343 - protein, 549 aa, Panicum virgatum
  misc_feature: Ceres CLONE 1727676
  misc_feature (29)..(266): Pfam Name: Lectin_legB Pfam Description: Legume lectin domain
  misc_feature (351)..(548): Pfam Name: Pkinase_Tyr Pfam Description: Protein tyrosine kinase
  misc_feature: SWISSPROT Homolog: EC 2.7.11.1 Non-specific serine/threonine protein kinase
MVDLRRARALLAAGILLAGVVGIVVLGAGEEQFVYSGFAGARLTLDGTAVITPTGMLELTNGTPQLMGHAVYPTPMPFRRSPDGPVRSFSASFVFGIIPPYADLSGHGIVFFAGNNSFSTALPSQYLGFLNSSNNGNASNHIFGVELDTIRSTEFKDPNDNHVGIDINSLTSANVSDAGYHDDGTGAFHSLSLISAKAMQVWVDYDAATAQIDVFLAPLKMAKPSRALVSAKQNLSDVLVEPVYVGFSSATGTVRSRHYVLGWSFAMDGPAPAINIAGLPKLPRFGPKPRSKVLDIVLPIGTATFVLGVVAVVVVLVRRRLKYAELREDWEVEFGPHRFTYKDLFRATEGFKSKKLLGIGGFGRVYKGVLPKSKMEVAVKRVSHESRQGIKEFVAEVVSIGRLRHRNLVQLLGYCRRKGELLLVYDYMPNGSLDKYLYGKEEKATLDWGQRFRIIKGVASGLLYIHEDWEQVVIHRDIKASNVLLDSEMNGRQGRTGKFKGPVRNNGLGSSGLVQDREYQAIAAGKRDKRDVLCESTNVRSHTCDWQLN

SEQ ID NO: 11344 - DNA, 1614 bp, Panicum virgatum
  misc_feature: Ceres CLONE 1727678
  misc_feature: Encodes the peptide sequence at SEQ ID NO. 11345
acatcacatgatcgccaccctcttttccttcttatgttcttctagctccacatccagcatcccattttccctcttctcttcaagtcccacccataaggcttggagggaagaagagagagcttagcagcccagaaccaaagccggcaagcaaaatggcgatctgcagcacgcacaccaccacctccctgcactccccatgcacagtctcaaacacaggcttcaggcagaagcaagtcatcttcttcaccagcaacaggagaagtggcagaaggcatggaggggcaagaacctttcaggtttcatgctccgtcgagaagccagtggtgattggcctggcggcagactcaggatgcgggaagagtaccttcatgcgccgtctcaccagtgtgtttggtggtgctgcagagccacccaagggtggtaacccggactccaacaccctcatcagtgacaccacgacggtgatatgccttgatgactaccattccttggacagaaccgggagaaaggagaagggtgttaccgccctcgacccaagggcgaacaactttgatctcatgtatgagcaggtgaaggcgatcaaagaaggccagacaattgagaagccgatctacaaccatgtcactggcctcctcgacccaccggaggttatcacacccccaaagatttttgtcattgagggcttgcacccaatgtttgatgagcgtgtgagagacctcctagatttcagtatctacttggacatcagtgatgaggttaagtttgcatggaaaattcagcgggacatggcagagcgcgggcacagccttgaaagcatccaggctagtatcgaagctaggaaaccagattttgatgccttcattgatccgcagaagcaatatgctgatgctgtgattgaagttctgccgacacagttgattcccgatgacaatgaaggaaaggtgctacgtgttaaattgatcatgaaagaaggcgtgaagcacttcaacccagtttacctcttcgatgaaggatcaagtatcaactgggtgccttgcggaagaaagctcacatgctcttaccctggcatcaaatttgcctatggcccagacagttacttcggccacgaggtatcagtgttggagatggatgggcaattcgacagactagatgagctcatctatgtggagagccatctaagcaacctctcaactaaattctacggagaagtgacacagcaaatgctaaaacatgcagatttcccaggaagcaacaacggaacaggtctcttccagaccattgttggactgaagattagagatctctatgagcagatagttgctgagagggctggtgtaccagctgaagcagcgaaagtttaatgatctgcacattcagatttcctacacctcttcaaactcaatgagaatgagaatcctcgaaattcttgtaattagttcggatatatcacgactaggaggtagaaatgtcattgcagtactcaggaaaacatgcaatggaatttctagaaatacctcgccatgggggtgctcttacatctcttcttcacatgttcaaatgtatatcttcttccatgcttttatgcagaaaaaaatacagctgcctgctactatc

SEQ ID NO: 11345 - protein, 402 aa, Panicum virgatum
  misc_feature: Ceres CLONE 1727678
  misc_feature (58)..(257): Pfam Name: PRK Pfam Description: Phosphoribulokinase / Uridine kinase family
  misc_feature: SWISSPROT Homolog: EC 2.7.1.19 Phosphoribulokinase
  misc_feature: Useful for making plants with altered lignin content
MAICSTHTTTSLHSPCTVSNTGFRQKQVIFFTSNRRSGRRHGGARTFQVSCSVEKPVVIGLAADSGCGKSTFMRRLTSVFGGAAEPPKGGNPDSNTLISDTTTVICLDDYHSLDRTGRKEKGVTALDPRANNFDLMYEQVKAIKEGQTIEKPIYNHVTGLLDPPEVITPPKIFVIEGLHPMFDERVRDLLDFSIYLDISDEVKFAWKIQRDMAERGHSLESIQASIEARKPDFDAFIDPQKQYADAVIEVLPTQLIPDDNEGKVLRVKLIMKEGVKHFNPVYLFDEGSSINWVPCGRKLTCSYPGIKFAYGPDSYFGHEVSVLEMDGQFDRLDELIYVESHLSNLSTKFYGEVTQQMLKHADFPGSNNGTGLFQTIVGLKIRDLYEQIVAERAGVPAEAAKV

SEQ ID NO: 11346 - DNA, 1616 bp, Panicum virgatum
  misc_feature: Ceres CLONE 1727683
  misc_feature: Encodes the peptide sequence at SEQ ID NO. 11347
aactcaaacagcccagccgcaaagccgcccgggtttcagcagcttcggcacgatcgccttcgcccagtgagggaggagaggacaggaaaaaaaattcccccgtcgcatccgccgcggcgggagaggaatctcccgccgccgccgccacggttctcctcggcaggtacgagctcggcgacctcctcggccgcggcgcgtccgccaaggtgtaccgcgcgcgggacctcctcaccggccgctccgtcgcgatcaagtcattccccaacccccgcgccgccggggccgagaaggggcgccgccccgtggccattgagcgcgaggcggccatcctccgccgcctgcgccaccgccacgtggtgcgcctccacgagatcctagccacgcgcaagaaggtccatttcgtcctcgacctcgccgccggcggcgagctcttctcgctcgtcgacgcctccggccgcatgacggaggacctcgccaagcactacttccggcagctcatctccgccgtgcgctactgccacgcgcgcggcgtgttccaccccgacatcaagccggagaacctgctcctcgatgaggcaggcgagctcaaagtcgccgactttggcctaggcgccgtggccgacggcaacctccgccacacgctctgcggcaccccggcgtacgtggcgccggagatcctgtcgaggaagggctacgacccggccaaggtggacatctggtcctgcggcgtggtgctgttcgtgctcgccgccggctacctccccttcaacgacgccagcctcgtcaacatgtaccgcaagatctacgcgggcaggttccggtgcccgagctggttctcgccggcgctgcgcgacctgctgcgccgcttgctggacccgaacccggactcccgcaccgacgcggacggcatcgtgggccacccgtggttctgccacggcgccggcgacgaggagctggcgcgcctcatgcgcggccacgaggaagagccctggttcaagcccgagttcaaggaggaggacatggcgagggagatgacggcgttcgacatcctgagcttctccgccgggtccgacctgtcggcgctcttcggtgccgggccgggcaaggagcgggtgttcgtgagcgaacccgccgccgcggtgctgagccgcgtggaggcggctgggcggaaggaagggtaccgcgtgaggagggaagggaagcggggcaccgggccggtctacctggaggaggagagcggcggcggcatcgtggccaaagtgagcgtcttcaagctcgccgacgcggtgtcagtggtggaggtcgtcaagggcgacggcgcggaggcggcactcttctggaccgagcggctcgagccggccgtgaagcccccggtgctgagctgagctgaaagctgatcggggccgccgccgagggttcctgctctgctcctgggaggcgccgccgctgccgcttgccgggaacgggattcgtttcctgttgttgtgatggtaaattcatttggttctttggccgtgtgtgtgttgtatggtgcctgtcacgctcagcgagcagagcactaagcgagcgagatttgttgccgggtcggcgaaaatcatcagcatcatcttgtgtat

SEQ ID NO: 11347 - protein, 460 aa, Panicum virgatum
  misc_feature: Ceres CLONE 1727683
  misc_feature (55)..(309): Pfam Name: Pkinase Pfam Description: Protein kinase domain
  misc_feature (340)..(397): Pfam Name: NAF Pfam Description: NAF domain
  misc_feature: SWISSPROT Homolog: EC 2.7.11.1 Non-specific serine/threonine protein kinase
  misc_feature: Useful for making plants with modulated biomass
LKQPSRKAARVSAASARSPSPSEGGEDRKKNSPVASAAAGEESPAAAATVLLGRYELGDLLGRGASAKVYRARDLLTGRSVAIKSFPNPRAAGAEKGRRPVAIEREAAILRRLRHRHVVRLHEILATRKKVHFVLDLAAGGELFSLVDASGRMTEDLAKHYFRQLISAVRYCHARGVFHPDIKPENLLLDEAGELKVADFGLGAVADGNLRHTLCGTPAYVAPEILSRKGYDPAKVDIWSCGVVLFVLAAGYLPFNDASLVNMYRKIYAGRFRCPSWFSPALRDLLRRLLDPNPDSRTDADGIVGHPWFCHGAGDEELARLMRGHEEEPWFKPEFKEEDMAREMTAFDILSFSAGSDLSALFGAGPGKERVFVSEPAAAVLSRVEAAGRKEGYRVRREGKRGTGPVYLEEESGGGIVAKVSVFKLADAVSVVEVVKGDGAEAALFWTERLEPAVKPPVLS

SEQ ID NO: 11348 - DNA, 1159 bp, Panicum virgatum
  misc_feature: Ceres CLONE 1727685
  misc_feature: Encodes the peptide sequence at SEQ ID NO. 11349
gaagttccgtatccgtcactctactgttccggtcaatccttctcctccccgcctccgcctctgcctccgcacgccgccatgccgccggccggtagcctcaccgccgaccagctcagcttcttcgagaccaatgggtacctcgtgatggactcgttctcgagcgcggaggaggtctggagatgcgggaccgcatggccgagctcgtcgccgggttcgacggcgccaatactagcgtcttctccaccaagaaccatccacagttaaaggatgactatttcttcaagagcgcagagaatatctcattcttctttgaggagaaggcgtatggagatgatggatgcttgaaacaggcaaaagaactttcaattaataaagttgggcatgcattacatgaacttgaccctgtgttcaaaaagttttctttctcgaagagcatcgctagcttgttctcttctctaggctacaagaggcctgcagttatgcaatctatgtacatcttcaagcaaccaggtattggtggtgaggtggtgccacaccaggatagtacattcctttacacggaacctagaacatgcacaggtttgtggcttgcacttgaagatgcaacaattaacaatggttgcctctgggcaattccaggatcacataaaaagggtctggtaagacgaatgattagagatgaaaatggtactcattttgattgcccttccccatcctatgatctgaaagaatttgtgccgctggaagtaaaatcaggagccttggtggttatacatggtgatcttatacatcagagctttgagaatctttctccagcgtcaagacatgctttcagcttacatgtaattgatactgaaggatgtgaatggtccaaggacaactggatacagaggaaaactgccccagaaccgctttatgtatcttagccaaaccaggtaccactcaccagtagtgcggtaaaaaacagagattcccagcaagtgattcgtggatcgcttatctttgtagtttgttgcaataaaattggggcatcctaccgagccatgttgttttcctttcaccttcaaacatgtaaatactactcttccttgctaaatgttcgaatcaatatcatatttagcgtgcaataaatgttcgaatcaatattagcgagcagcac

SEQ ID NO: 11349 - protein, 248 aa, Panicum virgatum
  misc_feature: Ceres CLONE 1727685
  misc_feature (3)..(217): Pfam Name: PhyH Pfam Description: Phytanoyl-CoA dioxygenase (PhyH)
  misc_feature: SWISSPROT Homolog: EC 1.14.11.18 Phytanoyl-CoA dioxygenase
MRDRMAELVAGFDGANTSVFSTKNHPQLKDDYFFKSAENISFFFEEKAYGDDGCLKQAKELSINKVGHALHELDPVFKKFSFSKSIASLFSSLGYKRPAVMQSMYIFKQPGIGGEVVPHQDSTFLYTEPRTCTGLWLALEDATINNGCLWAIPGSHKKGLVRRMIRDENGTHFDCPSPSYDLKEFVPLEVKSGALVVIHGDLIHQSFENLSPASRHAFSLHVIDTEGCEWSKDNWIQRKTAPEPLYVS

SEQ ID NO: 11350 - DNA, 1492 bp, Panicum virgatum
  misc_feature: Ceres CLONE 1727686
  misc_feature: Encodes the peptide sequence at SEQ ID NO. 11351
accacaccagcgcagcgcggcgcggcgcggcggccaaccagaaggacgaagcgtagcgggcggagccagccaaccaacaaaccaacggacgacggaagaggcgaagagccaatccggccacgctgccctgccccgcgctccgccgctcctctcgggatccgcccgcccgcccgcccggcgtgatctcgccgcctcgcccgcggttggggctccggccgcacgcccccatgtgtcccggagcggatcgccgcgcgtagaggccgggtggggagagggagtttagtgttggggcaggccaggcagggaagcgtcgccttgccgtgtcccgcggcgagatggacgcgagtgccggctccttcgtcgccgtccgccggctctccggctcggaccgcgccgccgccttccaccactcctcctcggcggaggtggtgacggggtcgtcggcgtggatcgggagggggctctcctgcgtctgcgcgcagaggagggacagcgatgcgcgcctctccttcgatttgacgcctacgcaggaagaatgcctacagaggctacagaatagaatagaagttcagtatgatagtgcaaacagagagcatcaggaagcattacgggctctttggtgtgctgcttttcctggaaccgagcttcggggtctaatatcagaacaatggaaagagatgggttggcaagggaaagacccatctacagattttagaggcggaggcttcatctccttggagaatctgttgtactttgcaaggaactatccgaaatcttttcaggaacttcttcgcaagcagaatggtgaccgtgcaatctgggagtatccatttgctgtagctggtgtaaatataaccttcatgctcattcagatgcttgatctccaagcagttaaaccaaggtcattgtttggagcagttttcctaaagcttctttcagaaaatgatcaagcatttgacattctctactgcataaccttcaagctgatggatcagcaatggcttgacatgcatgctacttacatggacttcaatacggtcatgaaatcaacacggcgtcagctagaaagggagcttttgatcgaggatattcagcggattgaggacatgccatcatacaggcttctagcccggtagctagaagaaactgaaaatcttaacatggctacacgttgcaagccttgagttgctgatggattgcaactggcacccacagcctgagagaatcctggaatgtagatgcatctgtatccctgtgtttaggtactctggtaacctgatctctgaaatttacaaggtagggtttttcttggtgatagaatgccgcttagggtaactgaagtgtctgatcagctgccaaggcaaagtatttgtagggtgtgttattgcaatcgggctgttgcccatcataccacgtaaagggtgtgttccagttcctagagtttgcgatgtaaacaggaggattttgggaaagctgatctgagttgtctccc

SEQ ID NO: 11351 - protein, 266 aa, Panicum virgatum
  misc_feature: Ceres CLONE 1727686
  misc_feature (85)..(246): Pfam Name: ELMO_CED12 Pfam Description: ELMO/CED-12 family
MDASAGSFVAVRRLSGSDRAAAFHHSSSAEVVTGSSAWIGRGLSCVCAQRRDSDARLSFDLTPTQEECLQRLQNRIEVQYDSANREHQEALRALWCAAFPGTELRGLISEQWKEMGWQGKDPSTDFRGGGFISLENLLYFARNYPKSFQELLRKQNGDRAIWEYPFAVAGVNITFMLIQMLDLQAVKPRSLFGAVFLKLLSENDQAFDILYCITFKLMDQQWLDMHATYMDFNTVMKSTRRQLERELLIEDIQRIEDMPSYRLLAR

SEQ ID NO: 11352 - DNA, 2055 bp, Panicum virgatum
  misc_feature: Ceres CLONE 1727696
  misc_feature: Encodes the peptide sequence at SEQ ID NO. 11353
ttcttgcttggacccagacccagccagagctggagtagcaactagcaacctcaccttcttgcgcaggaggagagaggaggtggaggagctctgaggcgccgccgccatggacgccgagagaggagatgcccagtctcccctgctgcagcaccagcctccaaaccagacgcaggtttcctcagcgaatcagcactataacaagcccttcagctggaaggctcctgccattgttttggccttcgaattcttggagagtattgcttactctggtatagcgctcaacttggtcgtctatcttgggaccgtcctccatggaaccactgcctccagtgcagcaaatgtcgatgcgtggaacggtgccacgtttcttacaccggtccttggagcctttcttgctgatacatattggggaaagtacaagaccgtagcaatctctataatattctacgttggtgggttgcttgtaattaccgcctctgctgtcattccatccctacggcctgcctcatgcgaaggaggttcttgcccacctgcaacggggtttcagtattttgtgctctttgcttcgttgtacctcatttcgatcggcacggggggcgtcaagtcagctctacttcccttcggagcggaccaatacgatgattccaaccttgaagagagtaaaaacaagcaattgttcttcagttggtttttcattgctatcaaccttggagtgttcatctcgggcactgtccttgtctggatacagcaaaatgtggcttggtcccttggatttggcatctccttgatctgccttctcatcgccacagtcgcctttttcattggaacaccagcctacagggttcagcttccaactgggagcccactgaagagcattgtaatggtatttgttgcctcctttaagcagagaagagtggcagttcctgctgatagcacgctgttgtttgaaggggaagatgctgaatcaagcgacacggtaccaaacaaattagaacacaccgatgaattcaggtgcttagataaggctgctgtggttttagaggagcaagagattaagggcagccgtcgtccatggatgctatgcacagtgactcaggtggaggaagtgaagatcctgatccggatgctcccaatatggttcacctgcgtcttctactcggccgcgatgtgccagaccgccacgacgttcgtccagcaggggaacgcgatgagcaccaagatcgggtccttctcggtgccagccgcgtccctgaactcggccgaggtcatcttcatgatggtctgggtggcgttccaggacagcgtggtcatcccggtggcgaggcggtatacgggccaccccgcgggcctgacgctgctgcagcggatgggcgtggggcggctcctggcggtccccgcgatgggggcggcggcgctggtggagacgtggcggctgcggcgcgtgcgggcaggcgggaacctgagcatcgggtggcagctgccccagttcgtgatcctggcctgctctgacgtgttctgcggcatcgcgcagctggagttcttctacgcggaggcgccggcgtcgatgcgcagcctgtgctcggcgttccagttcctggccatgtcgctggcgtactacgtgaacacgctggtggtctcggtggtggcggcggcgacgacggccggcgggcggcccgggtggctccccgcggacctgaacgacggccacctcgactactacttctggatgtggacgggcatcagcgcggtgaactacgccgtgtacacggcgttcgccaagcgctacacgctcaagaaggtggtccgccagtagctgctggatcggcctctgtccgagtaccctgctctactgtacggtatacggtgtacactactcctactctactccggaaccaaaagactgctgttgccgattgtaaagaccgtcaaaattcattgtagcctgttaatttaagcatcgtgtcatctgtactagttatcttgtagtatgtcgatgtgtatcttgtatggcgatttgtattgattttccggaaagaataagagggaaaattttac

SEQ ID NO: 11353 - protein, 568 aa, Panicum virgatum
  misc_feature: Ceres CLONE 1727696
  misc_feature (104)..(499): Pfam Name: PTR2 Pfam Description: POT family
MDAERGDAQSPLLQHQPPNQTQVSSANQHYNKPFSWKAPAIVLAFEFLESIAYSGIALNLVVYLGTVLHGTTASSAANVDAWNGATFLTPVLGAFLADTYWGKYKTVAISIIFYVGGLLVITASAVIPSLRPASCEGGSCPPATGFQYFVLFASLYLISIGTGGVKSALLPFGADQYDDSNLEESKNKQLFFSWFFIAINLGVFISGTVLVWIQQNVAWSLGFGISLICLLIATVAFFIGTPAYRVQLPTGSPLKSIVMVFVASFKQRRVAVPADSTLLFEGEDAESSDTVPNKLEHTDEFRCLDKAAVVLEEQEIKGSRRPWMLCTVTQVEEVKILIRMLPIWFTCVFYSAAMCQTATTFVQQGNAMSTKIGSFSVPAASLNSAEVIFMMVWVAFQDSVVIPVARRYTGHPAGLTLLQRMGVGRLLAVPAMGAAALVETWRLRRVRAGGNLSIGWQLPQFVILACSDVFCGIAQLEFFYAEAPASMRSLCSAFQFLAMSLAYYVNTLVVSVVAAATTAGGRPGWLPADLNDGHLDYYFWMWTGISAVNYAVYTAFAKRYTLKKVVRQ

SEQ ID NO: 11354 - DNA, 2395 bp, Panicum virgatum
  misc_feature: Ceres CLONE 1727699
  misc_feature: Encodes the peptide sequence at SEQ ID NO. 11355
agggatgaattgatcatcgccgctctccattccgagaagaaaaaatcattcatttgaccccgcagattcgctgctcatacatactactcccgcggacgcggcggccggcggcgcctcgatccccgcgcgccctcgttgctcccggcctcgggccaaatgcggcggccccggtggaagcttgagcggccggcgctccgtttgctcgcagggcgcgcgcccacggcctccctcccccccgaatcgcccggcagcggcaggttaattaggagttattttattacccaaaaatggttcatcaaaagccagatgaggcgacagcagatgaaaccagcatctcgacacagcctccctcctataatctatctcaagcgccacctgtgtacaaagtcgggtatcctcctcagaagaacctcaccacagagtttacgaacacactgagggagacattcttccatgacaatccactaaagcagtataaggaccaatctggatcgacaaagtttaaaatgggtttgcagttcttgttcccagtctttgattggggtaggacttacaacttgagcaagttcaaaggtgatctgattgccggattgacaatcgcgagtctctgcatccctcaggatattggctactcaaagcttgcttatctggatccacagtatgggctttactccagctttgtccccccattgatatatgctgcaatgggtagctcaagggatatagcaattgggccagttgcagtggtatctcttctaataggttcactcctacaaaatgaagttgatcatgaaaagaacaaggaagaatacttgtgtcttgcttttacggcaaccttctttgctggtattactcaagcagccctgggatttctaaggttaggattcctcatagagttcttgtcgcatgctgcaattgtcggattcatgggaggagcagcaatcactattgccctgcagcagctcaaatatgtgttgggaatcaggaacttcacaaaggaaactgatataatttctgttatgaagtctgtttggggctcggttcatcatgggtggaactggcagacagttgtgattggcttctctttcctcgcttttcttcttcttgcaaagtacattgggaaaagaaataagaagtatttctgggtgccagctattgctcctataacttctgtcattcttgctaccctttttgtataccttttccgtgctgacaaacatggtgttcaaattgtgaataatatcaagaagggcatcaacccatcatctctgcacaagatttatttcaccggtccatttgttgcaaaaggtttcaagatcggtgttgtctgcggcatgatcggtttgacggaagccgtggcgatcggaaggacatttgctgctgtgaagggctaccagttagatggaaacaaggagatggtagcacttggaacaatgaacattgtaggctcaatgacgtcttgctatgtcacaacaggttctttctcacgttctgcagtcaatttcatggctgggtgccgaacaccagtatctaatgttgttatgtcaatggttgtgcttctcaccttgttggtcatcacaccattgtttaagtatacgccaaatgcgatccttggatcaatcattatttctgctgtgattggccttgtggactatgaagcagcaattctcatttggaaagttgacaaaatggatttcatcgcctgcatgggagcattctttggtgtggttttcaaatctgttgagataggcctcttaattgctgtgtcaatttcatttgccaaaatacttcttcaagtaacaagaccaaggactgcactgctcggaaaccttccaggcaccacaatttacaggaacacggatcagtatccagatgcaaggcatgttcctggggtggtaatagtgagggttgattccgctatctatttctccaactccaattatatccgggagagaattcttaggtggttgacagatgaagagaaagtcaaggcagagggactgtctaaaatcaatttcttgatagtggagatgtcacctgttatagatattgacacaagtggtatacatgcccttgaagatctgcacaagaatcttcagaagagaagcattcagctcctcctatcaaatcctggctccatcgtcattgagaagctccagtcgtcgaaactaactgagcacatcggaagcaatcacattttcctgacagttgctgacgccgtgcgtttctgcacttcaaagtcgatgcaagagccctgaactgaaatggatttacgtcaggcatcttgctgatgtttgtgccaaatttggttatctacacatctgcattctagtatataaaacatgtaatgacgttacaagatcacaaatcatctatgatatgcagatacttcgcg

SEQ ID NO: 11355 - protein, 656 aa, Panicum virgatum
  misc_feature: Ceres CLONE 1727699
  misc_feature (193)..(504): Pfam Name: Sulfate_transp Pfam Description: Sulfate transporter family
  misc_feature (527)..(644): Pfam Name: STAS Pfam Description: STAS domain
MVHQKPDEATADETSISTQPPSYNLSQAPPVYKVGYPPQKNLTTEFTNTLRETFFHDNPLKQYKDQSGSTKFKMGLQFLFPVFDWGRTYNLSKFKGDLIAGLTIASLCIPQDIGYSKLAYLDPQYGLYSSFVPPLIYAAMGSSRDIAIGPVAVVSLLIGSLLQNEVDHEKNKEEYLCLAFTATFFAGITQAALGFLRLGFLIEFLSHAAIVGFMGGAAITIALQQLKYVLGIRNFTKETDIISVMKSVWGSVHHGWNWQTVVIGFSFLAFLLLAKYIGKRNKKYFWVPAIAPITSVILATLFVYLFRADKHGVQIVNNIKKGINPSSLHKIYFTGPFVAKGFKIGVVCGMIGLTEAVAIGRTFAAVKGYQLDGNKEMVALGTMNIVGSMTSCYVTTGSFSRSAVNFMAGCRTPVSNVVMSMVVLLTLLVITPLFKYTPNAILGSIIISAVIGLVDYEAAILIWKVDKMDFIACMGAFFGVVFKSVEIGLLIAVSISFAKILLQVTRPRTALLGNLPGTTIYRNTDQYPDARHVPGVVIVRVDSAIYFSNSNYIRERILRWLTDEEKVKAEGLSKINFLIVEMSPVIDIDTSGIHALEDLHKNLQKRSIQLLLSNPGSIVIEKLQSSKLTEHIGSNHIFLTVADAVRFCTSKSMQEP

SEQ ID NO: 11356 - DNA, 2091 bp, Panicum virgatum
  misc_feature: Ceres CLONE 1727705
  misc_feature: Encodes the peptide sequence at SEQ ID NO. 11357
aggacaggcagcgcagcccgcccgaccggagagcgctgcggcctgcctgtgccgctgatccatcgcggacgccgcgagcgcgcgctcctcctaggctaggactagctcattcgtttgcgtgggttcctgatccgtcggtggagaaccaatggccattgcgcgggtcgccgaggatgtggaggccggggtggtcggggccggcggcggcgggggcggcgtgggcggcgaggtgacggagctgctcctccggcgctgcggcaaggaggaggacgcggactccaagatccgggacgaggcggaggcgtccgagtgcgggagcgaggggcgcctgcaggcggacgacggagggtccctgcggatggtcctcgtctccaccgccgtcgccgtctgcggctccttcgagttcggcacctgcgtcggctattcggcacctacgcagtcagggatcatagatgaagtcgggctctctatctctgagtttgcaatttttggatctatattgacaattggagcaatgattggtgctgtaactagtgggcgcctagcagattttcttggacgtaaaatgaccatgcggatatcagctacaatttgcatgtttggttggctttctatacatttggctaagagtgctatcatgctctgtttcggcagaatcttgttgggctttagtactggagttctttcttatgtggtgcctgtgttcatagctgaaatagcaccaaagaatctccgaggggggcttgcaacttcaaaccagctgttgatatgttctggaagctcagctacctacataataggggccttggttgcatggcgcaatttggtactagtgggtttagtgccttgtgtcctcctgctaggtggccttttcttcattccggagtctccaaggtggctggctaatgtcggaagggaaaaagaatttcacgcctcattgcaaaagttactaggagaggatgctgacatatctgaagaagcaattgagattaaagagtatattgaatcgctccgtagctttccgaaggccaggcttgaagacttgtttctcagcaaaaatatatatgctgtcattgtgggtgttggcttgatggtttttcagcaactgggagggataaatggtgtcggcttctatgcaagctatatcttcagttctgcaggattttctggaaaacttggaaccatcttgattggcattattcagattccaatcacattgttcggggccattctcatggataggagtggaagaagggttcttctgatggtctccgcatctggaacatttttgggctgcttcctgactgggatatccttctacctgaaggcacaaggacttttcccagaatgggttcccacattggctctttccggcatactggtgtacataggggcatactcgattggaatgggtcctgtcccatgggtagtcatgtctgagatattctcaatcaacatgaaagcaattggtggaagcttggtgacccttgttagctggttgggttccttcgcgatttcttactcgtttagcttcctcatggactggagctctgcagggaccttcttcatgttctctgcagccagcttggtcactatactctttgtggcgaagctggtccccgagaccaagggaagaacacttgagcagattcaagactctctaaactccagtagataataatgaatttacaccacacagcagaagaattataagatgcaaaattatatacatacacggcggccttcaccattggatttctgcccattgcaggagcctggagatagaagaagcaattttcacctcctcccatttccccttcccttctcccctgcttgtctccctgtatctgtagtgtttagtgtaccatctgtagtttaaggacgacgcagactgagattatgtagtatgtaccatgcccctccagattattgagcagcagctgaaacgacattatataccatgtacctccagattaatgagtgttgaagtataagtaaattgtcctctcatcaacgtaagattttgggttgaattggttggtttacagtatgcaactcaataatgagcatcacattttatcttgaccatgt

SEQ ID NO: 11357 - protein, 509 aa, Panicum virgatum
  misc_feature: Ceres CLONE 1727705
  misc_feature (74)..(505): Pfam Name: Sugar_tr Pfam Description: Sugar (and other) transporter
MAIARVAEDVEAGVVGAGGGGGGVGGEVTELLLRRCGKEEDADSKIRDEAEASECGSEGRLQADDGGSLRMVLVSTAVAVCGSFEFGTCVGYSAPTQSGIIDEVGLSISEFAIFGSILTIGAMIGAVTSGRLADFLGRKMTMRISATICMFGWLSIHLAKSAIMLCFGRILLGFSTGVLSYVVPVFIAEIAPKNLRGGLATSNQLLICSGSSATYIIGALVAWRNLVLVGLVPCVLLLGGLFFIPESPRWLANVGREKEFHASLQKLLGEDADISEEAIEIKEYIESLRSFPKARLEDLFLSKNIYAVIVGVGLMVFQQLGGINGVGFYASYIFSSAGFSGKLGTILIGIIQIPITLFGAILMDRSGRRVLLMVSASGTFLGCFLTGISFYLKAQGLFPEWVPTLALSGILVYIGAYSIGMGPVPWVVMSEIFSINMKAIGGSLVTLVSWLGSFAISYSFSFLMDWSSAGTFFMFSAASLVTILFVAKLVPETKGRTLEQIQDSLNSSR

SEQ ID NO: 11358 - DNA, 1862 bp, Panicum virgatum
  misc_feature: Ceres CLONE 1727713
  misc_feature: Encodes the peptide sequence at SEQ ID NO. 11359
atccaaccagcccaccatcatcaggtcagagtcacccattcagtcatcactccgtcttctccccgcttcactcgagagctgaggaagaaaatggttcttggggcgttggcaagtcaagtcgcctcaacgccatggagcttcctcatctgcggtctcctgggcgccctgctcctgcggcaggccgcccggctgctggagcgcctgtggtgggggccgcggcgcctcgagcgggcgctgcgcgcgcagggcctccgcggcacgccgtaccgcttcctcaccggcgacctcaaggagtacggccggtccaaccgggaggcctggtccaggccgctgccgctgcggtgccacgacatcgccgcccatgtcgcgccgttcatccacggcgccgtccgggagcacggcagcatgtgcttcacgtggttcggcccgatgccccgggtgaccatcaccgacccggacctggccagggacgtcatgtccaacaagttcggccacttcgagaagcccaagttcccggcgctgtccaagctgttcgccgatggtgtggccaactacgagggcgagaaatgggtgaagcacaggaggatcctcaaccccgcgttccatctcgagaagctcaagctcatgttgccggcattttcggcgtgctgcgaagagcttgtcagcagatgggcgcagtcccttggccctgacggctcctgcgagctggatgttgagccggagcttcagaccctcaccggagatgtcatctcccgcaccgcattcggcagcagctaccttgaaggaaggaagattttcgagctgcagaacgagcaagtcgagcgcctcatgtccatcattcagaagtttggcattccgggatacatgtcgttgcctaccaaaaacaaccgaaggatgcgccaaatcaagaacgaggtcgaaacgattctccgaggcctgattggcaaaagaatgcaagccatgaaagaaggcgagcccaccaaagacgacctactgggcatcttgctggagtcaaacatgagggacacggccgagaacggccagtccagcctcgggatgacgatcgaagacgtcatggaggagtgcaagctgttctacttcgcggggatggagacgacgtcagtgctgctgacgtggacaatgatcctactcagcatgcacccggagtggcaggaccgtgcaagggaggaagtgattggcttatttggcaagaacaagcccgaatacgatggcctgagccgtctcaaaatcgtgaccatgattcttcacgaggtcctccggctgtacccgccggccatcgcgttcagcaggaagacgtacaaggagatggtggtcggcgacgccacgtaccctgccggcgtgatcctggagctgcccgttctgttcatccaccacgaccccgagatctgggggagcgatgtgcacgagttcaggccggaaaggttcgcggaggggatcgccggggcgtccaaggatcggctggcgttcttcccgttcgggtgggggccgaggatctgcatcggccagaacttcgcgctgctcgaggccaaaatggcgctgagcatgatcctccagagcttcgagttcgagctcgcgccggcgtatacccatgcgccccacacagtggcaatgctgaggccgatgcatggtgcccagatcaagctcagagcaatatgattggccccctgtgtatctatcagtcagtgtggtgtggtccaacgggctttgggctttcacgtcagcccatagagttgtgtgcaattgggcctttagccttttcacgtgttttgttttatttgattcaataaccggtgtcgtgtcattgtatcctaggctaagaaatgaagaaaaaagattgtatc

SEQ ID NO: 11359 - protein, 528 aa, Panicum virgatum
  misc_feature: Ceres CLONE 1727713
  misc_feature (80)..(525): Pfam Name: p450 Pfam Description: Cytochrome P450
  misc_feature: SWISSPROT Homolog: EC 1.3.3.9 Secologanin synthase
  misc_feature: Useful for making plants with modulated cold sensitivity
  misc_feature: Useful for making plants with modulated nitrogen use efficiency
  misc_feature: Useful for biocontainment applications
  misc_feature: Useful for making plants with modulated biomass
  misc_feature: Useful for making plants with modulated flowering time
MVLGALASQVASTPWSFLICGLLGALLLRQAARLLERLWWGPRRLERALRAQGLRGTPYRFLTGDLKEYGRSNREAWSRPLPLRCHDIAAHVAPFIHGAVREHGSMCFTWFGPMPRVTITDPDLARDVMSNKFGHFEKPKFPALSKLFADGVANYEGEKWVKHRRILNPAFHLEKLKLMLPAFSACCEELVSRWAQSLGPDGSCELDVEPELQTLTGDVISRTAFGSSYLEGRKIFELQNEQVERLMSIIQKFGIPGYMSLPTKNNRRMRQIKNEVETILRGLIGKRMQAMKEGEPTKDDLLGILLESNMRDTAENGQSSLGMTIEDVMEECKLFYFAGMETTSVLLTWTMILLSMHPEWQDRAREEVIGLFGKNKPEYDGLSRLKIVTMILHEVLRLYPPAIAFSRKTYKEMVVGDATYPAGVILELPVLFIHHDPEIWGSDVHEFRPERFAEGIAGASKDRLAFFPFGWGPRICIGQNFALLEAKMALSMILQSFEFELAPAYTHAPHTVAMLRPMHGAQIKLRAI

SEQ ID NO: 11360 - DNA, 1820 bp, Panicum virgatum
  misc_feature: Ceres CLONE 1727716
  misc_feature: Encodes the peptide sequence at SEQ ID NO. 11361
gcttccattccaatttccgccaataatggaggtcacgcgcatgctaacaatgtccatggccacggcagtgatggtcaccgtcgtcgtcatcctcgtgctcggctccctcgggaggccgcgccgcagccagcggaagacgctgaacctcccgccgggcccaaggggctggccggtgttcggcagcttgctgagcttgctcgcagacacgctccccccgcaccgcgtgctggccgcgctcgcggcgcgctacggcccgctcatgcacctccggctcggctccttcgacgtcgtggtcgcctcctccgcggaggcggcgcggctcgtcctcaagacccacgacctcgccttcgccgaccgcccgcccacggccttcggcaagatcctcggctacgactacaagggcatcgtgcagacgccctacgggccctactggcgcatggcgcgcaagctctgcgccacggagctcttctccgcgcggcgcatcgacgcgttcgagcgcgcccgcgcgcaggagatgcgcgccctgacgcgcggcctgttcgagcgcgccggcgccaccgtgcaggtgaaggagcacctgctgagcttcacgatgcgcaacatcctccgcatggcgctgggggagaaatggtcgtcgggctcctgcaatagccacgacggcggcgacggcgaggcgttccggcgatcgctcaaggagtccttcatggtgacgggtttgctgggcaatgttggggagtgggtgccgtggctcggctggctcgacgcgcagggtttcgtccggcggatgaagcgggtgcacgcgatgttcgaccggttcaacgagcagatcctcaacgagcaccagaacggccggcggcgtgctggggcggggtcggagatggacctggtggacgtgctgctgcaactggccgaggacggggaggaggcggcggagcggccgccggagaccaggctcactcgcgacggcgtcaaggccttcctcctggacatcatcggcggcggcacggagaccgcggcggcgacgttggagtggtccgtgctggagctcctccgccacccggccgccatggcggccgccaccgacgcgctcgaccgcacggtggggcgcggccgctgggtcaccgagagggacctgccggagctcccgtacatcgaggccgtcgtgaaggagacgatgcggctgcaccccgtgggtcccctcctcatcccgcaccacgcccgcgaggacacggtggtcggcggctacgacgtccccgccggcgcgcgcgtgctggtgaacatgtgggccgtggggcgcgacccggcgtcgtggcctgaggcgcccggcgcgttccggccggagcggttcctcgccgggggcagcgccgagggggtggacgtgcacggggcgcacttccagctgctgccgttcgggtccgggcggcggatgtgcccggcgcacagcctcgcgatgaaggagatggtggcggcgctggcgaaccttgtgcaggggttctcatggcggctgccggacggggtggcacccgaggagatgagcatggaggaattctttggactgaacgtgagtcggaaggagccgctcgttgccatcgccgagccaaggctgccggcgcacctctacgccgctgtcgacgactagccatatcctggtttatgtatggaccacgccgcgtccgtatacaagtattgggacacgttaaacgtcaagtgattcgtatcgattatctcgtatttgtaaatgagtaccaagtacacttttatttttatccctaaactatgtcacgccatcattttgcaacatcaaattctcaagattgtcc

SEQ ID NO: 11361 - protein, 537 aa, Panicum virgatum
  misc_feature: Ceres CLONE 1727716
  misc_feature (42)..(520): Pfam Name: p450 Pfam Description: Cytochrome P450
  misc_feature: SWISSPROT Homolog: EC 1.14.13.21 Flavonoid 3'-monooxygenase
  misc_feature: Useful for making plants with altered carbohydrate content
MEVTRMLTMSMATAVMVTVVVILVLGSLGRPRRSQRKTLNLPPGPRGWPVFGSLLSLLADTLPPHRVLAALAARYGPLMHLRLGSFDVVVASSAEAARLVLKTHDLAFADRPPTAFGKILGYDYKGIVQTPYGPYWRMARKLCATELFSARRIDAFERARAQEMRALTRGLFERAGATVQVKEHLLSFTMRNILRMALGEKWSSGSCNSHDGGDGEAFRRSLKESFMVTGLLGNVGEWVPWLGWLDAQGFVRRMKRVHAMFDRFNEQILNEHQNGRRRAGAGSEMDLVDVLLQLAEDGEEAAERPPETRLTRDGVKAFLLDIIGGGTETAAATLEWSVLELLRHPAAMAAATDALDRTVGRGRWVTERDLPELPYIEAVVKETMRLHPVGPLLIPHHAREDTVVGGYDVPAGARVLVNMWAVGRDPASWPEAPGAFRPERFLAGGSAEGVDVHGAHFQLLPFGSGRRMCPAHSLAMKEMVAALANLVQGFSWRLPDGVAPEEMSMEEFFGLNVSRKEPLVAIAEPRLPAHLYAAVDD

SEQ ID NO: 11362 - DNA, 1781 bp, Panicum virgatum
  misc_feature: Ceres CLONE 1727718
  misc_feature: Encodes the peptide sequence at SEQ ID NO. 11363
gcccgtcgcccactcgatcgcgccggtcgcggtcgcgctcctcgtgctccgtcccgcaccatcccggtcgcggggagattgccaggagaacgccggcgcgccgcgccgaaccggctggttctctcggctcgcgtgaaaagcgcgggagcagcctcgtcgtttccctcgtcttccgccaccgacgctttcccgtgatcctcaggatccgggagatggcagcggcaggtccgccacgcgccgcgcggggcctcgcgttcctctgcttcctggtctcgtgcgccgcgctcgcgggagcaagccggccgagccgggaggacctcgacgtcagcctcggcggcggcggcggcggcggcgtcggcatcggcatcggcattggcggcggcggcggccagggaggcagcagcccggcgccgtcgcagtcgggtccccgggcgtgcgacttcgagaacgagcggctgtaccgggcgtacctggtgatccagcagttcaggcagacggtgtcgtgcgacccgatggacatcacccgcagctggagcggcaccgacctgtgctccagctacaagggcttcttctgcgagcggccgcccaacgtgacggaccggaccatcgcgtccgtcgacttcaacgggtacatgctgcgctccgactccctgcggggcttcgtcgacggcctcccggacctggcgctcttccacgccaactccaacgacttcggcggcgccgtcccggcgctgggcggcctgcagtacttctacgagctggacctcagcaacaacaggctcgcgccggcgccgttccccgccgacgtgctggggctcaccaacgccaccttcatcgacctccggttcaacagcttctacggcgagctccccgccggcgtcttttgcaggttcccgcggatccaggccatcttcgtcaacaacaaccagttctccggcagcctgccggacaacatcgggcagtcgccggtgaactacctctccctcgccaacaacaggttcacgggggagatacccaggtccatcgcccgcaacgccggcacgctcctcgaggtgctcttcctcaacaacagcctcagcgggtgcctcccctacgagctcggcctgctcgagaaggccacggtcatcgacgccggcaccaaccggctcacgggcgccatcccggcgtcgttcgcgtgcctgcgcaaggtggagcagctcaacctggcggacaacctcctgtacggcgaggtgcccgacgcgctctgccggctcgcgttcggccacctcaagaacctcacgctctccggcaactacttcacggcgctcgggtcctgctgctgggacctgatcaaggaagggaggctcaacgtcgaccgcaactgcatccagtgggcgcccaaccaacgctcgcacgaggagtgcgccaggttcctccgccagcccaagtcgtgccccgtcagcgactacgtgccgtgccgccccaaataccgcggctccggcgagccggacgccggcgaggccgcagaggaggaggacgcgcgcgcggcagtggagtacaaataccggacgtactcggcgctgcatccttgaggtcccgacctgggccggtcgtcgacggcgaggccactgcacaggctgaaaaagcgcagagcgccgctgtgcgtctcgtgaccgtgaaacagcaactgatcagtagtcggtcgcttggcccgttgttttggtgtgttgtgtccctgtccagcaatgttccccttgtgtctgatgatgatcaatccactgtattatggccttcttgagttc

SEQ ID NO: 11363 - protein, 452 aa, Panicum virgatum
  misc_feature: Ceres CLONE 1727718
  misc_feature: SWISSPROT Homolog: EC 2.7.11.1 Non-specific serine/threonine protein kinase
MAAAGPPRAARGLAFLCFLVSCAALAGASRPSREDLDVSLGGGGGGGVGIGIGIGGGGGQGGSSPAPSQSGPRACDFENERLYRAYLVIQQFRQTVSCDPMDITRSWSGTDLCSSYKGFFCERPPNVTDRTIASVDFNGYMLRSDSLRGFVDGLPDLALFHANSNDFGGAVPALGGLQYFYELDLSNNRLAPAPFPADVLGLTNATFIDLRFNSFYGELPAGVFCRFPRIQAIFVNNNQFSGSLPDNIGQSPVNYLSLANNRFTGEIPRSIARNAGTLLEVLFLNNSLSGCLPYELGLLEKATVIDAGTNRLTGAIPASFACLRKVEQLNLADNLLYGEVPDALCRLAFGHLKNLTLSGNYFTALGSCCWDLIKEGRLNVDRNCIQWAPNQRSHEECARFLRQPKSCPVSDYVPCRPKYRGSGEPDAGEAAEEEDARAAVEYKYRTYSALHP

SEQ ID NO: 11364 - DNA, 2339 bp, Panicum virgatum
  misc_feature: Ceres CLONE 1727721
  misc_feature: Encodes the peptide sequence at SEQ ID NO. 11365
aagccaaccagcagagcccctgaatcctgatcgccctccactaaccgccgcacctcctctggaggagaccaaaaggccgagcacgccagcagccacacagagatcagagagagagagagaaagagagagagagagagagagagagagagattactactgctaaaaggctcgcgagcaagcaagctagtcaaaacgtacttgcagctcgcgccggccggccaccaatcgccagaggacagcgcccctccctgcctgtatcttctacctccaacagcgggaacgagggagggagaggcggcacgcgcgcgcgcgatcgagctttatagccccccgccccggatcatcggtccaccgccgccgtcatgtgcaacgccgccgggagcgacaccgccttgccgccggcgccggcgcctttgccgccgctcggctccttcatggcctccgcgcaccagctcctccgccccgtcgacggcgacgacgccggcggccatgcgctgcagctctccaaggtggccggcgaggcgcgggcgatcggccgggtgtcggtgccgacggcggtgacggggctcgtcatgtactcgcgggcgctcatctccatgctcttcctggggcggctgggcgagctcgcgctcgccggcgggtcgctggcgctcggcttcgccaacatcaccggctactccgtgctctcgggcctcgcgctcggcatggagcccatctgcggccaggccttcggcgcgcgccgcggcaaactgctcgcgctcgcgctgcaccgcaccgtgctgctgctgctcgccgtcgcgctgcccatctccctcctgtgggtcacctccacggggtacatactcaagctgctgggacaggacgagggcgtcgcggacgccgcgcagacgttcgccgcgtacgcgtcggcggacctcgccgtgctggccgtgctgcacccgctgcgcgtctacctccggtcgcagaacctgacgcttcccatcacggcgtgctccctcttctccgtgctgctgcacgggcccatcaactacctcttcgtggagcgcctcggcatgggcgtcgccggggtggcgctcgccgtcgcgctcaccgacctcaacctgctcctcgcgctcctctgcttcctcgccatctcgggcgcgcacagggactcgtgggtgggccccacctccgactgcctccgcggctggccggcgctgctccgcctggcggtccccaccgccacggcggtctgcctcgagtggtggtggtacgagctcatgatcgtgctgtccgggctcctggccaacccgcgcgccaccgtggcgtccatgggcatcctcatccaggccacgtcgctcgtctacgtgttcccctcctcgctgggccagggcgcgtccacgcgcgtcagccaccagctcggcgcgggccgccccgggggcgctcagcgcgccgccggcgccgcgctctccatcggcgtcgccgtgggcctggcggccgccaccttcatggtgtccgtgcgcaaccactggggccgcatgttcacgtcggacgcggacatcctccggctgacggccgtggcgctccccatcgcggggctctgcgagctcggcaactgcccgcagacggccggctgcggcgtcctccgcggcagcgcccggccggccagcggcgcgcgcatcaacctggcctccttctacctggtgggcatgccggtgggcgtggcgctggcgttcggcgctcggctggggttcgccgggctgtggctgggcctcctggcggcgcaggccgcctgcgccgtctggatggcgcgcgcggtggcgggcaccgactgggacgtggaggtgtcgcgcgccaaggagctgaccaaagccagcaccagcaacaaccacagcagcgagtgcaacgccaccaccccggctagtgatgttaccactgtgatcgccactatcgccacaggcggcactactaccaacagcaatgccgccgccgccggctgcaagaacagcagcggctacgtgccggtcagcgagagcagcggcggcaacgacaacgagctggagaagctggaggccggcctgatgattcccagcgacgacgacgccaccagcgccaccggaggcgacacggatgccgtggttggggagaatcacggcggcagctgcagtagcagtagcagtggcggtgctggcacgacgacggcgacggagggaaaggagcagaggggcgggccggagcgggccccgctcctcagtgcgggggacsgagcgcagscacggcgacsgccaaggaggcggccaggtctaagccgcgcggtgatctgctccattcaatccatcattaatctcgccgctcactct

SEQ ID NO: 11365 - protein, 658 aa, Panicum virgatum
  misc_feature: Ceres CLONE 1727721
  misc_feature (285)..(448): Pfam Name: MatE Pfam Description: MatE
  misc_feature (63)..(224): Pfam Name: MatE Pfam Description: MatE
  misc_feature: Useful for biocontainment applications
  misc_feature: Useful for making plants with modulated biomass
  misc_feature (628)..(628): Xaa is any aa, unknown, or other
  misc_feature (631)..(631): Xaa is any aa, unknown, or other
  misc_feature (634)..(634): Xaa is any aa, unknown, or other
MCNAAGSDTALPPAPAPLPPLGSFMASAHQLLRPVDGDDAGGHALQLSKVAGEARAIGRVSVPTAVTGLVMYSRALISMLFLGRLGELALAGGSLALGFANITGYSVLSGLALGMEPICGQAFGARRGKLLALALHRTVLLLLAVALPISLLWVTSTGYILKLLGQDEGVADAAQTFAAYASADLAVLAVLHPLRVYLRSQNLTLPITACSLFSVLLHGPINYLFVERLGMGVAGVALAVALTDLNLLLALLCFLAISGAHRDSWVGPTSDCLRGWPALLRLAVPTATAVCLEWWWYELMIVLSGLLANPRATVASMGILIQATSLVYVFPSSLGQGASTRVSHQLGAGRPGGAQRAAGAALSIGVAVGLAAATFMVSVRNHWGRMFTSDADILRLTAVALPIAGLCELGNCPQTAGCGVLRGSARPASGARINLASFYLVGMPVGVALAFGARLGFAGLWLGLLAAQAACAVWMARAVAGTDWDVEVSRAKELTKASTSNNHSSECNATTPASDVTTVIATIATGGTTTNSNAAAAGCKNSSGYVPVSESSGGNDNELEKLEAGLMIPSDDDATSATGGDTDAVVGENHGGSCSSSSSGGAGTTTATEGKEQRGGPERAPLLSAGDXAQXRRXPRRRPGLSRAVICSIQSIINLAAH

SEQ ID NO: 11366 - DNA, 1870 bp, Panicum virgatum
  misc_feature: Ceres CLONE 1727724
  misc_feature: Encodes the peptide sequence at SEQ ID NO. 11367
acctgcgctgccggcgccgcgcccgagacggccgcaaacgccaagccccaaaggcccaaaccacgcggcggcggagcaatgcggcgggggagggggacgcggctctacagcctcctgggcgtcctcctcctcctggccctcgcgtacttcaactggctccccgcgggccgcgggccccccggcggcggcggcggccccggcgggttcaagctccccgtgccgtggctgcagccgcggatgtccttcgcgggccgcgccggcacccacttcgtcgacgccggcaccggcgcgccgctctacgtcaacggctggaactcctactggctcctttcggctcggtcgcccgcgctggccgccgagatgctgcgccgcggccggcgcatggggctcacggtctgccgcacgtgggccttcagcgacggcgggcccggcgcgctccagatctcccccggccggttcagcgagcccgtcttccagatgctggattatgtgatatatgaggcccgaagaaatcatattagattgattctatgccttgtcaataaccttgataactttggagggaaggctcaatatgttcagtgggcacaagcagctggtgctaatgtgacgaattctacagattcctttttctctcacccaactattagacgttactacaaggagtatgtaaaggtgatattaacaagaagaaattcttatagtggaatcaaatactgtgatgaacctgctatatttgcttgggaactcataaatgagcctaggtgcgtgtctaattcatctggtcctcatattcaggcttggatagaagaaatggcagcatatgttaagagtttggacacgaagcatcttgtcacagttggtattgaaggattttatggccctggcagatctgagaggctgggtgtcaatcctggagactgggcagcttcactctgctcagacttcatacagaactcagctgtcaaagatattgattttgcctcagttcatgcttatcctgatagctggctaccgaaagcaagcttggaagaaaaagtcatgtacctttctaactgggttgattcgcacttgaatgacagtgaatacatcttgagaaagccggtcctgttttcagaagtagggtacctccagcatccagaagtgaacagcacagtcaatggagacactgttctaaaacttgtttatgataaaatatacaattcagcaaaaaagctgcaggcaggaggtggtgctcttatttggcaattgatggttgaagggagtcagatgtacaacgatggcttctccatggtggcacgtgatcgtccctcaacatataagttgataaaggagcagtcatgccgactgcaaagattatatggaaaaagaggatgacccaggctggaaatgttcattactgccctagggatttatctactgtcgatattgaagcgccccactttgtcaaacacaagcgggatttcttgagtcaatcttgaagatggcattgctgaggcaaacgtgaacagagatctttatagtgaacatcttgttattatagctaagagctagactgctagtgaagaatccacttttggcagcaaacatgttgatattttccggtggctgaagttttgatctgtggtggcccagtcttgattttccagcatatggttggtgttggtcagctatggccaaaagaggtatatacattttactttttcattaggtatttatgtagttttgatagcaaacttatattatacaggtagtggaattagtttctgaacttgtagtcatactagtgagtatattctagcaaaacttgtagtcaaacttaggttttagaaaccgtatcgatgttacaagcaacacttacttgtggctc

SEQ ID NO: 11367 - protein, 432 aa, Panicum virgatum
  misc_feature: Ceres CLONE 1727724
  misc_feature: SWISSPROT Homolog: EC 3.2.1.78 Mannan endo-1,4-beta-mannosidase
MRRGRGTRLYSLLGVLLLLALAYFNWLPAGRGPPGGGGGPGGFKLPVPWLQPRMSFAGRAGTHFVDAGTGAPLYVNGWNSYWLLSARSPALAAEMLRRGRRMGLTVCRTWAFSDGGPGALQISPGRFSEPVFQMLDYVIYEARRNHIRLILCLVNNLDNFGGKAQYVQWAQAAGANVTNSTDSFFSHPTIRRYYKEYVKVILTRRNSYSGIKYCDEPAIFAWELINEPRCVSNSSGPHIQAWIEEMAAYVKSLDTKHLVTVGIEGFYGPGRSERLGVNPGDWAASLCSDFIQNSAVKDIDFASVHAYPDSWLPKASLEEKVMYLSNWVDSHLNDSEYILRKPVLFSEVGYLQHPEVNSTVNGDTVLKLVYDKIYNSAKKLQAGGGALIWQLMVEGSQMYNDGFSMVARDRPSTYKLIKEQSCRLQRLYGKRG

SEQ ID NO: 11368 - DNA, 1253 bp, Panicum virgatum
  misc_feature: Ceres CLONE 1727725
  misc_feature: Encodes the peptide sequence at SEQ ID NO. 11369
aatcccgcggtcccgtctcatctcctccccgcgcccgcgccctcgcggccgcgcgggcaccacccgccaggatggcagcggggccgaccccatccgccacggccgcgtcgttccggccgccgatcccgccgccgccgccgtgcttcgactaccgcgcggccgtgctcgccgacacgcgcgccgcggcggcggcggcgggcaacccggcgctggccgcgctggtcagtccggcgcgctcgtgcgcgtcccgcggcggcggttcggcccggtcccggcgtggcgcccgccggacttcgtggagcccgaggaggtctggatcctcggcacgtcgcacctctccccggagtccgtcgccgacgtcgagcgcgtcctccgcgccgtccagcccgacaacgtcgtcgtcgagctctgccggagcagagctgggattatgtacgtgtccaccgatgcttccgacgagccgctcttgaagtccaacatgttctctctcggcggcgccaagttcttcggtgcagtcaaccgaagcatcaacctcggtgggcagagtgctcttgctctgcgtttgctcctcgccgttttctcttcaaagatttcttccggcgcgaaccggccgttcggagaggagtttcgagcagctaggaaggtgtctgaagacatcggtgctcagcttgttcttggggatcgcccgattgaaataactcttgaacgagcatggaagtctctcacctgggatcagaaaacaaagctagtaatctcattgtttcgtggtattacttcgacaactgacacgccacaggatgagaaaactgcggtcagcccatacgagttgtaccagaaactgagcacatcatatccctcgctgttgcaacctctcatacatgaacgcgacatgttccttgcatggtcactgaagaggagcaaagctgtgaacaagagcaaaactgttgtcggagtcgtagggaaggggcacatgaatggtatagtgtacgcgttgatctctgaccagggggacttgaggttccgcgaccttgttggcagagcatcatctgacacctgggtcagctcactcatcaagggcctggtcagggacacaataataggattggctctctgggctttgtatgaacagctgcaggctgtgctatagatagctgacgatgttgtgaattccgggtctgctgttgattttgcagtctgaagcttttgtgaattctgggcctgctgtttatataaaactccacaggatcaaatcc

SEQ ID NO: 11369 - protein, 381 aa, Panicum virgatum
  misc_feature: Ceres CLONE 1727725
  misc_feature (99)..(340): Pfam Name: TraB Pfam Description: TraB family
IPRSRLISSPRPRPRGRAGTTRQDGSGADPIRHGRVVPAADPAAAAVLRLPRGRARRHARRGGGGGQPGAGRAGQSGALVRVPRRRFGPVPAWRPPDFVEPEEVWILGTSHLSPESVADVERVLRAVQPDNVVVELCRSRAGIMYVSTDASDEPLLKSNMFSLGGAKFFGAVNRSINLGGQSALALRLLLAVFSSKISSGANRPFGEEFRAARKVSEDIGAQLVLGDRPIEITLERAWKSLTWDQKTKLVISLFRGITSTTDTPQDEKTAVSPYELYQKLSTSYPSLLQPLIHERDMFLAWSLKRSKAVNKSKTVVGVVGKGHMNGIVYALISDQGDLRFRDLVGRASSDTWVSSLIKGLVRDTIIGLALWALYEQLQAVL

SEQ ID NO: 11370 - DNA, 749 bp, Panicum virgatum
  misc_feature: Ceres CLONE 1727728
  misc_feature: Encodes the peptide sequence at SEQ ID NO. 11371
cttgcggcggctacctctccctctcctcttccgtctcgccgccggccgccgcaggcggaacccctctccgcctcgccctctccaacgccgaatatccccgggtggagggggtatttggtttgttacaacagatagtcgtgggctgctgattcgaggaggatatgttggtgctattcgagacccccgcggggttcgccctcttcaaggtgctggatgaggggaagctcgacaaggtcgaggatctatggaaggagttcacaacatcggactcggcaagaagggtggttgagctgaaggctttcaacaagtttgagaacacatctgacgctctctctgctgcaaccctaattattgatagcaagcctagcaagggtctgcgcaagttcttgcagaagcactgcgagggtgaaacattagctgttgctgattctaagcttggaaatgctataaaggaaaagctgaaaattgactgcgttcacaacggtgctgtgatggagctgatgagagggctgagaaatcagctcactgagcttataactgggctgggtgcacaagaccttggtccgatgagcttgggactgtcacacagcctgtctaggtataagctgaagttcagtcctgagaaggttgataccatgatcattcaggccattggcttattggatgatcttgacaaagagcttaacacttatgctatgagggttcgtgaatggtatggttggcactttccagagctcactaaaatagtc

SEQ ID NO: 11371 - protein, 195 aa, Panicum virgatum
  misc_feature: Ceres CLONE 1727728
  misc_feature (1)..(66): Pfam Name: NOP5NT Pfam Description: NOP5NT (NUC127) domain
  misc_feature (159)..(195): Pfam Name: NOSIC Pfam Description: NOSIC (NUC001) domain
MLVLFETPAGFALFKVLDEGKLDKVEDLWKEFTTSDSARRVVELKAFNKFENTSDALSAATLIIDSKPSKGLRKFLQKHCEGETLAVADSKLGNAIKEKLKIDCVHNGAVMELMRGLRNQLTELITGLGAQDLGPMSLGLSHSLSRYKLKFSPEKVDTMIIQAIGLLDDLDKELNTYAMRVREWYGWHFPELTKI

SEQ ID NO: 11372 - DNA, 635 bp, Panicum virgatum
  misc_feature: Ceres CLONE 1727728-R
  misc_feature: Encodes the peptide sequence at SEQ ID NO. 11373
aaagcaggatgaacactattgcaccaaatctgaccgcactcgtgggtgaattagttggtgctcgccttattgcacatggtggcagtttgctaaatttagccaagcagcctggcagcacaattcagatacttggtgcagagaaggctttattcagagctctaaagacgaagcattctacacctaagtatggcctcatctaccatgcatccttaattggcaaggcatctcaaaagcacaagggaaagatctctcgttctcttgctgcgaaaactgctcttgccatccgatatgatgcccttggtgatggtgaggacaactccattggcacggagagtcggctcaagcttgagacacggcttcaagttcttgagaaaacagaatttgggaaatctgctggttccgcaaagggaaagcccaagatagaagcgtatgaaaaggacaggaagaagggtgctggggctttaattactcctgctaaggcatacaaccctgctgctgatgtttttcttggaaaattcactgaagaaacacctaagaagtctgaattggcttcaaagaagaggaaacatcatgatgtggagactgcaccgccaacagagcctgccgctgaagcaatccaggaggatggtgaccag

SEQ ID NO: 11373 - protein, 210 aa, Panicum virgatum
  misc_feature: Ceres CLONE 1727728-R
  misc_feature (1)..(125): Pfam Name: Nop Pfam Description: Putative snoRNA binding domain
SRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLEKTEFGKSAGSAKGKPKIEAYEKDRKKGAGALITPAKAYNPAADVFLGKFTEETPKKSELASKKRKHHDVETAPPTEPAAEAIQEDGD

SEQ ID NO: 11374 - DNA, 649 bp, Panicum virgatum
  misc_feature: Ceres CLONE 1727747
  misc_feature: Encodes the peptide sequence at SEQ ID NO. 11375
acccagcgacactcaacgaccatcacaattattcaatcctcgcatttgcagcgcccacaaacccgcgaagaaaggaaggaagagaagctgctcccgatggagaacgccgacgcccctcccgccgccgtgaagccgtcgctgtccaagaagccctcgccgtcgttccgcctccggaacggcagcctcaacgcgctgcggctgcgccgcgtgttcgacctcttcgaccgcaacggggacggcgagatcaccctcgacgagatggcctcggcgctcggggacgcgctgttcggccccatcccggaggcggtgcccgaggaggacgaggagggggacatgaaggaggcgttccgcgtgttcgacgaggacggcgacggctacatctcggccgccgaactccaggccgtgctcaagaagctcggcctgcccgaggcgcggaacctcgccacggtgcaggagatgatatgcaacgtcgacagcgaccgcgacggccgcgtcgacttcggcgagttcaagaacatgatgcaggggatcaccgtatggggcgcctagctgcagcgcccctgcgttgccagccctctactgtgtgttgacatgtatgtatctagctaggcagcgccttttcttctacccagcgcttcttcttcttctt

SEQ ID NO: 11375 - protein, 150 aa, Panicum virgatum
  misc_feature: Ceres CLONE 1727747
  misc_feature (79)..(107): Pfam Name: efhand Pfam Description: EF hand
  misc_feature (34)..(62): Pfam Name: efhand Pfam Description: EF hand
  misc_feature (117)..(145): Pfam Name: efhand Pfam Description: EF hand
  misc_feature: SWISSPROT Homolog: EC 2.7.11.1 Non-specific serine/threonine protein kinase
MENADAPPAAVKPSLSKKPSPSFRLRNGSLNALRLRRVFDLFDRNGDGEITLDEMASALGDALFGPIPEAVPEEDEEGDMKEAFRVFDEDGDGYISAAELQAVLKKLGLPEARNLATVQEMICNVDSDRDGRVDFGEFKNMMQGITVWGA

SEQ ID NO: 11376 - DNA, 1579 bp, Panicum virgatum
  misc_feature: Ceres CLONE 1727753
  misc_feature: Encodes the peptide sequence at SEQ ID NO. 11377
acccgtcgcaagattcacggcacgctccgcctttattcctcctcccgtcctccgagagctggaaggcgagccaaacccagcgcgccgcagcgatggccaccccggacgcggagcagccggcgccgatggagcccgcgcggtggcgtaacctggacatgctcctctcccgccccgggaacctcgtcgcggcatccttcgaccctagccccaccctccgggacctgctggggagcctcgtggaggtgctggtggtgggcgccggcgggctcggctgcgagctcctcaaggatctcgccctctccggcttcaagaagctgcacgtcattgacatggacaccatcgacgtctccaacctcaaccgccagttcctcttcagagttcaggatgttgggaagtccaaggctgaagtggcggcgaagagggttatggagagagttagtggggtgaacattgtgcctcatttttgcaggattgaagataaagagatagagttctacagtcagtttcacataattgtcctcggcctggattcaattgaagctcgaagctatatcaattccgtggcatgtggcttcttggagtatgatgcaaatgacaatccacttgaggagacagtcaaacctatggtagatggtggaactgaaggctttaagggtcatgcaagggtcataatacctggaacaacaccttgcttcgaatgcaatatatggctttttcctccccaggtcaagttccccttatgtaccctcgctgagacaccaagaactgcagctcactgcattgagtatgctcatctgatcaaatgggatgaggttcatcctggaaaaccttttgatgctgatgacgcagagcatatgcagtggatttattcagaggctttaaagagagcagagcttttcggtatttctgatgttacatattctttaactcagggtgttgtcaagaatataatcccagccattgcttcaacgaatgcaattatatctgctgcttgtgcactggaagccttcaagcttatttctgggtgcagcaaaaatgtctcaaactatctcacgtacaacggtctggaaggaactcatattaaagtaactgagtttgtcagagacaaagattgccttgtatgtgggcctggtacccttattgagctggatacatcatctactcttgcggagttcatcaagatgctcgaggagcaccccaagctgcggatatccaaggctagtgtgacgcacgaaggcaacaacctttacatgcagtcacctgaggtgctggagcagatgacgcggccaaacctgagcgtccccatgtttgagctcctcaaagaggccccgtacgcgactgtccacgccacgggcatggcggagaacaacgggaagagagtgtcgtcgctgaggaagctgcgcgtcgccttcaagggcgtcgaggcctcgaagatggacgtctccgagagctcgtaggcctccctgaggaaggtgaggacgcttttgagacgatcaaagtcaatcaagtgcattttgatcgaaattgagatgtacccttgatgataactttgtctaagaagaaaataggcacttggtcc

SEQ ID NO: 11377 - protein, 454 aa, Panicum virgatum
  misc_feature: Ceres CLONE 1727753
  misc_feature (47)..(193): Pfam Name: ThiF Pfam Description: ThiF family
  misc_feature (246)..(312): Pfam Name: UBACT Pfam Description: Repeat in ubiquitin-activating (UBA) protein
  misc_feature (350)..(441): Pfam Name: E2_bind Pfam Description: E2 binding domain
MATPDAEQPAPMEPARWRNLDMLLSRPGNLVAASFDPSPTLRDLLGSLVEVLVVGAGGLGCELLKDLALSGFKKLHVIDMDTIDVSNLNRQFLFRVQDVGKSKAEVAAKRVMERVSGVNIVPHFCRIEDKEIEFYSQFHIIVLGLDSIEARSYINSVACGFLEYDANDNPLEETVKPMVDGGTEGFKGHARVIIPGTTPCFECNIWLFPPQVKFPLCTLAETPRTAAHCIEYAHLIKWDEVHPGKPFDADDAEHMQWIYSEALKRAELFGISDVTYSLTQGVVKNIIPAIASTNAIISAACALEAFKLISGCSKNVSNYLTYNGLEGTHIKVTEFVRDKDCLVCGPGTLIELDTSSTLAEFIKMLEEHPKLRISKASVTHEGNNLYMQSPEVLEQMTRPNLSVPMFELLKEAPYATVHATGMAENNGKRVSSLRKLRVAFKGVEASKMDVSESS

SEQ ID NO: 11378 - DNA, 712 bp, Panicum virgatum
  misc_feature: Ceres CLONE 1727754
  misc_feature: Encodes the peptide sequence at SEQ ID NO. 11379
attccaacagcttcttccccccaaagaccactccggcgagcttcttcccagaccggccggcgaatcacagctcgatcgatcgttctccggcgagccagcaaccactccctgatcggaattcggaatggacttcggaggggcgctgcagctgccgccggggttccggttccacccgacggacgaggagctggtgacgcactacctcctgcgcaagtgcggcgggctggcgccggcggcgccggtgatcgcggaggtggacctgtacaagttcgacccgtggagcctgccggagcgggcggcgggcggggagaaggagtggtacttcttctcgccgcgggaccgcaagtaccccaacgggtcgcgccccaaccgcgccgccggcgccgggtactggaaggccaccggcgccgacaagcccgtgggcgcgccgcgccccgtcgccatcaagaaggcgctcgtcttctacgccggcaagccgcccaggggcgtcaagaccaactggatcatgcacgagtaccgcctcgccgacgtcgaccgctccgccgccgcccgcaagaagacggccaataacaacaacgcgctcaggctggatgactgggtgctgtgccggatctacaacaagaaaggcgtgatcgagcggtacgacacggtggacgacgacgaggtcgcggcggccaacgacgtcaagccggccgcgcccaagaacccgcgc

SEQ ID NO: 11379 - protein, 195 aa, Panicum virgatum
  misc_feature: Ceres CLONE 1727754
  misc_feature (9)..(134): Pfam Name: NAM Pfam Description: No apical meristem (NAM) protein
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: The sequence is a functional homolog of SEQ ID NO 854 in the 10/374,780 US patent application
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Useful for making plants with altered cell wall content and/or composition
  misc_feature: Useful for making plants with altered lignin content
  misc_feature: The sequence is a functional homolog of SEQ ID NO 851 in the 10/374,780 US patent application
  misc_feature: Useful for making plants with altered terpenoid content
  misc_feature: Useful for making plants with modulated water use efficiency
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated light quality response
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 1012 in the 11/435,388 US patent application
  misc_feature: The sequence is a functional homolog of SEQ ID NO 852 in the 10/374,780 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: Useful for making plants with modulated light quality sensitivity
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: Useful for making plants with modulated nitrogen use efficiency
  misc_feature: The sequence is a functional homolog of SEQ ID NO 612 in the 11/435,388 US patent application
  misc_feature: The sequence is a functional homolog of SEQ ID NO 476 in the 10/666,642 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
MDFGGALQLPPGFRFHPTDEELVTHYLLRKCGGLAPAAPVIAEVDLYKFDPWSLPERAAGGEKEWYFFSPRDRKYPNGSRPNRAAGAGYWKATGADKPVGAPRPVAIKKALVFYAGKPPRGVKTNWIMHEYRLADVDRSAAARKKTANNNNALRLDDWVLCRIYNKKGVIERYDTVDDDEVAAANDVKPAAPKNP

SEQ ID NO: 11380 - DNA, 714 bp, Panicum virgatum
  misc_feature: Ceres CLONE 1727754-R
tgggcaggcgacgacgggctcgtggtcctcgacgacggcggcgcggcgctcttcggcccgccgtcgccggggctcttcgcccgcgtcgacgccgccgcggccgtcgcgttcggggacatgttcgcctacctgcagaggccgttctgaatcctgatcagggaaagtgcagcgtccgccgccctgcgtctgcgtgcgtgctccaggcagccactgacatggtcgatgtccatccaggtcgtgtagctcggttcaggtgaagtcgtgagccggtctagccgtctaggtctagcgcaacgaagccgagatcaccatggcactcccagtagctgcagatcaaaggagaattgggcggcgggatcatccgaccgatgatcggcggtccggtgtccggttgccattcagatggccggatcgacgtgcagctgacagttgcacacgatcactgcacctgatcgcgcccttgcttctgggcagcagcagcagcagctacatggaaatgggtgtgccaagcatggtagatgagtggtgatcaaggctggtagagagctagctagccgtcggatcgggtctcgattaatctaacccgtcgggtttttgtcgcgttaagtagtagtaactgacaacttgacatgcctagtgaaatcaaaataataagcaccaaaatcaaatggaaagaaaaaaaggggaaatacaagttttggattcatggggcag

SEQ ID NO: 11381 - DNA, 1915 bp, Panicum virgatum
  misc_feature: Ceres CLONE 1727755
  misc_feature: Encodes the peptide sequence at SEQ ID NO. 11382
actctctctctgtctctctctctctccgccgccgctgccgcattgattacttgggatctgcacacctgcctcgtgccgagtttcggtgttgcgagttgtgagtgtgagcgccatggccgtggaggctgtgtccgggaacggcggcgaggcggtggcgccggtgaaggaggtgagcgccaaggtggaggccaaggaggcggctgcggtcaccaagaatgcgtcgttcagggaggagagcaacttcctggatgacctcaaggagagcgagcggaaggcgctcgccgagctccgcgacaaggtggaggccgccatcctggagggcaagctgttcgacgacggcaagccggaggtgaaggagaagagggaggccaagaagaaggccgagaaggcgcccgaggagaagaaagaggaggaggaggaagggaagaaggagcccgaagccgtggagaagaaaggggaggaggacgccaagaaggaggccgaggtcgagggcaagaaagaggaggaagaaagcaagaaagaggctgagaaggagatggagcaggaggaagctggcgaggccgagaaggttgctgcggcggcggaggagaaaccggcggagacggcggccgtcgtcgtggacaaggacatcgccctgtggggcgtgcccctgctcccgagcaagggcgacgaggccaccgacgtcgtgctcctcaagttcctccgcgcgcgcgacttcaaggccggcgccgcgttcgagatgctccgccgcaccctccgctggcgcagggactggcccggcttcgacgccgacgccgacgccgatctccccgaggagctcgcgggcgcgtgctacctcgacggcgcggaccgcgagggccacccggtgtgctacaacgcgctcggggtgttcgccgacgacgccttgtacaagaaggcgctcggcaccgaggaaggcaaggcgcggttcctccggtggcgggtgcgcgccatggagcgccacgtcgcggagctggacttgaagcccggcggcgccgcgtcgctgctgcaggtgaccgacctcaagaactcgccggggccggccaagaaggacttccgcgtcgccgtcaagcaggtgctcgacctgttccaggacaactaccccgagctcgtcgcaagaaacatcttgatcaacgtgccgttctggtactacgcgttcagcaccctgttctacccgttcctgacgcagcggaccaagagcaagttcgtcattgctcgcccgtccaaggtcaccgagaccctcctcaagtacattccgattgaggccatcccggtgaagtacggcggcctgaaacgcgacgacgacactgaattctcctccgccgatgacggcgaagtcgcagagctcactgtcaagggaagctccaccgagaccattgagattgaagccactgaggctgatgccaccctgacatgggacctgacggtgctgggctgggaggtgaactacaaggaggagttcgtgccggccgacgagagctcctacaccatcatcgtcaggaagggcaagaagatgggggcgggcgaggaggctgtccgcaactcgttccgcgccggcgagcccggcaaggtggtgctcaccgtcgagaacacctcgcacaagaagaagaaggtgctgttcaggcacaagtccaagagcgccttcgccaagaagtgctgaggctcgatcgaaacctgcctgcaagccgaattcttcggagggtgtgatgtgctgagctcctatgccaaggagtgaattggttggtcgtgtggatccaatattcaattattcattacattctttatgtgtgtgtgtaagaaagaagagagcattgtttgtattcatggtgattaatttgaggttgggtgttgcggcatgacattcatgattcctgagaatataaagagctggtatcgc

SEQ ID NO: 11382 - protein, 521 aa, Panicum virgatum
  misc_feature: Ceres CLONE 1727755
  misc_feature (239)..(424): Pfam Name: CRAL_TRIO Pfam Description: CRAL/TRIO domain
  misc_feature (433)..(513): Pfam Name: EMP24_GP25L Pfam Description: emp24/gp25L/p24 family/GOLD
  misc_feature (126)..(224): Pfam Name: CRAL_TRIO_N Pfam Description: CRAL/TRIO, N-terminus
MAVEAVSGNGGEAVAPVKEVSAKVEAKEAAAVTKNASFREESNFLDDLKESERKALAELRDKVEAAILEGKLFDDGKPEVKEKREAKKKAEKAPEEKKEEEEEGKKEPEAVEKKGEEDAKKEAEVEGKKEEEESKKEAEKEMEQEEAGEAEKVAAAAEEKPAETAAVVVDKDIALWGVPLLPSKGDEATDVVLLKFLRARDFKAGAAFEMLRRTLRWRRDWPGFDADADADLPEELAGACYLDGADREGHPVCYNALGVFADDALYKKALGTEEGKARFLRWRVRAMERHVAELDLKPGGAASLLQVTDLKNSPGPAKKDFRVAVKQVLDLFQDNYPELVARNILINVPFWYYAFSTLFYPFLTQRTKSKFVIARPSKVTETLLKYIPIEAIPVKYGGLKRDDDTEFSSADDGEVAELTVKGSSTETIEIEATEADATLTWDLTVLGWEVNYKEEFVPADESSYTIIVRKGKKMGAGEEAVRNSFRAGEPGKVVLTVENTSHKKKKVLFRHKSKSAFAKKC

SEQ ID NO: 11383 - DNA, 572 bp, Panicum virgatum
  misc_feature: Ceres CLONE 1727756-R
  misc_feature: Encodes the peptide sequence at SEQ ID NO. 11384
atatgctacccttatctcaggcagaagtgattaggaaaggcatcgatataacacttattggctggggagctcaacttgcagtgcttaaagaagcttgtgaagatgcagcaaaggatggggtatcttgtgagctcattgatctgaaaactctgataccgtgggacaaggaaacggtagaggcctcagtaaagaagactggaaagctcctcgtcagccatgaggctccaatcactgggggattcggtgcggaaattgctgcatctattgctgagcgctgcttccaaaggctcgaagcgcctgtggcgagagtctgcggcctcgacactccttttcctctcgtctacgaaccgtttttcatgcccacaaagaacaaggtcctggacgccataaaagcaactgtaaattactgaagtgcacgaccaagctacttcccttcattttccatgatagcaatataaagcttccttcttcatatgtacatatgcactcttattacattgctggtcaccatatgcatgatctcaaacagcttattcagcaacattagcaataaagttgcaggatgcaaatgt

SEQ ID NO: 11384 - protein, 135 aa, Panicum virgatum
  misc_feature: Ceres CLONE 1727756-R
  misc_feature (5)..(125): Pfam Name: Transketolase_C Pfam Description: Transketolase, C-terminal domain
  misc_feature: SWISSPROT Homolog: EC 1.2.4.4 3-methyl-2-oxobutanoate dehydrogenase (2-methylpropanoyl-transferring)
MLPLSQAEVIRKGIDITLIGWGAQLAVLKEACEDAAKDGVSCELIDLKTLIPWDKETVEASVKKTGKLLVSHEAPITGGFGAEIAASIAERCFQRLEAPVARVCGLDTPFPLVYEPFFMPTKNKVLDAIKATVNY

SEQ ID NO: 11385 - DNA, 628 bp, Panicum virgatum
  misc_feature: Ceres CLONE 1727756
accccttcggttccgaatccagatccagatcgaggccgccggccccttcctccctgtctgccgggcggcgctcctccctctccgcgccgccgcctcctccccggtcgtctccttccctccactggtcgcctccttctcgcaccacgcaatcaccgattcactattctgcttgttatatctctgtccggttctcctttgccatcacttattctctgcttcgcaggtccaggaaccgctagccctggcgaccaagcttatgaagatattttctccacctaacagagtcccttgaaccacttctatgttgccttccaccctgcaaatacaggtatctgcaacacatattacttgaaatatacatccacaaagtgcccccggccatcaaagcaccggttctgcctcctttctgaccaactgccagcttgtttattgatgtttctgggagctgttcaaagaaccactcctgcaacatgcaaggccgataaagctctttcaagtctgtctggccaagtactcaaacgagtgtgacagctctttcgagtctcggtgacgcatatcaaataaacagctgttgaccaaacaacatgggagaccacgctcgtgaggaaacgtgcattgtcaacataag

SEQ ID NO: 11386 - DNA, 2556 bp, Panicum virgatum
  misc_feature: Ceres CLONE 1727757
  misc_feature: Encodes the peptide sequence at SEQ ID NO. 11387
ctctctctctctctctctccccccctaccgtctcctgcgatcccatcgcctcgccgccgccgccgccgccatggcgttcctcgcgagggcgctccgccagtcgaactcgcgcctgtcgtcgcgctgccccgccgtggccgcgtcctgccgctggatctccccgaccgccgccgcgggatcgccggaggccggcgcggcggtggcgccggccgacccggagctgccgccgccgcgggagcccgtggggggcgctcgggtggagctcccgcccaacccggaggacgcgctcgaggtgttcgtggacgggcacgcggtgcggatccccaaggggttcaccgtgctccaggcctgcgaggtcgccggcgtcgacataccgcgcttctgctaccacagccgactctccatcgccgggaactgccgcatgtgcctcgtcgaggtcgagaaatcgcccaagcccgtcgcctcctgcgccatgcccgcgctcccagggatgaagattaagacaaacactccagtggcgaagaaggcaagggagggtgtcatggagttcctgctgatgaaccatccacttgactgcccaatctgcgatcagggtggggagtgcgacctccaggatcagtctatggcatttggtgctgaccgtggtcggttcactgagatgaagcggtcagttgtggacaagaatttgggtcccttggttaagacagtgatgacccgttgcatccaatgtacaaggtgtgtcaggtttgctactgaggttgctggtgttcaagaccttggtatgttaggtcgtggtagtggtgaagaaattggaacatatgttgagaaacttatgacaagtgaactatccggaaatgttattgatatctgccctgttggggctcttacgtccaagccatttgcatttaaagctcggaactgggagctgaagggcaccgagactatcgatgttactgatgcggtagggtcaaacataagagttgacagcagaggtcctgaagttatgcgtattgttccacgtctcaatgaggacataaatgaagaatggatatctgacaaaacacggttttgttatgatggtctgaagaggcaaagactaaatgaccctatgatccgtggtcctgatggcaggttcaaggcagtgacatggcgtgatgctcttgcagttgttgctgaggttttgcatcaagtcaagccagaagaaattactggagttgctggaaaactttctgatgcagaatccatgatggctctgaaagattttgttaacagaatgggttcagataaggtcctctgcgagggaaatggtccaaatcctccagcagacctacaatcaaactacctaatgaatacaggcattgctgggcttgaaaaggctgatgtcttccttttggttggcactcagccaagagtggaggcagctattgttaatgctaggattcggaagaccgttagagcaacacaagcaaaggtgggctatatcggccctccagctgacttcaactatgaccatgagcatcttggcacaggaccacagacccttgttgagattgcagaaggtcggcaccctttctgctcagtactgcaatctgctaaaaaccctgtcatcatcgctggagctggattatttgaacgggaggaccaagatgccctattctcaacgattgagactgtagccaagaagttcaatgtgacgagaccagactggaatagccttaatgtcctactgctccatgctgctcaggctgcagctcttgatcttggccttgttgctaatcctgctgagagcatcaagtcagcgaagttcttgtacttgatgggagctgatgatataagtctagacaatcttccagaagatgcatttgttgtttatcaggggcaccacggtgacaaggctgtctatagggccaatgttattctgccatcttcagcattcagtgagaaggaaggtacctacgagaacaccgaaggttgcacccagtggaccatcccagctgttcccacagttgatgatgctagggatgattggaagatcatccgtgctctttctgaggttgctggggttcaactgccttatgacagtctgtcagctgtgagggaccggatcagcacagttgcacctaatctcattcacgtagatgagaaagaaccatgcacaatttcacctgaggtgaagccgccagtaaagcaacaagtgagctcaaccccgttcaaaaccgtcattgagaacttctatatgactgatgcaatcacacgagcttcaaagataatggcccaatgcagtgcgaccttgttgaagaagtgaggtctgtgtctttcaagctaatcatcagcgaagagcatcttagttccctttctttctttgctacgaggtcaccacctgttgcttgcttggttgggaggttggtgtataatttggactgcctctagattttcagagcagcaaaacttgatcagtgcatttctgtgttgtgtatgagaagcagagcatactcaataagcttgttgcccttttgaatcatacaacgggctacaagcaatgattttacctgttcc

SEQ ID NO: 11387 - protein, 744 aa, Panicum virgatum
  misc_feature: Ceres CLONE 1727757
  misc_feature (342)..(662): Pfam Name: Molybdopterin Pfam Description: Molybdopterin oxidoreductase
  misc_feature (75)..(139): Pfam Name: Fer2 Pfam Description: 2Fe-2S iron-sulfur cluster binding domain
  misc_feature: SWISSPROT Homolog: EC 1.6.99.5 NADH dehydrogenase (quinone)
MAFLARALRQSNSRLSSRCPAVAASCRWISPTAAAGSPEAGAAVAPADPELPPPREPVGGARVELPPNPEDALEVFVDGHAVRIPKGFTVLQACEVAGVDIPRFCYHSRLSIAGNCRMCLVEVEKSPKPVASCAMPALPGMKIKTNTPVAKKAREGVMEFLLMNHPLDCPICDQGGECDLQDQSMAFGADRGRFTEMKRSVVDKNLGPLVKTVMTRCIQCTRCVRFATEVAGVQDLGMLGRGSGEEIGTYVEKLMTSELSGNVIDICPVGALTSKPFAFKARNWELKGTETIDVTDAVGSNIRVDSRGPEVMRIVPRLNEDINEEWISDKTRFCYDGLKRQRLNDPMIRGPDGRFKAVTWRDALAVVAEVLHQVKPEEITGVAGKLSDAESMMALKDFVNRMGSDKVLCEGNGPNPPADLQSNYLMNTGIAGLEKADVFLLVGTQPRVEAAIVNARIRKTVRATQAKVGYIGPPADFNYDHEHLGTGPQTLVEIAEGRHPFCSVLQSAKNPVIIAGAGLFEREDQDALFSTIETVAKKFNVTRPDWNSLNVLLLHAAQAAALDLGLVANPAESIKSAKFLYLMGADDISLDNLPEDAFVVYQGHHGDKAVYRANVILPSSAFSEKEGTYENTEGCTQWTIPAVPTVDDARDDWKIIRALSEVAGVQLPYDSLSAVRDRISTVAPNLIHVDEKEPCTISPEVKPPVKQQVSSTPFKTVIENFYMTDAITRASKIMAQCSATLLKK

SEQ ID NO: 11388 - DNA, 1579 bp, Panicum virgatum
  misc_feature: Ceres CLONE 1727758
  misc_feature: Encodes the peptide sequence at SEQ ID NO. 11389
gttcgtcgtggtttgcgttgtgcgcgcgtgcagaggcggccggggagcaggggtagtggtggtggtggtggcccttgctgggtggaggtggaggcttcgattcgggcggtggattgtggcctgacgaatcccggaaaggccgccggaaagggagaacaaaggtaagctaagcaggcagccgtaaagccatggggtgcggggcgtcgagccagaaggacgccgtcggcgggccccggagacggccggggagcgtcggcgacgtggtcgtgttcctcccgggcctccgggtgccgaggagcgtcgacctcgcccaggcgctcggcgggcgcctggacaggagcatcgtggagcggctgtcggctctgagagctcgcgtcgtcgagatggcaatgcaagagtcggcggcggcgctgaagccgaggcggaagacggcggcggcacggcacgggtctagtacagccagtctcctgcaggccctcgaagactacttgccaattctgctaggattggtaacagaaggtagtacgttgaggcatacagtgcaattcacctggactaaccaagaggataatgctgctgaggagacgaccatggcagatgcctggtacgaggtgctgtctgtgctgcatttgatggccatggtctgcttgcttcaggccaacaccctgcttctccccaggtcttacggcgatggctacgcaccaagagtttccgaagaaagcagacgggccactgtcgatgttttcttgaaggcagctggatacttagcctgcacaattcggcatgtaattccgcagattccacctgaactaaggaggcaacttccagtagacctggttgaaggaaatctcaaagctctaagcctgcaagctctgggtcagggggttgacatgcagcttggtttggctattgatagtccaaaggccactttagcagtaaaacggcgcttagcctgtgaaatggtcaagtattggcaacaagttcaggaaagcattccagatcttcctggctccgatggatgggggaaaaagcaccggctgtttgtcaagtggaaatatgctgaagcaaaggctgcagcatactattttcatggtttgattcttgatgagggaaatacagagaaatcccacggaatggcaatagctgcacttcaagcttcagaagaatttctaaaagaaagcaaaagggtttcagaagccttccatgcaactcctccaacatcgaggagccctactccattcggaacagcaaaatatatgtttgacaagatcccaaaagatgcttcaagcaaggtccgaatcaaccaggacttgtatgctcaagaaaaggtcataggaactccgcctcccttaccggattttgcattggcactaatgccagaagactatgatcttcctccattagatccactttggaacaaagaagacagacgtcagtaggtgtgtatgcaactgaatggattcttcagatggaaagcttggctttggagagaggggagaagaaccaagatctgccatgtcaaagctgaacatggtaacaaatcaagtgtacaaaatatgtttaaacaaaatcctgagtc

SEQ ID NO: 11389 - protein, 416 aa, Panicum virgatum
  misc_feature: Ceres CLONE 1727758
  misc_feature (27)..(413): Pfam Name: BRO1 Pfam Description: BRO1-like domain
MGCGASSQKDAVGGPRRRPGSVGDVVVFLPGLRVPRSVDLAQALGGRLDRSIVERLSALRARVVEMAMQESAAALKPRRKTAAARHGSSTASLLQALEDYLPILLGLVTEGSTLRHTVQFTWTNQEDNAAEETTMADAWYEVLSVLHLMAMVCLLQANTLLLPRSYGDGYAPRVSEESRRATVDVFLKAAGYLACTIRHVIPQIPPELRRQLPVDLVEGNLKALSLQALGQGVDMQLGLAIDSPKATLAVKRRLACEMVKYWQQVQESIPDLPGSDGWGKKHRLFVKWKYAEAKAAAYYFHGLILDEGNTEKSHGMAIAALQASEEFLKESKRVSEAFHATPPTSRSPTPFGTAKYMFDKIPKDASSKVRINQDLYAQEKVIGTPPPLPDFALALMPEDYDLPPLDPLWNKEDRRQ

SEQ ID NO: 11390 - DNA, 2277 bp, Panicum virgatum
  misc_feature: Ceres CLONE 1727762
  misc_feature: Encodes the peptide sequence at SEQ ID NO. 11391
attcgctcgcctctccgaacgcaaagcaaggaacccgattccttcctctccttgcctgacgcctccagggcattagctgagcggcgcggcacggcaccaggctgaggaccgggatgcagtcggacgcgtccacctccccgcggcggcggagcacgagctgctacagcgacagcggcgactcgtcctgctccgagccctttagcgagtgcggcagcgacgacctctcctttacgcccgcggccgccgcggggatccaccgcctgctgctgtcctgcgcggcggagacgtcggaggacgccatctcgtcccttatggccgaactggagtcgccggcgccgtcgctggactcgctccggcgcgcggccatggagctccggctgctggccaagcacaacccggacaaccgggtccgcatcgccaaggccgggggcgtgcggccgctcgtcaagctgctgtcgcacgcggacccgctgctgcaggagcacggcgtcacggcgctgctcaacctctccatctgcgacgagaacaaggcgaccatcatcgaggccggcgcgatacggccgctggtgcaggcgctcaagtccgccgcgtcgcccgccgcgcgggagaacgccgcgtgcgcgctgctccggctctcccagctcgacggcgccgccgcggccgccatcggccgcgccggcgccatccccctgctggtctccctcctcgagaccggcggcctgcgcgggaagaaggacgccgccacggcgctctacgcgctctgcagcggcgcccgcgagaaccggcagcgcgccgtcgaggccggcgccgtgcggcccctgctcgacctcatggccgacccggagtccggcatggtggacaaggccgcctacgtcctccactccctggtgggctcgggcgagggccgcgccgcggccgtcgaggaaggcggcatccccgtgctcgtcgagatggtggaggtcggcagctcgcggcagaaggaaatcgccacgctctccctgctacagatctgcgaggacaacgccgcgtaccgcaccatggtcgcccgcgagggtgccatccctcccctcgtcgccctctcccagtcgccctccgcccgccccaagctcaaaaccaaggcggagtcgctgatcgagttgctgcggcagccgcggagcccgagcctccgcgcgaggccagcggcggtcgttgcggcggagtgacgaaccgttcctcaatcgggcggtcccatcccacccccaccttggtcgcgcgttcccagcctggcttcacttattcggcgagacgagccggagccggcaccgaccggccggtgcgcgcgtgtaaatagcaagcagcgtgtttgcgtccgcgagcgagtgtacagtttcctcaagcgagatgtcgtccggaggaccgaagaacagtctagcctccctgcaattacctccctccccgcccagcctcctttttgttccctttacagtttcgacttcggtttggttgcttcctcgccgccggccgcggcgaggcaaagcagaagggtgtgtgcagcgaagctgcggaaaagcttcgagttcgcgtgtgcccgtgtgggttggattgtgctagtctcagtgtgtacgtgtgtgtgggcagcgtctggaacgaatcaagtttgtttccgatcctgtggtggatacgagaagcgccaaaaaaacagagcaagtgcacaacacaactacagccaagagccaacaccacacaccacaatggctccacccagtagggcaactagaaccggcttgctagtggcgctgtgcctcgcctctctcctccttgtctcgtcgttcgcccatgggaggaagacgacgctaggaggagcgcaggcgcaggcatatgaacaaccaataggatatggcagtggcaatctcccgcagccgcagcccataggatatggcagtggcaatctcccgcagccgcagcccaaaggatatggcagtggcaatctcccgcagcccagttatgggccaccaaagccgtaatttcctgtgccggcaccacgctgacaagataatctgcccttttatatatacacatacatatatgtaagctgtaagtgaataaaatgatcggtagtcagggtggtgcttgtttcacatataagtattggcctgtacgttgggcaacaggtcggtctactgtaacgcgatagcatatatgtataatatataggccttgcttggcaagctgctgtggaggataccatagccatgccaaatcttctcaactaaaataaaatgcttttgttaaaccttc

SEQ ID NO: 11391 - protein, 362 aa, Panicum virgatum
  misc_feature: Ceres CLONE 1727762
  misc_feature (94)..(134): Pfam Name: Arm Pfam Description: Armadillo/beta-catenin-like repeat
  misc_feature (135)..(176): Pfam Name: Arm Pfam Description: Armadillo/beta-catenin-like repeat
  misc_feature (220)..(260): Pfam Name: Arm Pfam Description: Armadillo/beta-catenin-like repeat
  misc_feature (178)..(218): Pfam Name: Arm Pfam Description: Armadillo/beta-catenin-like repeat
MQSDASTSPRRRSTSCYSDSGDSSCSEPFSECGSDDLSFTPAAAAGIHRLLLSCAAETSEDAISSLMAELESPAPSLDSLRRAAMELRLLAKHNPDNRVRIAKAGGVRPLVKLLSHADPLLQEHGVTALLNLSICDENKATIIEAGAIRPLVQALKSAASPAARENAACALLRLSQLDGAAAAAIGRAGAIPLLVSLLETGGLRGKKDAATALYALCSGARENRQRAVEAGAVRPLLDLMADPESGMVDKAAYVLHSLVGSGEGRAAAVEEGGIPVLVEMVEVGSSRQKEIATLSLLQICEDNAAYRTMVAREGAIPPLVALSQSPSARPKLKTKAESLIELLRQPRSPSLRARPAAVVAAE

SEQ ID NO: 11392 - DNA, 2463 bp, Panicum virgatum
  misc_feature: Ceres CLONE 1727778
  misc_feature: Encodes the peptide sequence at SEQ ID NO. 11393
attttccgccgtcttatccctccgtccacgctgccccgcagccgccgcccaaaccctagcgaccccgacccgccgccgtccgtcaccatggctgacgaccactactcctccaagcgcaagtacgacgacccctcgccgccgccgcggcgcacggggttctcctccggcccgccgcccgcctctccgcccgccggcgccccgtcgtacaacagcgtgccgccgccccccgacgagatccagctcgcgaagcagcgcgcgcaggagatcgcggcgcggatcttcaacgccgccgaggccaagcgcccccgcgtcgacaacggcgacgatgacgtcggcggctacgggggaggaggctcccatggcggcggcggcggcggcggcggtggaggtgggcgcatcggcggcggggggctcggctactcgtcctctgccggtggtgggcatggttcttctatcgcgccgttatcttcacagagcagtgtgtctcagtactcttcatatggtggatatcagggtacaagcaaaaagattgaaataccaaatggaagggttggtgttattattggaaaagctggggaaactatcaggtatctccaacttcagtcaggagcaaagattcaagtaacaagagacaatgaagctgaaccaggtgcaccaacaagaccagttgagctttcaggcactcctgagcagataagcaaagctgagcagctgatcaaagaagttctggcagaggctgatgctgggtcttctggtactggatctggtggccggaaatataacgcaccacagccaggtgccgacacgttccagatgaaaattgctaataacaaggtgggtctggttattggtaagggtggtgagactataaagtccatgcaagccaaatctggagctcgtattcaggtcattcctttgcatctgcccgctggtgatacttcaactgaaagaactgtgcatattgatggcacacaggaacaagttgaaattgcaaagcagctggtgattgaggttaccagtgagaaccgtgccagaaatccaatgtcaggtggctattctcagcagggttatctccctcctcgtcctcagtcgaactggggccaacctggtgcaccaccccagcagccaggttatggttatatgcaacctggagcctatcctggggcaccaccacagtatggtgcacctcagcaaccttacggtagctatcctccaacatctggtggctatcagactggatgggatcagtctcaaaaccagcaatctcatacaactccccctggtactgggtatgactattatagccagcagcagcaacctcagcaacagtctgcccctggaactgctgcgtctgctactgatgctactagctacaattatggccagcctcctacatatacttcgcaaggatatgattctacctactctcagcagagtggtgggccgcaagcgtatgattactctggttaccagactcaagggcagcagcagggctattctcagcagactggttatgatcagcagggctatggtgcatctgcttatggatcagctgcaaactcgacccaggatgggtctgcacccagttatggtggtactggtggggccagtcaggcatctccagggcagcaaacttcaactccaactgctggaagccaccctggttattccagccaaccccctactagtgctgcatcaagctacccagcacaaggttctaccccaccatctggctatggcgctccaccgccgcagtctggatatggcacccagccaccacagcaaggtggttatggtcaaggtgcttatgggcagccttctccgcagggccagaagccgccttcatcttcaccgtatgggcaggctccacctcctggatctgtacaaggtggttggacagtatggttacagccagcctggttatggtgcgcctccgccttaccctggtgcaccccctgcaagccacccgggctatgcgcagcagcagtcttatggtgatgcatatggcagtggaagttatggtcagcctccagcatactctactgaagcaacaactgctgcatcccaggatcaatctgctgtacctggctccactggtgctaccacaacatctgctcctgctcctgctaacagtggcggtgcacaaacatctgcagaaagttaagcttcaatggctcgttggggaacaaaagatttttcaagcatccgccgtggtttcctctgttgctttatgttttagggaagagggtccatatctacgagttatattattttccttgttgctttagctttgacttttatcatcttaattattcgtcagtactgtgttatctatgttaaaggctatgttgtttagatgcctgtacgttctggtaatatctgtacttgtggttgctctggttgggccctactgtacggggtcttacattggacatctaccaatacaatatgcattctgaatcc

SEQ ID NO: 11393 - protein, 636 aa, Panicum virgatum
  misc_feature: Ceres CLONE 1727778
  misc_feature (240)..(306): Pfam Name: KH_1 Pfam Description: KH domain
  misc_feature (145)..(210): Pfam Name: KH_1 Pfam Description: KH domain
  misc_feature: Useful for making plants with altered lignin content
MADDHYSSKRKYDDPSPPPRRTGFSSGPPPASPPAGAPSYNSVPPPPDEIQLAKQRAQEIAARIFNAAEAKRPRVDNGDDDVGGYGGGGSHGGGGGGGGGGGRIGGGGLGYSSSAGGGHGSSIAPLSSQSSVSQYSSYGGYQGTSKKIEIPNGRVGVIIGKAGETIRYLQLQSGAKIQVTRDNEAEPGAPTRPVELSGTPEQISKAEQLIKEVLAEADAGSSGTGSGGRKYNAPQPGADTFQMKIANNKVGLVIGKGGETIKSMQAKSGARIQVIPLHLPAGDTSTERTVHIDGTQEQVEIAKQLVIEVTSENRARNPMSGGYSQQGYLPPRPQSNWGQPGAPPQQPGYGYMQPGAYPGAPPQYGAPQQPYGSYPPTSGGYQTGWDQSQNQQSHTTPPGTGYDYYSQQQQPQQQSAPGTAASATDATSYNYGQPPTYTSQGYDSTYSQQSGGPQAYDYSGYQTQGQQQGYSQQTGYDQQGYGASAYGSAANSTQDGSAPSYGGTGGASQASPGQQTSTPTAGSHPGYSSQPPTSAASSYPAQGSTPPSGYGAPPPQSGYGTQPPQQGGYGQGAYGQPSPQGQKPPSSSPYGQAPPPGSVQGGWTVWLQPAWLWCASALPWCTPCKPPGLCAAAVLW

SEQ ID NO: 11394 - DNA, 782 bp, Panicum virgatum
  misc_feature: Ceres CLONE 1727790
  misc_feature: Encodes the peptide sequence at SEQ ID NO. 11395
ctgtcctctcctctctcgcgctctctctctctctctctctcgtgccgcgctgggttcctcgtctcgttctgcttcgacaggatccgggagcgcgtggagcgagcgggtgctgccggttccgggcggcggagctgggtgggcgcgttccgtgcgccgccgcggtggctggctcgcgcgggggtaggctgtgaggaggcgcgccccagagccggcgacggtgcccgtacgtctctcggctgctagcgcgctgatagaacaggttttggtcgcttcgaggaggaattgggagctcgcgaggacgcgaggaggagcttttacttccggtggtgctgcctcagtggccgggcggagatggcggcggcggtggcgatgcggagcgggagcagcgacggcggcggcgggtacgacaggggcggcatggacacgggcaagtacgtgcggtacacgccggagcaggtggaggcgctggagcgggtgtacgccgagtgccccaagcccagctccgcgcgcaggcagcagctgctgcgcgagtgccccatactctcaaacatcgagcccaagcagatcaaggtctggttccagaaccgaaggtgccgtgataagcagcgtaaggagtcttccaggctccaggccgtgaacagaaagttgactgcgatgaacaagcttctcatggaggagaatgagcgtctgcagaagcaggtctcccagctggttcacgagaatgcgtacatgaagcagcagctgcagaatcctttcttagcaaatgacgcgagctgtgaatc

SEQ ID NO: 11395 - protein, 143 aa, Panicum virgatum
  misc_feature: Ceres CLONE 1727790
  misc_feature (27)..(85): Pfam Name: Homeobox Pfam Description: Homeobox domain
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: Useful for making plants with altered carbohydrate content
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
  misc_feature: The sequence is a functional homolog of SEQ ID NO 2 in US patent 7056739
  misc_feature: Useful for making plants with altered lignin content
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
MAAAVAMRSGSSDGGGGYDRGGMDTGKYVRYTPEQVEALERVYAECPKPSSARRQQLLRECPILSNIEPKQIKVWFQNRRCRDKQRKESSRLQAVNRKLTAMNKLLMEENERLQKQVSQLVHENAYMKQQLQNPFLANDASCE

SEQ ID NO: 11396 - DNA, 730 bp, Panicum virgatum
  misc_feature: Ceres CLONE 1727790-R
  misc_feature: Encodes the peptide sequence at SEQ ID NO. 11397
gtttccgtgattgtcggagtgctgaagtctttacaatgttaccggctggaaatggtgggaccattgagcttgtttacatgcagatgtatgctcctactactttagttcctgcaagagatttttggacactgagatacacaaccactctggaggatggcagtcttgtggtctgtgagagatctttgagtggttcagggggtggtcaaagtactgccacgatacaacaatttgtaagggctgaaatgcttcctagtggctatttagtccgccagtgtgagggtggaggctcgattgtgcgtatagtggaccatctggaccttgatgcttggagtgttcctgaagttcttcggcccctctatgagtcgtctagagtagttgctcagaagatgacaacagcagcactacggtacatcagacaaattgctcaagaaacaagtggagaggttgtatatgcgttggggaggcaaccagctgtcctacgaacatttagtcagaggcttagtagaggatttaacgatgctataagtggtttcaatgatgacggttggtctgtcatgggtggagatggtatagaagatgttatcattgcttgcaactcaaagaagattaggaacagtagcaatccagcaagtgcttttggagctcctggaggcatcatatgtgctaaggcatccatgttactgcagagtgttccaccagcagtacttgtaaggttcctgagggaacaccg

SEQ ID NO: 11397 - protein, 242 aa, Panicum virgatum
  misc_feature: Ceres CLONE 1727790-R
  misc_feature (1)..(140): Pfam Name: START Pfam Description: START domain
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
  misc_feature: The sequence is a functional homolog of SEQ ID NO 2 in US patent 7056739 220>
  misc_feature: Useful for making plants with altered lignin content
  misc_feature: Useful for making plants with altered carbohydrate content
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
FRDCRSAEVFTMLPAGNGGTIELVYMQMYAPTTLVPARDFWTLRYTTTLEDGSLVVCERSLSGSGGGQSTATIQQFVRAEMLPSGYLVRQCEGGGSIVRIVDHLDLDAWSVPEVLRPLYESSRVVAQKMTTAALRYIRQIAQETSGEVVYALGRQPAVLRTFSQRLSRGFNDAISGFNDDGWSVMGGDGIEDVIIACNSKKIRNSSNPASAFGAPGGIICAKASMLLQSVPPAVLVRFLREH

SEQ ID NO: 11398 - DNA, 2270 bp, Panicum virgatum
  misc_feature: Ceres CLONE 1727792
  misc_feature: Encodes the peptide sequence at SEQ ID NO. 11399
gctttgttcccctcctgtccttccctttcccttggcttccttgctttgcttgctcctctgccgccccgtcgccgccgtctcctccgtggcgcatcaggcattcaaacccgctcgtcaaaaggaatccgtccgcgagatcgaaagcaacagctcccgattattaaagccacgttttttcaaaagccgcgggggttaaaaaccctgggaaattttggaggaagcgaaattcgtttcctcgcatccgaaactgcagttgcgtgctcgaggcgggggtgcacagcctagaagctccagcgcccgacggcgccggcgccccgttctctccgtgggatcctccgccggccgccactccactgagctctgtggtggacttgggtggagattcaacccggcgcggattggactgaataccacacatgacaagggttatacatgactctggagaaggcgtgcagaaggaggcacttgatctggtctcttctgatgttaacttccccaagggccatttcccggactacaggattggaccaaacaatcaaatcattgatccagaggaggcacatgaggctgtgcctctcaaggagattgttgcaaaggaaacagcgcagctgctagagcagcacaagcgcctttcagtgcgcgatctcaaagagaagtttgagaagggtttgtctggtgctaccaagctgtctgaagaggctaagcggagagaaacagcttcattagacaggcaggttcttctgaagaagctcagagatgttttagacacactgaaaggccgcgtggctggtcgaaatagagacgatgctgaggaagctatatcgctggtggaggcacttgctgtccagctgacacaacgagaaggggagttaatttatgaaaaggctgaagtaaaaaagttggctaacttccttaagcaggctactgaagatgcacgtaaagtggctgaagaggaaagggctcttgcgcttgctgaaattgaaaaggctagagctgcaatagaaaaggttgagaaagcattgcaggtgcatgattctgcttcaagtagcagggagaaggaggagatagaggaacttaggaaagaggtccgagaggctaggagaataaaaatgctacaccagccaagcaaggtcatggacatggagtttgaacttaaggcactgcggaccctcatctcagagaaaactcagctttgcaatcagctaaagaaagagcttgccatgatcaagaggctggaggaggatagttccgacctctttgagcttgaaggttctgatacccttggatcacagctttgtattatccctcgagttgatggtgctccaaacataacaaactgtccaattcagtggtaccgtgtaatttctggaggcaccagagagctcatatctggagcaacaaaatttacatatgctccggaaccgtttgacgtcggtcgattattgcaagcagagatagttttgaatacagataaaattatagttcagacagatgggcctataaagaatgctgcaggacttgaacgttatgtggactcactaatgaaaaggacggatattgagttcaatgtggtagtcacccaaatgaacgggaaggattactcgtcaaattctgtccatgtatttcacattggaaagctgagaataaaactccgaaaaggatggtctacaaaagcaagagagtcgtattctactacgatgaagttatgtgggagccgtggtggtggtaatgctgcagctggggcagttttttggcaagctaggaaaggcttgacctatactctagcttttgaaacagacagggataggaatgctgcaattatgattgctcgcaaatttgcttcaaattgcaatgtcgctctcactggcccaggcgatcaaggcacctgatgaagtggatcatgcatgtttttgacagcgacacagtacataattagggtgtggattggctgattaggtggttatctactggtgcttgtgagagtagaggttgtatactgcgtgaggctatccccttttcatatgtttatggaggcattgtttttgtttgcctgccagcagcactagccacgttcttgaaacaggatgtgcaaaattgatcactgttcttgtgcgttaagtctgtaatactgaacggaaaaggcttggtcgttagtctcgctgggagacttcccttattgagttaccaagaagtatgtacagacagctggtctcctgaagtcatattattgatgatattcaggtggtatttagtggatttgtgatgtgcgg

SEQ ID NO: 11399 - protein, 490 aa, Panicum virgatum
  misc_feature: Ceres CLONE 1727792
  misc_feature: Useful for making plants with altered alkaloid content
  misc_feature: Useful for making plants with altered terpenoid content
MTRVIHDSGEGVQKEALDLVSSDVNFPKGHFPDYRIGPNNQIIDPEEAHEAVPLKEIVAKETAQLLEQHKRLSVRDLKEKFEKGLSGATKLSEEAKRRETASLDRQVLLKKLRDVLDTLKGRVAGRNRDDAEEAISLVEALAVQLTQREGELIYEKAEVKKLANFLKQATEDARKVAEEERALALAEIEKARAAIEKVEKALQVHDSASSSREKEEIEELRKEVREARRIKMLHQPSKVMDMEFELKALRTLISEKTQLCNQLKKELAMIKRLEEDSSDLFELEGSDTLGSQLCIIPRVDGAPNITNCPIQWYRVISGGTRELISGATKFTYAPEPFDVGRLLQAEIVLNTDKIIVQTDGPIKNAAGLERYVDSLMKRTDIEFNVVVTQMNGKDYSSNSVHVFHIGKLRIKLRKGWSTKARESYSTTMKLCGSRGGGNAAAGAVFWQARKGLTYTLAFETDRDRNAAIMIARKFASNCNVALTGPGDQGT

SEQ ID NO: 11400 - DNA, 2495 bp, Panicum virgatum
  misc_feature: Ceres CLONE 1727804
  misc_feature: Encodes the peptide sequence at SEQ ID NO. 11401
cgccgcgacggcaggaggaggagacgcagacacagagaggaatcgcgtcgttggattggatcatcctcgctgctgctgctcgttgaatctttaccccccctgtcacgaatttctgcatcgccggagcccggaggacgagatatgccgccgccgccggacgagcgcgggcagccgccgaggcgccggaggatgctggcgctgccggcggtgtgcccgtgcgaagccatcgcgccggcagcgctgctggcgtcgctgctctccctcaccgccgacgccgccggcctccaagcgggcgcgctccccgcgctccggggcgcggcgcgcgaggccgtccggatcgccggcctgctccacgcgtttctcgacgcggtccgcggcggcccgctgcccgacgaggcggtgctggggctctcggagctgcacgtggcgctgcagaagctgcgcctcctgctcgccgactgcgcccggaagggggcgcggctgtgagtgctcatgaacgccgagacggccgcctccgagctccgggtcgtcatggggtccgtcgccacggcggtggacgcgctgccggagggcgcggtcgcgggcgcggcgtccgccgaagcgcgagagctcgcggcgctggcgtccgcgcacgcatggcgcgcggcggcgcggctgcggccggacccggaggacggccgcgcggcgcggggcgtgcgctcggtgctcgcgcggttcgcgggcggcgccacgcccgacgccgaggacgcccgccacgtgctcgaccgcgtggggaccgccacctggtccggctgcgccgaggaggcggcgttcctggaggccgagctgctcgagcgcctggagaccggcggcgaggacgacaacgacctcgtgctcatcgccggcctcctggcgttcctcgtctactgccgcgtcatcctgttcgatcgcattgacgatcccagcaaggccgcggcggctgcggcgccggtgatgaccaggccgccggccaggtgcgcggcgtggatcaacccggaggctctgcggtgccccatcacgctggagctgatgaccgacccggtgacggtggccaccggccagacgtacgaccgcgcgtccatcaagaagtggatcaagagcgggtgccggacgtgccccgtcaccggcgagcggctccggagcgcggagctcgtgcccaacgtcgcggcgcgcgggatcatcgagcagctgctcctcagccggggcgtcccgctccaggagcccagcggcaagcaccggtgcgcggtggacaagaccgccgcgccgttcggcgcggccgcggccggcggcgtgcggctcgccgtggcgttcctcgtcgcgcggctgtccaggggcacgcccgagcagcagaagaaggcgtcgtacgaggcccggaagctctcgaagcggaacgtcttctaccgggcgtgcctcgtggaggccggcgccgtgccgtggctgctccacctgctctcctcgggcgacgcgtccgtgcaggacaacgccgtggcggggctcctgaacctgtccaagcacccggccgggcggcgggcgctggtggagtccggcgggctcgggctcatcgtggacgccgtgagcgtcgccgccagggtggaggcgcggcagaacgcggcggccgtgctgttctacctgtcgtcgagcccggagtactgcgaggagatcagccgcatcccggaggcgatcccgacgctggtgcacctggcgcggggcggcgcgtaccgcggccgcaagaacgcgctggtgagcctgtacgggctgctccagtgcgcggacgcgcgcggccgggcggtgtcggccggcgccgtggccgcgctcgcgggcctgctgctgggctcccccgccgccgccgccgaaggcgacgacgacctggccctcgacgccgtcgcgctgctcgcgaggatcgcggagcagccgggcggcgcgcacgccgtcgcggcgagctcggagctggtgacccggctcgtggacttcctcggcgagtcggcgtcgcggtccgccaaggagcactgcgcgtcgctgcttgcgtcgctgggccggcacggcggcgacggggtgctggcgctgctgggcaagctgccgggcctgatgccggcgctgtacgcgctcatcgccgacaggaccccgcaggcggtcaagaaggcgcggtggctggtgaacgagatccaccggcactacgagcagcgccaggcgccggcggccgcgcgcacgccggctgtggccggcgaccaccgcgtcatccgtgtatagccgtgtacatagcacacatgtacatttggtttctcctcttctttgcttgggatcatgagggcccgatgtttgttcttccgccggccggctcgagtttttcgaagagccaggacggatttcggcattgtttcgtcgtgagatttatgaatacaaacgaaattgtacagggaatagtttgtaacttgtaagttggttttgtgaattgtggtaatgaaaatccatggatgtac

SEQ ID NO: 11401 - protein, 590 aa, Panicum virgatum
  misc_feature: Ceres CLONE 1727804
  misc_feature (174)..(246): Pfam Name: U-box Pfam Description: U-box domain
  misc_feature (306)..(346): Pfam Name: Arm Pfam Description: Armadillo/beta-catenin-like repeat
  misc_feature (347)..(388): Pfam Name: Arm Pfam Description: Armadillo/beta-catenin-like repeat
MNAETAASELRVVMGSVATAVDALPEGAVAGAASAEARELAALASAHAWRAAARLRPDPEDGRAARGVRSVLARFAGGATPDAEDARHVLDRVGTATWSGCAEEAAFLEAELLERLETGGEDDNDLVLIAGLLAFLVYCRVILFDRIDDPSKAAAAAAPVMTRPPARCAAWINPEALRCPITLELMTDPVTVATGQTYDRASIKKWIKSGCRTCPVTGERLRSAELVPNVAARGIIEQLLLSRGVPLQEPSGKHRCAVDKTAAPFGAAAAGGVRLAVAFLVARLSRGTPEQQKKASYEARKLSKRNVFYRACLVEAGAVPWLLHLLSSGDASVQDNAVAGLLNLSKHPAGRRALVESGGLGLIVDAVSVAARVEARQNAAAVLFYLSSSPEYCEEISRIPEAIPTLVHLARGGAYRGRKNALVSLYGLLQCADARGRAVSAGAVAALAGLLLGSPAAAAEGDDDLALDAVALLARIAEQPGGAHAVAASSELVTRLVDFLGESASRSAKEHCASLLASLGRHGGDGVLALLGKLPGLMPALYALIADRTPQAVKKARWLVNEIHRHYEQRQAPAAARTPAVAGDHRVIRV

SEQ ID NO: 11402 - DNA, 1390 bp, Panicum virgatum
  misc_feature: Ceres CLONE 1727823
  misc_feature: Encodes the peptide sequence at SEQ ID NO. 11403
ctctctctctctctgtgcatacaacacagggaactagagccatggctactccgaagaagacgatgagagccctgcagtacgacaagtatggcggaggagcaggtctcaagcatgtggaggtgccggtcccgtcgccgaagaagggggaggtgctgctcaagctggaggcggccagcatcaaccctatcgactggaaaattcagaagggcatggtccggcccttccttcccaggaagttccccttcataccagttggagacatgtctggagaagtcgtcgagctggacagcggtgtgaccaacctcaaaccaagcgacaaagtcatctccatcagcttcccggtaacattctcaattcaaatttccaattactactgccttgcagagttctgttcccctcgagcagtgatgaacttgtgcatctcttctgacagtaagaaacaacgattttaatttgttaggctaattgtatatagtaagtgcattgcctgactaattaacacgttcatgaatcatttcccatgcatcccaccttggaagaatggcggcgggctcgcggagtacgcggtggcgccggcgtcgcttacggtggcacggccgccggaggtgtccgcggccgaaggcgcctctctgccgacggctgcgtccaccgcgctccagcagctgaaggccgcgggcgtcagcagcttcgacgggtccggcggcggcagcaacggcccccggaacgtgctggtcaccgcggcctccggcggcgtcggccactacgccgtgcagctggccaagctggcggggctccacgtgacggccacctgcggcgcgcgcaacctgggcctcgtccagggcctgggcgctgacgaggcgctggactacaagacccccgagggcgccaggctgcggagcccctccggccggaagtacgacgcggtgatgcactgcgcgacgggcaccccgtggtcggtgttcgcgccggtgctggccggcgaggccacggtcgtcgacgtgacgcccgggatcgccgccgccgccaggtcgttcctgcagaaggtgacgctggccaagcagaggctggtgccgctgctcctggtgcccaggaaggaggagatggagtggctggcggacatgacgcggcaggggaagctcaggacggtggtcgattccaggtacccgttgagccgggcgcaggaggcgtgggccaagagcatcggagggcacgccaccggcaagatcgtcgtggaaatgggaggcgaggagtgagccggccgggcggcgtgcgtgcgtgcacggcgatctgtgtgacagcattgtgtcgtcgtggtgttgtatgcggtctgtctgattggatttctagtgtgggaataattaagaaacaacaagttgtgctgggcactctg

SEQ ID NO: 11403 - protein, 248 aa, Panicum virgatum
  misc_feature: Ceres CLONE 1727823
  misc_feature (70)..(207): Pfam Name: ADH_zinc_N Pfam Description: Zinc-binding dehydrogenase
  misc_feature: SWISSPROT Homolog: EC 1.1.1.1 Alcohol dehydrogenase
MNHFPCIPPWKNGGGLAEYAVAPASLTVARPPEVSAAEGASLPTAASTALQQLKAAGVSSFDGSGGGSNGPRNVLVTAASGGVGHYAVQLAKLAGLHVTATCGARNLGLVQGLGADEALDYKTPEGARLRSPSGRKYDAVMHCATGTPWSVFAPVLAGEATVVDVTPGIAAAARSFLQKVTLAKQRLVPLLLVPRKEEMEWLADMTRQGKLRTVVDSRYPLSRAQEAWAKSIGGHATGKIVVEMGGEE

SEQ ID NO: 11404 - DNA, 623 bp, Panicum virgatum
  misc_feature: Ceres CLONE 1727830-R
  misc_feature: Encodes the peptide sequence at SEQ ID NO. 11405
ccttgcaaaactgaatgatgagctctatgaggtgcatcaaattatgacccgcaatgttcaagaggttcttggtgttggtgaaaagctagaccaggtcagtgaaatgtcaagtagattgacatctgacacaagaatatacgcagataaggcaaaggacctcaatcgacaggccttgatccggaagtatgctcctgttgcgatcgtgattggggtagtcttcattctcttttggctgaaaaacaagatatggtgaatgtaacatacaaaggaagccgtgccccatttgactggagaaaggatgaatgaatttctggttggtcgattctggatcaagagatgcttctgtgacttgtatcccgtatctgcccattcaagcgagtactttagcttccttttgctcctgccttacaagctactcaagtgaattcgtttttagtatagaccttactcatgaggaactcagaattttgtggatccgtggaattggtaaatacaagaagtctgtagagttgattttacggcattgggattgtgatttttctggtgaacctattagtaaggattcaggctgatgaactgtactcgtgcacacttcgctacttaatatggatttacgcaatttt

SEQ ID NO: 11405 - protein, 83 aa, Panicum virgatum
  misc_feature: Ceres CLONE 1727830-R
  misc_feature (1)..(83): Pfam Name: Synaptobrevin Pfam Description: Synaptobrevin
LAKLNDELYEVHQIMTRNVQEVLGVGEKLDQVSEMSSRLTSDTRIYADKAKDLNRQALIRKYAPVAIVIGVVFILFWLKNKIW

SEQ ID NO: 11406 - DNA, 616 bp, Panicum virgatum
  misc_feature: Ceres CLONE 1727830
ggcttatcgttccgcgtcaggacagaagactcgaggagtagagagggcgagaacggcgctgcgctggtaaatcattcgccgggcggcggcggcgacgagatcgaggccgggctcccgttcggctcttcttcgtcttgcttcctaggcctcgcacgcgtgcgcctgcacggagcgccacctccctcaccgccaacgacgcagcagttgcaaagggcgccggaacctatctctccgtcacctccgtgctcaactccgtcgaatctacagcctcccctgcccctccacatcctccgccatcaaactcagtcactcaggtcgggctcaacaacgagatcaaggaaattgtaactactaggaaaggaaactgtgcggttaagttgatttggtatctgtaagctttggactgatctacaatattttcacggctcaattgaaagcttactttgtaggttttctactatatttttttagtggttctggctttcttgacacaatggtgaagctgaccatgatagcgcgtgtcactgatggccttcctctggcagaagggttggatgatgggcgagatcagaaggatgctgatttctacaagcagcaagctaaacttatttttaag

SEQ ID NO: 11407 - DNA, 1887 bp, Panicum virgatum
  misc_feature: Ceres CLONE 1727840
  misc_feature: Encodes the peptide sequence at SEQ ID NO. 11408
atttctgccctgtacccctccggctcggctccaccctcgccgccatctcccacctctctccccccaagccctcccgctcccaccgaagcgccgccgctagggtttgctccgccagccgtgaaccctaaaccctactgctctgctccgttcctacagcgcaggccactactcagcaatctagctgctacgcttagctccccgcctcgatcgagagctagggtttcactcgcccccaatctcgggtggtttcgggccggcggcgacgcggcatggcggggtacggggaggagaaccaggacggcatgaacgggtacgaggaggaggaggaagaggaagaggaagaggaagaggtggaggaggtctacgaggaagaggaggaggaaggggacggggaggcggacgacggggctgcggtggcggcggagcctgctgagatgagaagcgagggtggaggtcgaggcctagcggaggtcattggggatgctgacgccggtggcgaggaagggagggatgcggattctgggggcggcgacgcctcggggaagattttcgtagggggtgtagcctgggagaccaccgaagaaacgttcactatgcattttcagaagtatggtgcaataactgattccgttatcatgaaggacaagcatacgaagatgcctcgtggatttggatttatcacattttctgatccatctgtgattgatagggttctagaggatgaacatgtcatagatggaagaacggttgaagtcaaaaggactgttccaaaagaggagatgtcaacaaaagatggtcctaagacaaaaaagatctttgtgggtggtatcccgccatctcttactgaagataaattgaaggagcacttctcctcatatgggaaggtggttgagcatcagattatgcttgaccatagcactgggcgatcacgagactttggatttgtcacgtttgaaagtgaagatgctgttgaaagggttatgtcacaggggagaatgcacgatcttggagggaaacaggtcgaaataacgaaagctgagccaaagaaacctggcgggggtgattcaagctcaaatgggagatacagtcgtgggggtggtggtcaccgtgattcttaccgtggtagtggcggcggcggcggcggctctgggagcagtggtggtggtggctatggatatggaggtggctaccgatcagctgcagcctattatggcagcacagcttatggtgcatatggcagaggatatggatacggcaatactgctggctatgggtctggttatggctcagtttatggtggttccatgtatggtggtccatatggtgcatacggggcatatggtggtgcctatggaggtggtgcatatggtgcaccaggaggctatggaggtgcaggaggatatggtggatacggtggggctggaggcatgggtggtggtggtggtggtagcactggcggtcggggctcgaggtaccacccttatggaaaatgatcatcgattcatagtggttttctaggatcagataataaagagtcctatataccttacctcatttgtgctaccgagacaatggaacattccattcacttcgcctgagtcagcggcatcagaccattttttttcctggaacttagcgttgcactgtgtctggcaagaaagattgtaggctatagtcgctgaaaccagaactaccccctgagctttctgtagaagctgcagctaaaactcttgttgtattcttgtagactgcttatgaaccttagaacccttgaaccaaactttgtgatagtagaaatatgttgtgatggaacatatgtatgtcgatgtaacattcactcgctgatcggctgactgttgctctccttatatgttgagagaagcttcg

SEQ ID NO: 11408 - protein, 407 aa, Panicum virgatum
  misc_feature: Ceres CLONE 1727840
  misc_feature (182)..(253): Pfam Name: RRM_1 Pfam Description: RNA recognition motif. (a.k.a. RRM, RBD, or RNP domain)
  misc_feature (93)..(162): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with altered alkaloid content
  misc_feature: Useful for making plants with modulated nitrogen use efficiency
  misc_feature: Useful for making plants with modulated phosphate use efficiency
MAGYGEENQDGMNGYEEEEEEEEEEEEVEEVYEEEEEEGDGEADDGAAVAAEPAEMRSEGGGRGLAEVIGDADAGGEEGRDADSGGGDASGKIFVGGVAWETTEETFTMHFQKYGAITDSVIMKDKHTKMPRGFGFITFSDPSVIDRVLEDEHVIDGRTVEVKRTVPKEEMSTKDGPKTKKIFVGGIPPSLTEDKLKEHFSSYGKVVEHQIMLDHSTGRSRDFGFVTFESEDAVERVMSQGRMHDLGGKQVEITKAEPKKPGGGDSSSNGRYSRGGGGHRDSYRGSGGGGGGSGSSGGGGYGYGGGYRSAAAYYGSTAYGAYGRGYGYGNTAGYGSGYGSVYGGSMYGGPYGAYGAYGGAYGGGAYGAPGGYGGAGGYGGYGGAGGMGGGGGGSTGGRGSRYHPYGK

SEQ ID NO: 11409 - DNA, 1709 bp, Panicum virgatum
  misc_feature: Ceres CLONE 1727841
  misc_feature: Encodes the peptide sequence at SEQ ID NO. 11410
agacccaacccaacaagcaaacccaccgcttctgcaatccgggccgaaacctttcctcgaacgcaagaagaaccccaacccccgagccggcgatggcgacggtggcgatggacatctcgaagcccacgccggcggcgtccggcgacgaggccgcggcggcggcggcggcgaaggggaggagcggcggcgggggcgagggcctccgccagtactacctccagcacatccacgacctgcagctccagatccggcagaagacccacaacctcaaccgcctcgaggcccagcgcaacgacctcaactcccgagttagaatgctcagggaagagctgcagttgcttcaagagcctgggtcatatgttggtgaggtggtgaaggtcatgggcaaatctaaggttctggtgaaggtgcatccagaaggcaaatatgttgtggatattgataagagcattgatattacgaagatcacaccttcaacaagagttgctcttcgaaatgacagctatatgctccatctgatcctgccaagcaaagttgatccattggtcaatctcatgaaggttgagaaggttcctgactctacttatgatatgattggaggccttgaccagcaaattaaagagatcaaagaggtcatcgagcttccaatcaaacatcctgagctgtttgagagcctcggaattgcccagccaaagggtgtcctcctttatggacctccaggcacaggaaagactttgctggcacgtgcagttgctcatcacactgattgcaccttcatcagggtttctggttctgagctggttcagaagtatattggtgagggctcccgtatggttcgtgaactattcgttatggccagggaacacgcaccgtccattatatttatggatgaaatagattctattggatctgctagaatggagtctggaactggcaacggtgatagtgaagttcagcgtaccatgcttgagcttctaaaccagcttgatggttttgaagcatcaaacaaaattaaggttctgatggcaacgaacagaatcgacatcttggatcaagcccttctgaggcctggacgcatagacaggaagattgaatttccgaatcccaatgaggattcacgtttcgatatcttgaagattcattcaagaaaaatgaacttgatgcgtggtattgatctgaaaaagattgcagaaaagatgaatggagcctcaggagctgagctgaaggcggtctgcacagaagctggaatgtttgcccttcgcgagagaagggtacacgttacacaggaggactttgagatggcggtggccaaggttatgaagaaagacacggagaagaacatgtccctgcgcaagctctggaagtgaggttcatgccaaagatgccccgcaaccttcacagcctcaccaaagctcgtgccttcaaatcctgagctttttccgccttgccatatagcagtggaatggtgtaactgcatgctccggaccttcgccatgtgtctttttttttaataactttatgccgtgcatgcctatgtttaaagttttctgataacagatgtagtatgttgttgcaaagttaaaatttatggattggctagatacgggataattcattgctagctcgcgatgtaccacgttacaatgcctacttggtttgcagtttaccggccgtagtgaaactgcctactggtctggtgttttgtcttc

SEQ ID NO: 11410 - protein, 424 aa, Panicum virgatum
  misc_feature: Ceres CLONE 1727841
  misc_feature (202)..(390): Pfam Name: AAA Pfam Description: ATPase family associated with various cellular activities (AAA)
  misc_feature: SWISSPROT Homolog: EC 3.6.4.3 Microtubule-severing ATPase
MATVAMDISKPTPAASGDEAAAAAAAKGRSGGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 11411 - DNA, 738 bp, Panicum virgatum
  misc_feature: Ceres CLONE 1727864-R
  misc_feature: Encodes the peptide sequence at SEQ ID NO. 11412
aggtaaaaagatcactgagccagttcacccctgcacaatgggataaggatcagtggcatcctttcatggggccactgcgattcatccaagtgcttttcctctgcgccgtcttcatgactgtggaacttaacacattctttctcaaattttgtctatggattcctccaaggaaccccttggtcgtgtacagattgatcctctggtggctgattgccatcccaaccatccgcgagtataactcctacttgcaagacagcaaaccagtgaagaaggttggagccttttgttggctctctctggctatttgcatagtggaactacttatctgcatgaagtttgggcatgggctgtttcatgacccaatgcctacctggttggttatcttttggagctcagtggggattgcgcttgtgattttcttgcttgcatggtcatggaggaatcaccaaaaattccggagaaagcagctgtgatagattgcaagaatttatcttagacaatttaaaactcgattcctttcttggatacaggcgctgtacatatgtgatatgtgatgtaacttacgtattaggggagcccatttttctgcagctcctggcaggaacttggtttgtcagctgtcacagtagtatatgccatagcaatgcttctttatttcaaaaaaaaaaaaagttgtcacagtagctcattgctgccagcatgagatttgacgaataattgagaatattgcagcatcag

SEQ ID NO: 11412 - protein, 156 aa, Panicum virgatum
  misc_feature: Ceres CLONE 1727864-R
  misc_feature (1)..(115): Pfam Name: PSS Pfam Description: Phosphatidyl serine synthase
VKRSLSQFTPAQWDKDQWHPFMGPLRFIQVLFLCAVFMTVELNTFFLKFCLWIPPRNPLVVYRLILWWLIAIPTIREYNSYLQDSKPVKKVGAFCWLSLAICIVELLICMKFGHGLFHDPMPTWLVIFWSSVGIALVIFLLAWSWRNHQKFRRKQL

SEQ ID NO: 11413 - DNA, 788 bp, Panicum virgatum
  misc_feature: Ceres CLONE 1727864
cctcgccttctccacttcgtcgcccgcccgcccgcctcccctctcgtcgtcccacggcctcgcgcgcgccttctccgattcccgcgctcccggcggcggcgcgcgtccggcccggcggcccccctccccgaaattcgcttcgcgcgggcgtcgccgccgattgcgttgtccgttgtggcgtcccgtcggatcgcgtagggcaaccgcaccgcacggctaagaaaggtttcgcggcggctcggttcctcgtctccgcggacgtccaactctgacaggtgttggttccggcggtttctgctgtcgcgggctcagactcagagggcggccgttccctcttgattcgggcggcgcgctgaggacgcgccatggaggcgaagcagcagcgggcgcggcacggcgaggagaggcggccgccggcggcgaccgatggcgccgccgccgccgaggagtacgacccgtggacggcgtggctctacaagccgcacaccatctcggtgctcctcgtcggcgcctgccttctcatctgggcaagtggagcacttgaccctgaaggcgctgctgctcacagcagcgtgacatcaatcaagaggggtgtctgggctatgattgcagtcttccttgcctactgcacgcttcaggcaccttcaacgatacttattaggccccatcctgctgtctggcgcctggtgcatggactggctgtcgtttacctcgtcgctattacctttcttcttttccagaatcgtgatgatgctcgccagttcatgaaacaccttcaccctgatctg

SEQ ID NO: 11414 - DNA, 1217 bp, Panicum virgatum
  misc_feature: Ceres CLONE 1727878
  misc_feature: Encodes the peptide sequence at SEQ ID NO. 11415
acacacctcgccgcgctcttccgtcttcccccctccattccaatcaccgacgtgacgagacgtgagggcgagtggaggctagggttcccgccgcatcgcaccgagggacggaggcgattgatggcacgacgcgggcgcgtggagctgcggcggatcgaggacaaggcgagccggcaggtgcgcttctccaagcgccgctcggggctgttcaaaaaggcgttcgagctcgccctcctctgcgacgccgaggtcgcgctgctcgtcttctcccccgccggcaagctctacgagtactcctccaccagcatagaagatacatatgagcgttaccagcgatttgcgggggcaggaagaaatgcgaatgaaggagaccaaaataacaacgataaccaggatgctgctgcttcagatttacagtccaagcttaggcagatctcaacatggtcagaacgaaacaatgctgacaagtcagatcccaatgaactagagaaactggagaaactcctgacaaatgctttgagggataccaaaaccaaaaagatgttggcaaaacaaaataaaggtggtgctggggcaagtacaagcagccagaacagcaatggacctacgagacaggattaagtactggctctcagcaaatcagcacagagcaaggtgccctgacttctgtgcagttggcaaatgaaacgggcatgcatcatctgttgctatcagtatctcctactattgctgggtagccgagatctgtcgagaacgctgctggcaaggtgtgcagggaaaggaaattcaataacaggatgcgcaaatggtgccagccttgccgaacctgaccttatgttgttgtaccttatgttccctagaattgtgcttgctgagtggtctttatactggttgtgagcttatgtaacctggtgatgtttgcttggatctgtcaaatatgcagtgaccctcgaggaattgtggtttcttgcaacttgagtccttgcctctggtgagagcggatgattagcaaagttcggtgctgtaatcaggtgagtgcctgacagatgtaggtgcatgagttatttctttgagctggtgtaggcgtgcatgatttcatctgcagaaattggttagcatgctaaatctagcccaatggttttacaagttttgagacagaaactgttgttagctcgtcgggttctttatgccttaggatatgaggtgatttctgtgtt

SEQ ID NO: 11415 - protein, 166 aa, Panicum virgatum
  misc_feature: Ceres CLONE 1727878
  misc_feature (10)..(60): Pfam Name: SRF-TF Pfam Description: SRF-type transcription factor (DNA-binding and dimerisation domain)
  misc_feature: Useful for making plants with modulated biomass
  misc_feature: The sequence is a functional homolog of SEQ ID NO 1701 in the 10/412,699 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
MARRGRVELRRIEDKASRQVRFSKRRSGLFKKAFELALLCDAEVALLVFSPAGKLYEYSSTSIEDTYERYQRFAGAGRNANEGDQNNNDNQDAAASDLQSKLRQISTWSERNNADKSDPNELEKLEKLLTNALRDTKTKKMLAKQNKGGAGASTSSQNSNGPTRQD

SEQ ID NO: 11416 - DNA, 1173 bp, Panicum virgatum
  misc_feature: Ceres CLONE 1727901
  misc_feature: Encodes the peptide sequence at SEQ ID NO. 11417
atcctttcacggatccatccaacgagtttggaggcagcgggaagaagcttatgctacctagcttgattaagtagcaggggagtagtattagtaggatccgtagggtgttttttttcggtcggtaggttgattacttgtgaggatgttggcggtgttcagcggcgaggtggtggaggtgccggcggagctggtggcggccggcagccggacgccgtcgcccaagacgagggcgtcggagctggtcagccgcttcctggggagctcggagccggccgtgtccatccagctcgccgacctcgggcacctcgcctactcccacaccaagcaggccctcctccgcccaaggtcgttcgcggcaaaggacgagatattctgtctgttcgagggtgtgctggacaacctggggcggctgagccagcagtacgggctgtccaagggcaccaacgaggtggtcctcgtcatcgaggcctacaagacactgcgggaccgggcgccatacccggccagcttcatgctctcgcagctcaccggcagctacgccttcgtgctcttcgacaagtccaccaactccctgctcgtcgcatctgatcccgagggcaaggtgccgctcttctgggggatcactgcggatggcttcgtcgccttctctgacgacattgacatgctcaaaagatcatgtggcaagtcactagcacctttcccacaaggttgcttctactccaatgctcttggaggcttgaagtgctatgagaaccctaagaacaaggtgactgctgttcctgcaaacgaagaagaaatctgtggtgcaactttcaaggtggaaggctctacagtcctctctgcgctgcattaggaggagatgttggtgcggaggcgggtcaatgcaaaactctgtccatggcggtgtatcataatggcaaggctgcatgcaactggtctacctgtatcatcccccgtaaaaagagaagtactgccagcgtggcaagaacttcatcagtgttgtttgttgttgatgttgtgtgggtgtgggtgtgggtgtgtgtctgaatctgctgtatgcatgtatcccttgttgctcaacttatatggaacttgagaccgggttctagtcgaccagttgcatggatgaacgaagttgtgtatctgcagcaaataattgaactttacttcttt

SEQ ID NO: 11417 - protein, 236 aa, Panicum virgatum
  misc_feature: Ceres CLONE 1727901
  misc_feature: SWISSPROT Homolog: EC 6.3.5.4 Asparagine synthase (glutamine-hydrolyzing)
MLAVFSGEVVEVPAELVAAGSRTPSPKTRASELVSRFLGSSEPAVSIQLADLGHLAYSHTKQALLRPRSFAAKDEIFCLFEGVLDNLGRLSQQYGLSKGTNEVVLVIEAYKTLRDRAPYPASFMLSQLTGSYAFVLFDKSTNSLLVASDPEGKVPLFWGITADGFVAFSDDIDMLKRSCGKSLAPFPQGCFYSNALGGLKCYENPKNKVTAVPANEEEICGATFKVEGSTVLSALH

SEQ ID NO: 11418 - DNA, 1604 bp, Panicum virgatum
  misc_feature: Ceres CLONE 1727915
  misc_feature: Encodes the peptide sequence at SEQ ID NO. 11419
acactctcgcagtcgcagcagcgtgtagcttgcccgggtgcgccggcctcttccctcgcttcgctctcccggcagccgctaactagctacgcaatccaaagctcagagggagctgaagctagctagtagctaccaatggctgcgcctcctcctcctcctcctcttagcagcagcagcgtgccacggcgcggcgccgccgccgtcgtgccggcattgctgctggcggcggccatggcgatggcggccttccccggcgccggcgcgcagccgtccccggggtactacccgagctcgcggttccggcccatcccgttcaaccgcgggtacaccaacaagtggggcccgcagcaccagacgctctccggcgaccactccgccctcaccatctggctggacaagacctgcgggagtagtttcaagtcgaagcacgcctaccggaacggctacttctccacccgcatcaagctccccgccggctacaccgccggcaccaacaccgccttctacctgtcgaacaacgaggcgcaccctgggttccacgacgagatcgacatggagttcctgggcaccatcccgggggagccctacacgctgcagaccaacgtgtacgtccggggcagcggcgacgggcgcatcgtggggcgggagatgcggttccacctctggttcgaccccacggcggggttccacacctacgccatcctctggaaccccgacgccatcaccttcttcgtcgacgacgtgcccgtccgccgctacgagcgccgcaccgagctcaccttcccggaccgccccatgtgagtgtacggctccatctgggacgcctccgactgggccaccgacgacggccgccaccgcgccgactaccgctaccagcccttcgtcgcgcgcctcgaccgcttcgtcctcgccggctgctccgccgccgcgccggcctcctgccgccccgtcccggcctcgccccgcggcgccggcctcacgccgcagcagtacgccgccatgcgctgggcgcagcagggccacatggtctactactactgcaacgacttccgcagggaccactcgctcacgccagagtgctagtccgccgccggccatggccgccggtagatcttggccggttgcgctcctggtgggatgatgatcggcgagatctggcggttggcgcgcgcgtgctccgagtccgacgatctctttcttggcgctgtttgtttccttgcctgccttggatgtttgctagtatttggttgtttgtttttttttttccttgcatcaatcgatctcccgtgaacggaaggctagtgaggccgaccggatcgatcgatctcgatctcccgtggctgccctaccaccaccgccgctcagctgctagctagtgaggcgagccgggcggggtggttgaggcggttggtcgttggcgcattttgccaacaaaagggggtgtcgtcgccgtctgccgttcgcttgttccgctgccttttttccatttggtcagtctcacatgcgtgccgccccaaaggggcaagcttgcatgattcatggcatcatgcatgcccactgtaatacggaactggttataccatatatatatatttaatatgtat

SEQ ID NO: 11419 - protein, 189 aa, Panicum virgatum
  misc_feature: Ceres CLONE 1727915
  misc_feature (28)..(189): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MAMAAFPGAGAQPSPGYYPSSRFRPIPFNRGYTNKWGPQHQTLSGDHSALTIWLDKTCGSSFKSKHAYRNGYFSTRIKLPAGYTAGTNTAFYLSNNEAHPGFHDEIDMEFLGTIPGEPYTLQTNVYVRGSGDGRIVGREMRFHLWFDPTAGFHTYAILWNPDAITFFVDDVPVRRYERRTELTFPDRPM

SEQ ID NO: 11420 - DNA, 640 bp, Panicum virgatum
  misc_feature: Ceres CLONE 1727916
  misc_feature: Encodes the peptide sequence at SEQ ID NO. 11421
accgcctcacctcgtcatctgctccaaggcttgtgcaatcgtggtgctcggtgtcgaacgatgcgcggctgcaagatgggtatgactccgatgctgcccttgctgctgctggtgctcgctgccggcgccggcgcggcggcgtcgcacacgtcgtcgccgtcgtcgtgcccggcgacgccgccggactcgggggccacgctgcaggtgtcgcacgcgttcgggccgtgctcgccgctggggcccgaggcggcgtccccgtcgtggtcggggttcctcgcggaccaggcggcgcgcgacgcgtcgcggctgctgtacctggactcgctggccgtccggggccgcgcgtacgcgcccatcgcgtcggggcggcagctgctgcagacgcccacctacgtggtgcgcgcccgcctcggcacgccggctcagcagctgctgctcgccgtcgacaccagcaacgacgccgcgtggatcccctgcgccggctgcgcgggctgccccacctccacgcccttcaatccggccgcctccacctcgtaccgcccggtgccctgcggctcgccgctgtgcgcgcaggcgcccaacgcggcgtgcccgcccaacagcagggcctgcggcttcagcctcacctacgcggactcct

SEQ ID NO: 11421 - protein, 193 aa, Panicum virgatum
  misc_feature: Ceres CLONE 1727916
  misc_feature: SWISSPROT Homolog: EC 3.4.23.12 Nepenthesin
MRGCKMGMTPMLPLLLLVLAAGAGAAASHTSSPSSCPATPPDSGATLQVSHAFGPCSPLGPEAASPSWSGFLADQAARDASRLLYLDSLAVRGRAYAPIASGRQLLQTPTYVVRARLGTPAQQLLLAVDTSNDAAWIPCAGCAGCPTSTPFNPAASTSYRPVPCGSPLCAQAPNAACPPNSRACGFSLTYADS

SEQ ID NO: 11422 - DNA, 688 bp, Panicum virgatum
  misc_feature: Ceres CLONE 1727917-R
  misc_feature: Encodes the peptide sequence at SEQ ID NO. 11423
ggggacatggcgcgcctcaactttcccgccctccgccgcggcggcgcacacctggcaggcccgctccacgcctctgtggatgccaagctcacgcccatctgccagtccctcaccgggtccaagagcggctcccccgacgccgagtcctcggccgcgtccccgccggactcgcccaagtgctcggcgtcgacggagggggaggaggagtcggtctccgccggctccccaccttccccgacgcaggtgccgcctgtcccagagatggcgaagctggacttcacggaggcgccgtgggacgagacggaggccttccacctgcgcaagtacccgtcctgggagatcgactgggactccatcctctcatgaagaatcaactgcaactgttatagtagtagtagcaaagattcagtcagtccagctcaatgacagctctgtgtaattttcatttgggtttttgcagctgcggtggctcgatggcattttagacatcggccatggcggctgcaagtagcaatgagtaactagcagctagtaagtcgcccagtgttgtgatgatgtagcagtcagtacgtgttaatctcctggttgagctgccggttgttttttctcagggcacggccagtcgagaaggtcaagtgtaatcccttgttattgttatatgttgcagcttaatccatgtagcttacgt

SEQ ID NO: 11423 - protein, 121 aa, Panicum virgatum
  misc_feature: Ceres CLONE 1727917-R
  misc_feature: The sequence is a functional homolog of SEQ ID NO 1288 in the 10/374,780 US patent application
  misc_feature: The sequence is a functional homolog of SEQ ID NO 1434 in the 10/412,699 US patent application
GDMARLNFPALRRGGAHLAGPLHASVDAKLTPICQSLTGSKSGSPDAESSAASPPDSPKCSASTEGEEESVSAGSPPSPTQVPPVPEMAKLDFTEAPWDETEAFHLRKYPSWEIDWDSILS

SEQ ID NO: 11424 - DNA, 717 bp, Panicum virgatum
  misc_feature: Ceres CLONE 1727917
agagagacgcctcaacccaccccaccccacaagaacacgaagccacatccccattccactccacggtgaggttgagcgatcagaccagatcatccgcgacgcagcaacaggtttgttctctgaactctctgattctttttagcagcagggacgctcgcacagcacgagaaaggtccggttcaagaaggctcttcctttgggtttattagaatcctcagaggaagattgttcttgggtttggatttttttctcacctcatcacacctctcctaggaggaacagagatccagagaaccttttttctcttctggattcttgccgcctttttggcattcgaaagggttcttttgcaatacccttcttgttcaccaaccctttttctttgcacaaacctcgttgtttctctacttttattgaggaacagcgctgatttccaaacctattttctactttgattttgcataaaaaagctccttttatttcttcccgttttcagttctcccctgcctcttcttctagctccatccaaagcttcttcatctattcataatggccgcagccatagatatgtacaagtactacaacactagtgcacaccagatcgccgcctcctcttctttcggatcaggagctcgcgaaaagcctcgaacctttttataacaaatgtttcctcctcttcgtcttcctccccctaccactactactccgtcctcttcc

SEQ ID NO: 11425 - DNA, 1514 bp, Panicum virgatum
  misc_feature: Ceres CLONE 1727928
  misc_feature: Encodes the peptide sequence at SEQ ID NO. 11426
aaaaatctctctaccgctccaccctctctagcggcgaggcgaggcggggaagaagagggagcggcgaggatgctgtgggtggacaagtaccgccccaagaccctagacaaggtcaccgtccacgaccaggtcgcgcagaacctcaggaagctcgtgtcggagcaggattgcccgcacttgctgttctatgggccgtcggggtccgggaagaaaaccctaatcctggcgctcatcaagcagatgttcggcgccggctcggagaaggttaagatggagaacaagacatggaagatcgatactggaacaagaacacttgagatagagttggtgatgttgtcgagtgctcatcatgtggaaatgaaccccagtgatgctgggtttcaggacaggtatgttgtccaggaggtcatcaaagagatggcgaagaataggccaatcgatgccaaaggcaagagagcatttaaagtccttgtgttaaatgaagttgacaaactctcacgagaagcccagcattccctccgtaggactatggagaagtatagcgcatcatgcagactgatcctgtgctgtaacagctcatcaaaagtcacagaagctgtaagatcccgttgcttaaatgtgcgagtgaatgctcctagtgaagatcagattatccaagttctagagttcattgggaagaaagaaaacttgcagcttccagctggatttgctgctcgtattgctgcacaatcaaaccgtaatctgagacgggcaatactgttttttgagacttgcaaagtgcaacaatacccatttacatcaaatcaagtcgcacctcctcttgactgggaacaatatgtgtctgaaatatcaactgatatcctgacagaacaaagccctaaaaggctatatgctgtacgccagaaattctacgaattacttgtcaattgtatcccacctgaaagtattttgaagaagttgttggcggaattacttaagaagttagacgctgatctgaagcacgaaatctgtcactgggctgcacactatgagcacaagatgcgccttgggtcaaaagccatttttcacctagaagctttcgtggcaaagttcatgagcatttacaaggagttcctggtggcttcatttggttgagcaaaatccaaagcgttaggattgtttccgacgaattcatgagcatttacaaggagttcctggtggcttcatttagttgagcaaaatccaaagcgttagggttgtttccgacgaagttgcatcatctggggccctgtctgcgtagtttgttcgtaccaaactatggacgattagctacatccagtctgtttaaccaccatcaatgtcattcaggttccgtggttacagctcttcagtatttacttcacgttgaggatgctacgatggcatccgaagtctcatttcacttagctgccacatgttactactcagaagcaaaagcctgttgactgaaaaaaagaacttacgatggtggcaacaagcaagatgctaattatatt

SEQ ID NO: 11426 - protein, 354 aa, Panicum virgatum
  misc_feature: Ceres CLONE 1727928
  misc_feature (36)..(238): Pfam Name: AAA Pfam Description: ATPase family associated with various cellular activities (AAA)
  misc_feature: SWISSPROT Homolog: EC 2.7.7.7 DNA-directed DNA polymerase
MLWVDKYRPKTLDKVTVHDQVAQNLRKLVSEQDCPHLLFYGPSGSGKKTLILALIKQMFGAGSEKVKMENKTWKIDTGTRTLEIELVMLSSAHHVEMNPSDAGFQDRYVVQEVIKEMAKNRPIDAKGKRAFKVLVLNEVDKLSREAQHSLRRTMEKYSASCRLILCCNSSSKVTEAVRSRCLNVRVNAPSEDQIIQVLEFIGKKENLQLPAGFAARIAAQSNRNLRRAILFFETCKVQQYPFTSNQVAPPLDWEQYVSEISTDILTEQSPKRLYAVRQKFYELLVNCIPPESILKKLLAELLKKLDADLKHEICHWAAHYEHKMRLGSKAIFHLEAFVAKFMSIYKEFLVASFG

SEQ ID NO: 11427 - DNA, 1321 bp, Panicum virgatum
  misc_feature: Ceres CLONE 1727948
  misc_feature: Encodes the peptide sequence at SEQ ID NO. 11428
gtcggtctgttttcggatgtctgcgctccgactaaaaccctaggtatcccagttcttgaaggtccgtcgaggggaggagatggcggcggtggatgggcgcagcggcgataacctagccaggggcgacggtggcggtggtcggatccaccggctggaggtcgagaacttcaagtcgtacaagggtacgcagacgattggacccttcttcgatttcacggccatcatcggccctaacggcgccggcaagtcgaatcttatggacgccatcagcttcgtgcttggcgtgcgctcagcgcacctccgcggcgcgcagctcaaggacctcatctacgccctcgacgaccgcgacaaggacgctaagggacgcagggcgtccgtccgcctcgtctaccgccaacccaaccaggaggagctccacttctcccgcaccattaccggcgcaggcggcagtgagtaccgcatcgacggccgccttgtcacctgggacgagtataacggcaagctcagatccctcggcatcctcgtcaaggcccgcaatttcctcgtcttccagggtgatgtggaatccatcgcctccaagaaccccaaggagctcactgcgcttctggagcagatctcaggctccgatgagcttaggagggagtatgacgagctcgaggaggagaaagccagggccgaagagaactctgcgcttgtctatcaagagaaaaggaccattgtcatggagcggaagcagaagaaggcgcaaaaagaagaggcagagatgcacctacgtctccagcaggacctgaaactgttgaagacagagcattccctgtggcaactctataccatcgagaaagacatagagaaaatggaggctgagcttgcagaggacagagagtcccttcagcaagtgcaggaagagaatcaatctgctgaaaatgaactaactgcaaaaaagaaggagcaaagtgcttttctcaagaaaatgacattgtgcgaaaagagtatagccaagaaaaagcttgaactagacaagaagcatcctgagcttcttaaattgaaagagcaaatctctcggctcaaatcaaaaatcaaaagttgcaagaaagagattgacaaaaagaaggatgataacaagaagcatctggaagagatgagaaggctgcaaagtgctctagttgatgtcacaaaagctattgaggaattgaatgagcaaggacaagataaaagtggaaaactgcagttagctgacgaccaactccgggagtatcatagaattaaggaggatgcaggaatgaagacagcaaagctgagagatgagaaggaagtcatagac

SEQ ID NO: 11428 - protein, 413 aa, Panicum virgatum
  misc_feature: Ceres CLONE 1727948
  misc_feature (21)..(403): Pfam Name: SMC_N Pfam Description: RecF/RecN/SMC N terminal domain
MAAVDGRSGDNLARGDGGGGRIHRLEVENFKSYKGTQTIGPFFDFTAIIGPNGAGKSNLMDAISFVLGVRSAHLRGAQLKDLIYALDDRDKDAKGRRASVRLVYRQPNQEELHFSRTITGAGGSEYRIDGRLVTWDEYNGKLRSLGILVKARNFLVFQGDVESIASKNPKELTALLEQISGSDELRREYDELEEEKARAEENSALVYQEKRTIVMERKQKKAQKEEAEMHLRLQQDLKLLKTEHSLWQLYTIEKDIEKMEAELAEDRESLQQVQEENQSAENELTAKKKEQSAFLKKMTLCEKSIAKKKLELDKKHPELLKLKEQISRLKSKIKSCKKEIDKKKDDNKKHLEEMRRLQSALVDVTKAIEELNEQGQDKSGKLQLADDQLREYHRIKEDAGMKTAKLRDEKEVI

SEQ ID NO: 11429 - DNA, 1302 bp, Panicum virgatum
  misc_feature: Ceres CLONE 1727951
  misc_feature: Encodes the peptide sequence at SEQ ID NO. 11430
atcaaccgagcagcgatcgcagagctcggagcactcgcctagacaccagcaatggcggcggctcgtctcgtcgtcgcgttcctcgccgtgtcctccggcttcctggccgtgtccgggcagaagttcaacgccatcttcagcttcggcgactccatgtccgacaccggcaacctctgcgtgaacggcccccccgccggcctgaccctcacccagccgccctacggcgagaccttcttcggccgcgccacctgccgctgctccgacggccgcctcgtcgtcgacttcctcgccgagaagtacgggctgccgctgctgaagccgtcgaagcagggcggctccgacttcaagaagggcgcgaacatggcgatcatcggcgccaccaccatggactcgggcttcttccagtcgctgggcatcgccgacaagatctggaacaacgggcccctcaacacccagatccagtggttcaagcagctcatgccctccatctgcggctccacacaggcctgcaagtcgtacctgtccaagtccctgttcgtgctgggcgagttcggcggcaacgactacaacgccatgaccttcggcagctactcgccggagcaggcgagcgggcagagcgccaccatcgtggacgccatcggcagcggcgtggagcagctgatcgcgctgggcgccgccmacgtagtggtcccgggggtcctccccgtggggtgcttccccatctacctgacgctgtaccagacctccaacgccggcgactacgaccagtacggctgcctgcggcggttcaacgcgctgtcggcgcggcacaaccagctgctgcagagcaaggtgacaagcctgcagggccagtacccgggcgcccggatcatgtacgccgacttctacagccacgtctacgacatggtccggagccccgggagctacgggttcagcaccaacctccgggcctgctgcggcgccggcggcggcaagtacaactaccagaacggcgcgcggtgcggcatggccggcgcgtcggcgtgcggcaacccggcggcgtcgctcagctgggacggcatccacctcacggaggcggcgtacaagaagatcgccgacgggtgggtcagcggggcgtactgccacccggccattggagcctagagggagctccaggaatcagcatcaaggggtgactggctggctggtttggtggatggctcctcaagttaggggagcgggtgattaattgtttggtttctctagctggaaaacaagaagatgctctgggagaataatcaattaagcataattttcttgtgt

SEQ ID NO: 11430 - protein, 363 aa, Panicum virgatum
  misc_feature: Ceres CLONE 1727951
  misc_feature (28)..(351): Pfam Name: Lipase_GDSL Pfam Description: GDSL-like Lipase/Acylhydrolase
  misc_feature: SWISSPROT Homolog: EC 3.2.1.51 Alpha-L-fucosidase
  misc_feature (210)..(210): Xaa is any aa, unknown, or other
MAAARLVVAFLAVSSGFLAVSGQKFNAIFSFGDSMSDTGNLCVNGPPAGLTLTQPPYGETFFGRATCRCSDGRLVVDFLAEKYGLPLLKPSKQGGSDFKKGANMAIIGATTMDSGFFQSLGIADKIWNNGPLNTQIQWFKQLMPSICGSTQACKSYLSKSLFVLGEFGGNDYNAMTFGSYSPEQASGQSATIVDAIGSGVEQLIALGAAXVVVPGVLPVGCFPIYLTLYQTSNAGDYDQYGCLRRFNALSARHNQLLQSKVTSLQGQYPGARIMYADFYSHVYDMVRSPGSYGFSTNLRACCGAGGGKYNYQNGARCGMAGASACGNPAASLSWDGIHLTEAAYKKIADGWVSGAYCHPAIGA

SEQ ID NO: 11431 - DNA, 3050 bp, Panicum virgatum
  misc_feature: Ceres CLONE 1727968
  misc_feature: Encodes the peptide sequence at SEQ ID NO. 11432
accacggctcgtcgcaatcgtcttcttccccacgcgaggccagatccaaccttccgccgcggccgacctccgccatggctcccaccgtcccttcggcggcgaagtccgcatctccttcccaaccttccgggaagagcgaggtggctgatctgaagcagcagctgcggcagctcgcggggagccgcgcgcccgatgcggatgaccagcgccgcgacgtcttcaagcgggtgatctcctgcatgacggccggcatcgacgtgtcggccgcgttcggggagatggtgctctgctccgccacctccgacgtcgtcaccaagaagatgtgctacctctacgtcggcgcccacgcccgcgctcacccggacctcgcgctgctaaccatcaacttcctccagcgggactgccgcgatcaggaccccaccatccgcggcctcgcgctccgcagcctctgttctctccgtgtccccaactttgtcgagtatctcgtcacgccactcacgaccgggctcaaggaccccagcgcctacgtccggatgatcgccgctgttggtgctgccaagctgtatcacatatctgccaccgcctgcattgatgctgatctgcctgcttcgctcaaggcgctaatgctctccgatccagatgcacaggtagttgccaattgcctgcattcgttgcaggaaatctggaccttagaagctgctaattcagaggcagcagcaagggagattgaaacattgtatagcaagccagtggtattttacctgctaaacaagatcaaagagttcagtgagtgggcgcagtgccttgtccttgagttggcatcaaagtttctaccatctgataataatgaaatttttgacataatgaacctgctggaggataggcttcagcatgcaaatggagctgttgttttgtcaacaattaaagtatttctccatttgacaatgtccatgactgatgttcatcaacaggtttatgagcgtataaaagcacccttgcttactttagtgggtgctgggagtcctgaacagtcatatgctgtgctatgtcatctacatctcctggtgatgcgtgctccaatgttattttcctctgactataaaagtttttactgtcaatttagtgatccatcatatgtgaagaagctgaaacttgagatgttgactgccatagcaaatgaaagcaacacctatgaaattgtaactgagctgtgtgaatatgctggaaatgtcgacgtaccaattgcaagagagtctatccgggcagttggaaaaatagcactccagcaatatgatgttaatgccattgtggacaggcttctacaatttcttgaaatggataaggattatgttactgctgaaactctagtcttggtgaaagatcttcttagaaaatatcctcaatggagccatgattgtatagctgttgttggaaatatcagtagcaaaaatattcaggagccaaaaggtaaagcagctctcatatggatgttgggagaatattctcaagacatgcatgatgctctgtatgtccttgaaagtcttgttgaaaactgggatgaagagcactctcctgaggttcgcttgcatctcctgactgcagtgatgaaatgtttcttcaagagaccaccagaaacgcaaaaggccttgggagctacattagcagctggtctatctgacactcaccaggatgttcatgacagagcgcttttctactacaggcttttgcaatatgatcctgctgtggcagaacgtgtagtaaaccctcccaaacaagctgtctctgtatttgcagatacgcagagcagtgaaatgaaagatcggatatttgatgagttcaacagtctatcagttgtatatcagaagccatcttacatgtttacagataaggagcatcgtggaccatttgagtattctgaggatcttacaaacttggctgttggtacagaggctcaggaaaatgtaatatctgcccaaagataccaagaaaatgataatgaccttttgcttagtacgtcagataaagaggacaatggtacaagagccagcaatggttcagccacctctacatacaatgctccttcggacttgattggctcttcattgataagttctcaaacaccagctgaagcttcactaataaatactggtgggccgacatattcctcgcaatcaaatttcagtcttgatgaccttcttgggcttggtgttactgaaactcctgcgcctccaccaccaccagcactgacccttaactcaaagcctgtgttagatcctggtacgttccagaggaaatggggccagttagcattggcactgactcaggaatgctctttgagcccacaaggagcagcatcattaatgaacccccaatcgctcatccgccatatgcaaagcaattacatccaatgtattgcttcaggtggtcagcctccaaactacaagttctttttctatgctcagaaagatggagctactgctttcttccttgtagaatgtattgtcaatacagcatcagcgaaggcacagctcaaaatcaagggtgatgatggaactgctgctgaggcattctcgactttgtttcagtcagccttgtccaaatttgggctttcttgatcctgagcattttctgcctcaatgattcactggcccccagtttttctgccctgtcgcagtttgtccactgtctgcagcccttagacttcgagtaagcttgtccagtgtacattttatcatcaaaatattggagaacgagatgaaacattgccgtttgagggtgtagatcagcaaggagagaacactggagttttgtaagggatggtaatctgatttgttccctgtgggtgaagaactgggcgtctgtacatgtcatccagagaaacagttgtgctctgatgttcaggggcctgctggtttgatgttgcctattgtggagctgaatatcctttttttcccaagggatgtggaaagaatagggatcacccttcatgtatgttatttacttatttttatctacctgcacagatcaataaagatgttcataatttgtcc

SEQ ID NO: 11432 - protein, 846 aa, Panicum virgatum
  misc_feature: Ceres CLONE 1727968
  misc_feature (26)..(555): Pfam Name: Adaptin_N Pfam Description: Adaptin N terminal region
MAPTVPSAAKSASPSQPSGKSEVADLKQQLRQLAGSRAPDADDQRRDVFKRVISCMTAGIDVSAAFGEMVLCSATSDVVTKKMCYLYVGAHARAHPDLALLTINFLQRDCRDQDPTIRGLALRSLCSLRVPNFVEYLVTPLTTGLKDPSAYVRMIAAVGAAKLYHISATACIDADLPASLKALMLSDPDAQVVANCLHSLQEIWTLEAANSEAAAREIETLYSKPVVFYLLNKIKEFSEWAQCLVLELASKFLPSDNNEIFDIMNLLEDRLQHANGAVVLSTIKVFLHLTMSMTDVHQQVYERIKAPLLTLVGAGSPEQSYAVLCHLHLLVMRAPMLFSSDYKSFYCQFSDPSYVKKLKLEMLTAIANESNTYEIVTELCEYAGNVDVPIARESIRAVGKIALQQYDVNAIVDRLLQFLEMDKDYVTAETLVLVKDLLRKYPQWSHDCIAVVGNISSKNIQEPKGKAALIWMLGEYSQDMHDALYVLESLVENWDEEHSPEVRLHLLTAVMKCFFKRPPETQKALGATLAAGLSDTHQDVHDRALFYYRLLQYDPAVAERVVNPPKQAVSVFADTQSSEMKDRIFDEFNSLSVVYQKPSYMFTDKEHRGPFEYSEDLTNLAVGTEAQENVISAQRYQENDNDLLLSTSDKEDNGTRASNGSATSTYNAPSDLIGSSLISSQTPAEASLINTGGPTYSSQSNFSLDDLLGLGVTETPAPPPPPALTLNSKPVLDPGTFQRKWGQLALALTQECSLSPQGAASLMNPQSLIRHMQSNYIQCIASGGQPPNYKFFFYAQKDGATAFFLVECIVNTASAKAQLKIKGDDGTAAEAFSTLFQSALSKFGLS

SEQ ID NO: 11433 - DNA, 2092 bp, Panicum virgatum
  misc_feature: Ceres CLONE 1727975
  misc_feature: Encodes the peptide sequence at SEQ ID NO. 11434
gtcgagttctcacttctcagtccactctgcgacgccccgtcgagcctctagatccgagctaggcccagcactcgccactcgggaacactaggaaggcaccagcaagggggccgcggtggcgaaggcgctcgaaggcatcgccgacgcgccggggacgctagcggaggcgcggctcgccgtcgccgcgcacgccgtgctgcgctcccccaacgccgacgccgacatatgggacgcggaggcgacctgcgtcaacagaagcctcctctcggcgatcgacgagatcctccaactcaaggagaccgctgcgttccccacggcctccccggctcgccgccgcatggacggcgccctcgccgtcgccatgtcgcgcctcatggacgagttcctcctcctcagggtctgggacgcttcccagctggagggcaaggaaggcctccgcgtcgccgtcgagaagctctcagtatcgttggcttcggcttcagttggcagcggcgtgtggcccgccttccccaccggcggcaccaccagcaccggggagctcagcgtgagcaccaccgacgagctccgcgcgtccggcaggagcctctcgagctggcctgacaacgcgctgaccacctccgtggatggcaccttctcggatgacctccatctgatctgcccggcaagcttgcctgtcctccatgagatcgcgacgcgggtcatccgtgccggctacacaaaagagctgctccagacattcaccaaggccccctgccatgtcttagacaggttcttgtcaatccttgagctggaccggcctttcttggcggccaacagagtcaacttcgaggatgccgagtggtggacagcggaggacatggtaaagcggtggatcttggcgaccaagctcgtcgggaaggtcctcaccgtcatgcaaacccagctcatggcgcaggaatgcggagccttcgacaggttcaaggacgactacttcatggccatcgcgaagcagagcatcctcgtcctgctcaagttcgcggacgggttcaccagcaccagatcaccggagaagctcatctatgtcctggaattgtacggggcactagacagctccgctcctagcctcctgcccctgttcaccgggaagcacggggagctcatctcccggcaggtgccagtcgttctcgccaagctggagcgcgcgttgagggccgcgaccggcggcctcgtcgccaagatccgaacagactcttctcgggcagaaggcgtcggcgtccatccgctggcgcggtacgccatgacctgtgtcgagctgctggcgccgcaccgcgaggcgctggacctcatcctcgcgaacgccggcgaagatcccgccggcggagccgagggcgtggcgtcgtttggcgggctcgtgtcggagctgatcgccggcatggaacgcaaccttgaggagaaatccgcggtcgcctgcgcgggcggctcgctgtcgcgccacctcttcctggccaacaacacaagcttcgtgctgagccgcgccgcggacgccggcgtcgcgtctctgctcgggggcgactgggccgcgcggcgtcggggccggctcgagcagcacgcggcgagctacctcgaggcctcctggggcccggccgtcgcgtgcctggaggcggccgcgggtggcggcggcaagccggcgcgggcgctggcgaagttcaacgccgcgttcgaggaggcgcgcggcagccaggcgggccgcgaggtcccggaccccgcgttccgggcggccctgcgggaggccatgtcggagatggtggttcctgcttacggcgcgttcctggagaagcaccccaagcttggaaaatccgtcaggtacacggctgccgacgtggcccaatctctgtcggaattgttcgaaggagatactggcatggcggaaaatcgttggtgatgttgcacagtgtagtgtgtagaatcgaagtaccaagtagcaaaacctctctaaccatctgtgagagagtaagcctagtctacggacatttccgagactttttttttttataatacgtacctgtattagaagataagggaaacgtacaaatacaagtacatactgcaagtg

SEQ ID NO: 11434 - protein, 527 aa, Panicum virgatum
  misc_feature: Ceres CLONE 1727975
  misc_feature (5)..(517): Pfam Name: Exo70 Pfam Description: Exo70 exocyst complex subunit
MDGALAVAMSRLMDEFLLLRVWDASQLEGKEGLRVAVEKLSVSLASASVGSGVWPAFPTGGTTSTGELSVSTTDELRASGRSLSSWPDNALTTSVDGTFSDDLHLICPASLPVLHEIATRVIRAGYTKELLQTFTKAPCHVLDRFLSILELDRPFLAANRVNFEDAEWWTAEDMVKRWILATKLVGKVLTVMQTQLMAQECGAFDRFKDDYFMAIAKQSILVLLKFADGFTSTRSPEKLIYVLELYGALDSSAPSLLPLFTGKHGELISRQVPVVLAKLERALRAATGGLVAKIRTDSSRAEGVGVHPLARYAMTCVELLAPHREALDLILANAGEDPAGGAEGVASFGGLVSELIAGMERNLEEKSAVACAGGSLSRHLFLANNTSFVLSRAADAGVASLLGGDWAARRRGRLEQHAASYLEASWGPAVACLEAAAGGGGKPARALAKFNAAFEEARGSQAGREVPDPAFRAALREAMSEMVVPAYGAFLEKHPKLGKSVRYTAADVAQSLSELFEGDTGMAENRW

SEQ ID NO: 11435 - DNA, 1854 bp, Panicum virgatum
  misc_feature: Ceres CLONE 1727977
  misc_feature: Encodes the peptide sequence at SEQ ID NO. 11436
attctcccccctccgcgtttctccccgcctctcctcctcctccccccaaatccgcaccaccgccggcccatccgggccacggccgcccaatgccgccctccgccgacgcaatgccgccccccggggacgccgccggcgtgcgcatgatctcctcccaggagctccgcgcgcacgcgtcccccgacgacctctggatctccatctccggcgacgtctacgacgtcacgccatggctgccccaccaccccggcggggacctcccgctcatcaccctcgcggggcaggacgccaccgacgccttcgccgcctaccacccgccctccgcgcgcccactcctacgccgcttcctcgtcggccgcctctccgactacaccgtctccccggcatccgccgactaccgccgcctcctcgcgcagttctcctccgcgggcctcttcgaacgcgtcggccccacccccaaggtcctgctcgccatcatggtcacgctcttcagcgccgcgctctacctcgtcctcgcctgcgccaccgcctccgcgcacctcctcgccggcgacctcatcggctttatctggatccagtccggctggatgggccacgactcgggccaccaccgcatcacgggctacccgctcctcaaccgcgtcctccagatcctctccggcaactgcctcaccggcctcagcatcgcctggtggaaatgcaaccacaacacgcaccacatcgcctgcaacagcctcgaccacgacccggacctccagcacatgccgctcttcgccgtctcccccaagctctttggcaacatctggtcctacttctaccgccgcaccatggccttcgatgccgcctccaaattcctcatcagctaccagcactggaccttctaccccgtcatgtgcgtcgccaggataaatcttctcacccagtccgccctcttcgtcctcaccgagaagagggtgccgcagcggtttcttgagatcgccggggttgccgcattctaggcctggtacccgttgctggtgtcctgcctgcccaattggtgggagagggtagcgttcgtgctttccagcttcacaatctgcgggattcagcacgtccaattctgcctgaaccatttctcgtcggaggtgtatgtcgggccgccaaaggggaatgactggttcgagaagcagacggcgggcacactcgacatcttgtgctccccgtggatggattggttccatggcggcctgcaatttcagattgagcaccatctcttcccccgtctacctcggtgccaccttcggaaggtcgcgccctacgtgcgcgatctttgcaagaagcatgggctgccatattctgcagcctcattctgggatgcaaatgtgcttacatggaagacactgagggctgctgcattgcaggctaggaatgccacaagtggtgcggcgccgaagaatttggtctgggaggctgtgaacacccatggataagtgggagaaggattgaagtttcaggcaactggtggtgttgacccttgtatgcatgcaagtatctgattatttctcagttgtttcgagagattgatcattacccgctggagtcgggttggattttttcgtgttggccagtgactgtctatccagtggaagggtgagttcatccttcaattgtctggttgttcaccagttgttctactatccctatcatggtaactatattatattccttgcattagattatgatgctctttttaagatcatgcccatttgattttgcttgcactgtcaagattgtgggtgtttgatgttcgtgaatctgtaagcttattgaatggcgggtaaaattgtgtggtactcctgtattttctcggttgct

SEQ ID NO: 11436 - protein, 302 aa, Panicum virgatum
  misc_feature: Ceres CLONE 1727977
  misc_feature (19)..(92): Pfam Name: Cyt-b5 Pfam Description: Cytochrome b5-like Heme/Steroid binding domain
  misc_feature (154)..(297): Pfam Name: FA_desaturase Pfam Description: Fatty acid desaturase
MPPSADAMPPPGDAAGVRMISSQELRAHASPDDLWISISGDVYDVTPWLPHHPGGDLPLITLAGQDATDAFAAYHPPSARPLLRRFLVGRLSDYTVSPASADYRRLLAQFSSAGLFERVGPTPKVLLAIMVTLFSAALYLVLACATASAHLLAGDLIGFIWIQSGWMGHDSGHHRITGYPLLNRVLQILSGNCLTGLSIAWWKCNHNTHHIACNSLDHDPDLQHMPLFAVSPKLFGNIWSYFYRRTMAFDAASKFLISYQHWTFYPVMCVARINLLTQSALFVLTEKRVPQRFLEIAGVAAF

SEQ ID NO: 11437 - DNA, 749 bp, Panicum virgatum
  misc_feature: Ceres CLONE 1727981
  misc_feature: Encodes the peptide sequence at SEQ ID NO. 11438
gcgtccaccggttcctctgttcccttcttctcgcaactcggctttgcaggagcagagttttcttcccccacctccccagagatactgtcgacgagaaccgccgccatggccgggaagggagacgggccggcgatcgggatcgacctcggcacgacctactcgtgcgtcggggtctggcagcatgaccgcgtcgagatcatcgccaacgaccagggcaaccgcaccacgccgtcgtacgtcgcgttcaccgacaccgagaggctcatcggcgacgccgccaagaaccaggtcgccatgaaccccatcaacaccgtcttcgatgccaagcggctcatcggccggcgcttctcggacgcgtcggtgcagagcgacatcaagctgtggcctttcaaggtggtcccgggctccgccgacaagcccatgatcggggtgatgttcaggggcgaggagaagcagttctcggccgaggagatctcctccatgatcctgaacaagatgaaggagacggccgaggcctacctcggcagcaccgtcaagaacgccgtcgtcaccgtgccggcctacttcaacgactcccagcgccaggccaccaaggacgccggcgtcatctccggcctcaacgtcatgcgcatcatcaacgagcccaccgccgccgccatcgcctacggcctcgacaagaagtcgagcagcgacggtgagaagaacgtgctcatcttcaacctcggcggcggcaccttcgacgtctcgct

SEQ ID NO: 11438 - protein, 214 aa, Panicum virgatum
  misc_feature: Ceres CLONE 1727981
  misc_feature (9)..(214): Pfam Name: HSP70 Pfam Description: Hsp70 protein
  misc_feature: Useful for making plants with modulated heat sensitivity
MAGKGDGPAIGIDLGTTYSCVGVWQHDRVEIIANDQGNRTTPSYVAFTDTERLIGDAAKNQVAMNPINTVFDAKRLIGRRFSDASVQSDIKLWPFKVVPGSADKPMIGVMFRGEEKQFSAEEISSMILNKMKETAEAYLGSTVKNAVVTVPAYFNDSQRQATKDAGVISGLNVMRIINEPTAAAIAYGLDKKSSSDGEKNVLIFNLGGGTFDVS

SEQ ID NO: 11439 - DNA, 2122 bp, Panicum virgatum
  misc_feature: Ceres CLONE 1728015
  misc_feature: Encodes the peptide sequence at SEQ ID NO. 11440
ccccaagcggccaagcccacaccaccactgcacagtacacacaccactgctccctgcctcagctcgctcccccctctctctccgtcctccaatgcgagaggctcccggggcgcgcgagctctgaagcccatggcagccgcggccgggagcccttggcgcagcgccggacccgtcgcggccctcgccctcctcctcctactcgccgccgcgcccgcggcggccgccggcgggtccgcggccgtgaacggggaccgcctccgggcggagcagatccggaagcaggcctcggacgccgccgcctcggccgccgcgctcgccgcggcgtcgcgccgcctccacctcgaccgcgcgcgccacctccgcctcctctcctcgctccaccggaacctcaccaacacgctccgcgccctctcgctcgcggccgactcggacccctccgcctccgaccccgccgccgctgccgccgctgacgccaacgcctcgtccccccgccagctcgacctccaggccaaggacctgatccgcgccgcgcgcgccgccatcgccgaatccaagccgctcttcgacccgcagctcaagatccagcgcctcaaggacgccatcttcgcgcagaacgagctgctcgcgcgcgccaagaagcgcggcgccttcgcctccctcatcgctgccaagtccatccccaagccgctccactgcctcgccgtccgcctcaccgccgagcggatcgcgaggcccgagcagtacgcggacccggtgccgccgcagcgggcgctcgaggaccccgcgctcttccactacgccatcttctctgacaacgtgctcgcggcctcatgcgtcgtgcgctccgccgtcgccaactccaacgacccctccaagcacgtcttccatgttgtcaccgatcggatgaacctcggtgccatgcaggtgataatacgccgaatggacttaaaaggtgcacactatgaggttaaagcatttgaggattacaaatttctgaactcctcatatgtccctgtgctccggcaactggagtctgcaaaccttcaaaaattctattttgagaacaagcttgagaatgccaccaaagatgctagcaatatgaaattcagaaatcccaagtatctatctatgctcaatcacttgcgattctatttgccggagatgtacccgaagctgcaccgtattcttttcttggacgatgatgttgtggtacagagggatcttacaggactgtggaagattgacatggatgggaaagtgaatggagcagtagaaacgtgctttgggtcttttcatcggtattggcagtacatgaacttctcacatccccttatcaaagcaaagtttagtcctaatgcctgtggatgggcatatggcatgaacttctttgatcttgattcttggaggagggagaagtgtactgagcagtaccattactggcagaatcagaatgcgaaccggacattatggaagctaggaacgctgcccccaggcttaatcacattctactccaccacgaagcctctggacaaatcctggcatgttcttgggcttgggtacaatccaagcatcagcatggaggagatcaggaatgctgctgttgtgcatttcaatggtaatatgaagccgtggctggacatcggtatgaaccagttcaggcacctttggacaaagtatgtggactacgatgacgaatatattcgtcaatgcaattttgcaccaccatagaaggcttaattatctatgtatccattcttcaatgaaaaacaaagaagtttggcaattagaactagtgactgccactgaagggttactgccactgaagggttacatgttctgtaagcacattttgtgtagagattcaaggagtttgtcaagtacaactgaagggtccacaattctttctcgcttataatgtacgtcaccgattaagttataatgaaagtaatgttcgccacatgaacattattttcgttatgtttgtaataatgttttttagtgcgtttgtaataatgttatgtctgcgatagcgtgtgtatgccgaagtcagatatataatgttcatgtggatcctagaactgaactttcagttatgtatccaatcattaataaatgcatttag

SEQ ID NO: 11440 - protein, 532 aa, Panicum virgatum
  misc_feature: Ceres CLONE 1728015
  misc_feature (189)..(505): Pfam Name: Glyco_transf_8 Pfam Description: Glycosyl transferase family 8
  misc_feature: Useful for making plants with altered carbohydrate content
  misc_feature: Useful for making plants with altered cell wall content and/or composition
MAAAAGSPWRSAGPVAALALLLLLAAAPAAAAGGSAAVNGDRLRAEQIRKQASDAAASAAALAAASRRLHLDRARHLRLLSSLHRNLTNTLRALSLAADSDPSASDPAAAAAADANASSPRQLDLQAKDLIRAARAAIAESKPLFDPQLKIQRLKDAIFAQNELLARAKKRGAFASLIAAKSIPKPLHCLAVRLTAERIARPEQYADPVPPQRALEDPALFHYAIFSDNVLAASCVVRSAVANSNDPSKHVFHVVTDRMNLGAMQVIIRRMDLKGAHYEVKAFEDYKFLNSSYVPVLRQLESANLQKFYFENKLENATKDASNMKFRNPKYLSMLNHLRFYLPEMYPKLHRILFLDDDVVVQRDLTGLWKIDMDGKVNGAVETCFGSFHRYWQYMNFSHPLIKAKFSPNACGWAYGMNFFDLDSWRREKCTEQYHYWQNQNANRTLWKLGTLPPGLITFYSTTKPLDKSWHVLGLGYNPSISMEEIRNAAVVHFNGNMKPWLDIGMNQFRHLWTKYVDYDDEYIRQCNFAPP

SEQ ID NO: 11441 - DNA, 1638 bp, Panicum virgatum
  misc_feature: Ceres CLONE 1728022
  misc_feature: Encodes the peptide sequence at SEQ ID NO. 11442
accagtgaccactgtcctcgttctagggttttactccgtaggctaattgggcagcggcgctccaaggtttttgcgcaacctgcatcagcgccacccatggcttagcaggtaggacctcactcgtgttccttctgctgcgccgcctccccatggccgacccaatggaggacgccgccgccgccgccgccgcccctgtatccgcggccagcaacaatgatgacgacgacgttgaggacctttacgcggaccttgatgagcaggtcacggccgcgctcgccgccgcgggggagagcggcggctccaatgcgagagactccgacccggccaccgacggcgaggaggaggtaccggaggtggacgcgaacgaggcagtggatttgggggacgggaccgcgggctacagcagcagcgacgaggagagcgatgatggcctccacatcgtcctcaacgaggacgcgggcgcgccgctgccgccgcctcctgtgggtcgaggtgaggagtgccaagctgaggagggggaggattcgggctgccgcgtgaagggttcatctgcaaacgatggcggctgggcaacggttggtggactccagtgcaagggatctcttgagaaaatgacgttacctaacatggcgcaagttgaccgaggtcgccagcatatgtttcaacgcgattctaatttattcttgacaagaaacagcacaattttcgacatagacattgaagcatttcaacacaagccttggagacaacaaggagtgaatcttagtgactacttcaattttaatctggaggaagaaggctggataagatattggtgcagcatgaagcaattaaggttagggaccagatcacatgcaaatgaaacatcaggaccggatcaagaatcattgaaactaaaatctgtcaaagcaatgtcaaaggtagcaaattgttctggatttgaaggaagaaatggccttgccaagccaaagggtagagcaatccatgttgaaggcagtgcacatgaacgtgttccgtcagcagacttgtggcgtccaatacagagggattcagatgttgtgattcaagtaaacatgacactttcaccctcaaatcagtccacttcagatgacagctcaaaattaaatcagaagtgtgtgaccactgaaagaatgtccattgaccatcctggtgccagatatttgaggggctccagccatgtggcggacagggtggttgataaggaagtgcatggtggaggttcctcagagtgcagtggcagcaaactggatagaagagattcttcttgtgaaaggggccaatcttctagtcctgattattctgatacgctttctggagaatcaaaaggagatttctatttcaaaagagccaatagacattcagattccagggtcttctttgaaggcaccaaacttcaggatgagcatgtcaaatctgacttttaccgccattcaagtaagtcagacagagaaaacagtgaaattcgcagtcatagttataccccttcacctactgatgatagaaatcataaggcaactaaacctttttggaggggtgaagcttcttttcctggacggggcaagtccagtgattcttttgttgactgcaaaagtgatgacaacctccttaaatctggac

SEQ ID NO: 11442 - protein, 496 aa, Panicum virgatum
  misc_feature: Ceres CLONE 1728022
  misc_feature (186)..(246): Pfam Name: Fip1 Pfam Description: Fip1 motif
MADPMEDAAAAAAAPVSAASNNDDDDVEDLYADLDEQVTAALAAAGESGGSNARDSDPATDGEEEVPEVDANEAVDLGDGTAGYSSSDEESDDGLHIVLNEDAGAPLPPPPVGRGEECQAEEGEDSGCRVKGSSANDGGWATVGGLQCKGSLEKMTLPNMAQVDRGRQHMFQRDSNLFLTRNSTIFDIDIEAFQHKPWRQQGVNLSDYFNFNLEEEGWIRYWCSMKQLRLGTRSHANETSGPDQESLKLKSVKAMSKVANCSGFEGRNGLAKPKGRAIHVEGSAHERVPSADLWRPIQRDSDVVIQVNMTLSPSNQSTSDDSSKLNQKCVTTERMSIDHPGARYLRGSSHVADRVVDKEVHGGGSSECSGSKLDRRDSSCERGQSSSPDYSDTLSGESKGDFYFKRANRHSDSRVFFEGTKLQDEHVKSDFYRHSSKSDRENSEIRSHSYTPSPTDDRNHKATKPFWRGEASFPGRGKSSDSFVDCKSDDNLLKSG

SEQ ID NO: 11443 - DNA, 1431 bp, Panicum virgatum
  misc_feature: Ceres CLONE 1728032
  misc_feature: Encodes the peptide sequence at SEQ ID NO. 11444
tcgtcactagtcttgccttgcgaaaccacctagtagcaagcaagctagctcagttcatcagggtggtgctctgctcccgcggccatggcgatgcgacgggtggcggcggcggcggcggcgctgttggcctgcgtcctgctggtgtcgccggtgcgcgggcgcaacatcacggccatcctcgacgggtacaaggagtacaagctgtacaacaagtacctgtcggagaccaaggtgtgcgacgagatcaactcgcggcagtcgacgtccatgaccatcctcgtgctctccaacgacgccatgaccacgctcgcctccgacgccggcgactcgctccccgccatcaagaacgcgctccgcctccactcggtgctcgactactacgaccgcaagaaggtcaagaagtacggcgacgagagcgccgccacgctgtaccaggccaccggcgacgccgccagcaccacggggaacgtcaaggtcgtcgaccaggaggacaagaactacggcttctccgccgccacgcccggcgccaggatctgcaccgtcaccaaggaggtggagacccaccccttcaagttcgccatcctcgaggtcacggcgcccatcgagttcgacggcctcttcgacaccccgtccacggccaacctcacgcgcctcctggagcgggccggctgcaaggtgttcgcctcgctcgccgcccgctccggcgtgctcaagacctacgaggcggccatgggcaaggggctcaccctgttcgcgcccaacgacgacgcgttccaggccaaggacgcgcccgacgtcaagaccatgtccagcgccaacctcaccaagctcctccagtacaacgcgctgccgtcctacaacaccaagacgtcgctcaagttcgtcaagggcacgctccgcacgctggccaccaccaaggccggcgtcacggtcgtcgctatgggcgacgacgtctccctcgacaccggcaagagcaagtcccgcgtcgcggacacggtcgtcgacagcgtgcccttctgcctgctcaccgtggacagcctcctcgtgccgccggagctctacgtcggcgcaccggaggccgccccggcgccggcgcccgcggaggcgccacagggctccccgtcggtggccgcggaccacgcggcggaccacaagaccaagaagccgtcgtcctctgacgcctcgcagacgatcggcgcgctcgccgccgcgtgctccgtcgtgctgccctccctgttgctgttgttgtgatggaactgaacgcgggcagcacattcagattcagtcctgcctgacagctcgcaatactccgtttcccctgtgatcttttcctccgtcgtatgctcggccgttcgttgattgaatttgttgctgcattgcgatccctctgtgtaatttgagcaagcactgtaaattgcttttttttttcgt

SEQ ID NO: 11444 - protein, 388 aa, Panicum virgatum
  misc_feature: Ceres CLONE 1728032
  misc_feature (195)..(322): Pfam Name: Fasciclin Pfam Description: Fasciclin domain
  misc_feature: Useful for making plants with altered carbohydrate content
MAMRRVAAAAAALLACVLLVSPVRGRNITAILDGYKEYKLYNKYLSETKVCDEINSRQSTSMTILVLSNDAMTTLASDAGDSLPAIKNALRLHSVLDYYDRKKVKKYGDESAATLYQATGDAASTTGNVKVVDQEDKNYGFSAATPGARICTVTKEVETHPFKFAILEVTAPIEFDGLFDTPSTANLTRLLERAGCKVFASLAARSGVLKTYEAAMGKGLTLFAPNDDAFQAKDAPDVKTMSSANLTKLLQYNALPSYNTKTSLKFVKGTLRTLATTKAGVTVVAMGDDVSLDTGKSKSRVADTVVDSVPFCLLTVDSLLVPPELYVGAPEAAPAPAPAEAPQGSPSVAADHAADHKTKKPSSSDASQTIGALAAACSVVLPSLLLLL

SEQ ID NO: 11445 - DNA, 2138 bp, Panicum virgatum
  misc_feature: Ceres CLONE 1728033
  misc_feature: Encodes the peptide sequence at SEQ ID NO. 11446
aatcccaggcagcaggcaaccctagctctagcggcggcggtggaccggcggcgcggcatcggcacggcggcaggccggcaggggcggggcgcagccgcggaggccagtggccgaaaggggccgcgcgctcgcgtcgcgcaggagcgacggcgaccgcctgctccctgctgccctgcccggcgggcggcggccaggcgtagggcgcagttgcgctgcgcacttgtgcagcagtgcagtcgccaggcaggcgggccgcgggcggccagccgggcaggggcagccggcgtccggcgaggcggcgaccagcggcgctgcgcatcaattactaggagcgtcattatttccagaatactatctgctttatagtgggcaacaatgtcagcctccactgctgcgattccaaccgcaaacacaaatgggaaccatgcattaagtttggactcgcattctagccaagatgttaggcggcgaacaattgttgcaaagaagaaagcctcgcctgagcttcttgctgaaggtggagtcaatgggatatcagcagataagattacaagcaagaaggatcttagccatactatccgtggagaatcagttcttgacaagccaaaatattcttcagaggcaaggaaagatgtggttgcttcggcagctgctaaacgtcgaaagaaaagctctagtaaacaagaaaaggccaagtgggtgactgccttaagtgtgctggtgaaactatgccttcttatttctgcaatcacttggatggggcagttggtctggagatggcaaaatggcgagttatcatttacaacactggatatggagagcaggctatccaaggtggaaggcttcaagaagacaaccaagatgcttcaggtacagctggacattttggataagaagctaggaaatgaggttgacaaagcaaaaagggatatcactaagcaatttgaggccaagggtaatgaattagagaaaaagatgaagacattggaagacaaaactggcaagttggataagtcaatatctgagcttagggacatgggatttctttctaagaaagaattcgagaagattttgagtcagttgaaggaaaagaagggattgggtgttacagacaatgacataaccttggacgatatacggctatttgccaaagagattgttgagatcgagatagcaaggcattctgctgatggccttggtatggtggattatgccctgggatctggcggtgccaaagtagtaagtcattcaaagcctttcatgaatggcaagaactattttcctgttggcagcagtgtgcatgcaacagcccaaaagatgcttgagccaagctttgggcagccaggagagtgttttgcgctgaagggaagtagtgggtttgtggacgtgaagctaagaacaggaataattcctgaggcggtcactatagagcatgttgacaagagtgtggcctacgatagatctagtgctccaaaggatttccagatccgtggttggtaccaaggaacacatgatgcttcagacaaggattcaaatgtgatggctaccttaggagagttctcttatagcctcgaccgcagcaatgcccagaccttccaactagagagaggcgccaacccacaagctgtcaacatggttcggtttgacttctcctcgaaccatgggaatttggaacttacatgcatctatcgcttcagggtgcatggtacagaacctggctccctcagcaatgcagcatgatgccctcatctgtgagctgcacaccagagcttaaaagattattggatcccatttgccaatcagagcacttcgtcagcacttcgggtcctatcacagacagttttaggacaggtgcaagagtgaatgccagagcagaagctcaagggattgagctcgttacaagtgactgcccccacgtttatcttgctaaggttgatttcagtagtctgcaaattatcatgaataggtcctgacggtttgtacctagctagactaattattcttgtatcacttgatcgctgcgctgttcctactctggtttccaatttgcttgtttgcaactccggttgcaccatgccacgattgcattgttacagtttgcaagactgatgtatgtagggttaaggtgatcgttaggt

SEQ ID NO: 11446 - protein, 454 aa, Panicum virgatum
  misc_feature: Ceres CLONE 1728033
  misc_feature (306)..(446): Pfam Name: Sad1_UNC Pfam Description: Sad1 / UNC-like C-terminal
MSASTAAIPTANTNGNHALSLDSHSSQDVRRRTIVAKKKASPELLAEGGVNGISADKITSKKDLSHTIRGESVLDKPKYSSEARKDVVASAAAKRRKKSSSKQEKAKWVTALSVLVKLCLLISAITWMGQLVWRWQNGELSFTTLDMESRLSKVEGFKKTTKMLQVQLDILDKKLGNEVDKAKRDITKQFEAKGNELEKKMKTLEDKTGKLDKSISELRDMGFLSKKEFEKILSQLKEKKGLGVTDNDITLDDIRLFAKEIVEIEIARHSADGLGMVDYALGSGGAKVVSHSKPFMNGKNYFPVGSSVHATAQKMLEPSFGQPGECFALKGSSGFVDVKLRTGIIPEAVTIEHVDKSVAYDRSSAPKDFQIRGWYQGTHDASDKDSNVMATLGEFSYSLDRSNAQTFQLERGANPQAVNMVRFDFSSNHGNLELTCIYRFRVHGTEPGSLSNAA

SEQ ID NO: 11447 - DNA, 1612 bp, Panicum virgatum
  misc_feature: Ceres CLONE 1728047
  misc_feature: Encodes the peptide sequence at SEQ ID NO. 11448
ctaccggcggcttcctttctccacaccgcgtgcgagtgaacgagagcagccagcagcggcggcgatggggaaggcgtcgaagggctcgcggaaggggaagaaggcgtggcgtgccaacatcagcaccgacgacatcgacgactttttcgagaagcagacgcgcgacgcccacgccggtgctgccgccatcccctcgctcccctctgattcccttttctacgtcgacaagcccgccgcatccacttcagcaactagcgcctctgacacaccaaccaaagatattcctgccaaaaggaagattgagaagaagcgagagaaggttctttaccatgagagtttgttgaagcagaacccatttgtacagccaatcccatcttctgtggtgggcaagaaggataagaagaaggcgaagaaggaattgcaggagaaacatggagaaaaaagtgtccccatggaagatgattctgctgaaaagaaccttgacatatgggctggggatggtaatggagataccaaggccaaaaagagatctactacatcagtgattcctgctgttgaagttgaggccccaggatgctcatttaatcctccattcgaagcacatcaagatgctcttgctcaagcagttgccgacaaaaggcacaaaacacttatgaaagagttggggcccacacctgtaccacttatagttcctggtgaagctataactgaagaagataaattctttcttgacgctgatgatggagatgaagatgtcgcagacgatgatggagatcaggatgctgatgcttcggttggacaaaggaagaacaaaacaaaaagagttacaagagtggaaatgaacaaaagagctcgtcgtaaggagaggttaagagcagaggcagaagcaaagaaaatggaaaatatttcaaaagaaatagatagcttgccaaatataattgatgcgatagctaaagaggatgaggaaaaggaaaagaggcgcttacggcgaactgtggttaaagaggagaggcttaaatcaggcccacctcgtctgggcagacacaaatttgaaccagctcctgttcaagttctattgactgaagagattagtggctctcttagaaagctaaaggggtgttgtaatcttgtgagggatcgctacaagagcattgagaaacgtggaatacttgcaccaaacaagaaaataagcaaacgtcggtagagaatcaaggtccaatatgatggatgataaggcaatcttaaccttgttttctcctacaatattgagggaatgcactcctgatggattgaagaggcttacgaaattggctgataaaagacgagaagattcagatataagtgaagagccagtgggggcggtcttaccccccgcaggtcaagttttttttttttaagtgaagagccagttttaccgcattcttatttcctttcacatgttcagtgtcaactaggcagtcaaatctttagccctagcaatattttgtgagcctgcgaggcaaaattttgcagttgacctttgaagttggtgcttagcagatgcgacgtggtgtaatagcatatttatatcagttctgttctagtagatggtagcgattgctatactattgcc

SEQ ID NO: 11448 - protein, 379 aa, Panicum virgatum
  misc_feature: Ceres CLONE 1728047
  misc_feature (8)..(364): Pfam Name: Nop53 Pfam Description: Nop53 (60S ribosomal biogenesis)
MGKASKGSRKGKKAWRANISTDDIDDFFEKQTRDAHAGAAAIPSLPSDSLFYVDKPAASTSATSASDTPTKDIPAKRKIEKKREKVLYHESLLKQNPFVQPIPSSVVGKKDKKKAKKELQEKHGEKSVPMEDDSAEKNLDIWAGDGNGDTKAKKRSTTSVIPAVEVEAPGCSFNPPFEAHQDALAQAVADKRHKTLMKELGPTPVPLIVPGEAITEEDKFFLDADDGDEDVADDDGDQDADASVGQRKNKTKRVTRVEMNKRARRKERLRAEAEAKKMENISKEIDSLPNIIDAIAKEDEEKEKRRLRRTVVKEERLKSGPPRLGRHKFEPAPVQVLLTEEISGSLRKLKGCCNLVRDRYKSIEKRGILAPNKKISKRR

SEQ ID NO: 11449 - DNA, 663 bp, Panicum virgatum
  misc_feature: Ceres CLONE 1728089
  misc_feature: Encodes the peptide sequence at SEQ ID NO. 11450
aaaaaaaaaaaaaaaaaatccgcctcccccctcgcgtcgcggcgccctctgatctgatgccggggaggccctgatggcggcggcgggagctggagcggccggcggcggcgggggagccgggggcggggaggggtcctcctcctccccggcgggcgtcgcgatcgggccccaccaccacaggaccgcggaagaggctatgtggcaaatgactttaggaggaggagaatctattgaacatggtcccttccctgagagaattggagaaccagactgtagttattatatgaggactggactttgtagatttggggcaacgtgcaagttcaatcacccgccaaacaggaagctggctgttgccgctgcaaggatgaaaggggagtatccttacagagttggtcaaccagagtgtcaatattatctgaagaccgggacatgcaagtttggagcaacatgcaagtttcatcaccccagagaaaaggctgcgattgcaacgcgagtacagttgaatgttctaggttacccaataaggccgaatgagaaggaatgtgcttattatttgagaacagggcagtgcaaatttgcaagcacatgtaagtttcatcatccaccgccctccaatacgatggttgctgtacgcggctctatttattcacctgggcaatc

SEQ ID NO: 11450 - protein, 196 aa, Panicum virgatum
  misc_feature: Ceres CLONE 1728089
  misc_feature (62)..(88): Pfam Name: zf-CCCH Pfam Description: Zinc finger C-x8-C-x5-C-x3-H type (and similar)
  misc_feature (107)..(133): Pfam Name: zf-CCCH Pfam Description: Zinc finger C-x8-C-x5-C-x3-H type (and similar)
  misc_feature (153)..(179): Pfam Name: zf-CCCH Pfam Description: Zinc finger C-x8-C-x5-C-x3-H type (and similar)
  misc_feature: Useful for making plants with modulated nitrogen use efficiency
  misc_feature: Useful for making plants with modulated low light sensitivity
  misc_feature: Useful for making plants with altered alkaloid content
  misc_feature: Useful for making plants with altered lignin content
  misc_feature: Useful for making plants with altered terpenoid content
  misc_feature: Useful for making plants with modulated flowering time
MAAAGAGAAGGGGGAGGGEGSSSSPAGVAIGPHHHRTAEEAMWQMTLGGGESIEHGPFPERIGEPDCSYYMRTGLCRFGATCKFNHPPNRKLAVAAARMKGEYPYRVGQPECQYYLKTGTCKFGATCKFHHPREKAAIATRVQLNVLGYPIRPNEKECAYYLRTGQCKFASTCKFHHPPPSNTMVAVRGSIYSPGQ

SEQ ID NO: 11451 - DNA, 679 bp, Panicum virgatum
  misc_feature: Ceres CLONE 1728089-R
agttagcatcttcaccagggcattytgaaagattgctcgacggagggtccggaaggtctcataggatttcccaaactgattcccagcaaataccctccagcaatggaagcactgagagagagatgtcataagccgctgtcctcagccttccctcatgcttattcccattctagactcttcagtaattatctcccaacacattcaaagagctgaagctgtacaggtcctcatccatccttcctccgctgttctgagcttccgcattctggtgcttctccgtgtatcacattcaagcaggaaaaagttcttgcttaccccatcctggtgctcgtttgcccgctgaaaaataaatgggggtaaccattcatatttatccgtaccgtacacagacacaagatacactcactccctgatcccattgttgtagttatacaggtgacctgcggtgaacaaagcttaccaaactgactgtactggggatgcaacatctcttcctctctttccttttgctcttcttcctttttaggcaattggggtgtgagggcaggacgtgctgctcgtgcaagtcagcatgttcaaaacagcgggaataataccctgccttcaatgtaataattgtaatctatgtatgacccaccgaattatttcttcaataagagacatcgagtgcggatgtgac

SEQ ID NO: 11452 - DNA, 1041 bp, Panicum virgatum
  misc_feature: Ceres CLONE 1728092
  misc_feature: Encodes the peptide sequence at SEQ ID NO. 11453
atccttcgcaagcaccaggctgcagctgcagacaaccgagcgagaagaagctaggctgcaagaagccagcgaggacgcgagcagcgacgccagattgagcaaccaatggcgccgaggaggtcgacttcgccggccgggagcagcggcagcggcgcggagcagccgaggctccgcggtgtgcggaagcggccgtggggccggtacgcggcggagatccgcgacccggtgcgcaaggcgcgcgtgtggctgggcaccttcgacacgcccgaggaggcggcgcgcgcctacgacgccgccgcgcgcaggctccgcgggccgcgcgccgccaccaacttcccctccgcccaggaggccaaggcggccgccgcagctgcccctgcggcgagcgagagcgcgagcgccgtgctgtcggaggacgcgtcgtcgtgctgctcctcccgggactcgccgcgggcggtgacggcggccgtcgcggcgcctccgtcgctggaactgggcctggcgctcccggccgtggcggggacgccgccgtcgtgccagctgttcctggacccggaggcgatggtggccgtggcgccggcgctgctgcagttcctgccgcccaagagcgaggaagagcggagcttctcagggtcgtcgtcggtggcgttcgacgcggcgccggccgtgggcctgctggggctggacctgaacctggcgctgccggccgagatggtgatgtagagacacaccaatccatcgttagggtgtaaataggctgcagatttatgtatgcgccgagatggtgatgtagcgaattaagcaacttattcaacactcaaatggcttcttcttcttcttcttcttctctcttcttcatcggagccaattggccgagtgaagcaacacaatgtttttttattgaaagcttaacaagagcagttgattgtaaatagtagtctgctagctgttggcgtaggtttcacttcttctcatccgttgcaaggaggagcaaagtcgatcttaggctgacttcaatagctgaggcaaaagctttttttt

SEQ ID NO: 11453 - protein, 205 aa, Panicum virgatum
  misc_feature: Ceres CLONE 1728092
  misc_feature (20)..(71): Pfam Name: AP2 Pfam Description: AP2 domain
  misc_feature: Useful for making plants with altered carbohydrate content
  misc_feature: Useful for making plants with altered alkaloid content
  misc_feature: Useful for making plants with altered lignin content
  misc_feature: The sequence is a functional homolog of SEQ ID NO 160 in the 10/714,887 US patent application
  misc_feature: The sequence is a functional homolog of SEQ ID NO 160 in the 11/435,388 US patent application
  misc_feature: The sequence is a functional homolog of SEQ ID NO 28 in the 10/903,236 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: Useful for making plants with altered lutein content
  misc_feature: Useful for making plants with modulated biomass
  misc_feature: Useful for making plants with modulated flowering time
  misc_feature: The sequence is a functional homolog of SEQ ID NO 22 in the 10/903,236 US patent application
  misc_feature: The sequence is a functional homolog of SEQ ID NO 2215 in the 10/666,642 US patent application
  misc_feature: The sequence is a functional homolog of SEQ ID NO 82 in the 10/714,887 US patent application
  misc_feature: The sequence is a functional homolog of SEQ ID NO 82 in the 11/435,388 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 2217 in the 10/666,642 US patent application
  misc_feature: The sequence is a functional homolog of SEQ ID NO 24 in the 10/903,236 US patent application
  misc_feature: The sequence is a functional homolog of SEQ ID NO 84 in the 10/714,887 US patent application
  misc_feature: The sequence is a functional homolog of SEQ ID NO 84 in the 11/435,388 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: Useful for biocontainment applications
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: Useful for making plants with altered sterol content
  misc_feature: Useful for making plants with altered terpenoid content
MAPRRSTSPAGSSGSGAEQPRLRGVRKRPWGRYAAEIRDPVRKARVWLGTFDTPEEAARAYDAAARRLRGPRAATNFPSAQEAKAAAAAAPAASESASAVLSEDASSCCSSRDSPRAVTAAVAAPPSLELGLALPAVAGTPPSCQLFLDPEAMVAVAPALLQFLPPKSEEERSFSGSSSVAFDAAPAVGLLGLDLNLALPAEMVM

SEQ ID NO: 11454 - DNA, 1525 bp, Panicum virgatum
  misc_feature: Ceres CLONE 1728097
  misc_feature: Encodes the peptide sequence at SEQ ID NO. 11455
agtccccttgcccataccctgtcactcccgcgtgcccccttctccccgcaccgtcgttggcctccgcctggctcgccgcggcgaggcgccggtagccccgctgccgcaccttgccggcggcgagcacggcgctggagtgggcgccgttgacgcttctgctcgccaacgccgccgccttcagcctcatcaccgccgccacggcccgccctgcatccgcgcctgcgaccaccgccttcgctccggccatcaaggggcacggcgccctgcgcctcctctgcgcctcgctcgcagccggtctggcggccagagctcggttcccggccgtggtactttttttctctgatccaatcccttcgacaccgcttctctccgcaccgtcctcctcctcgctcgcttgctctctctctctctctctcctgagggcggctagggtttcctcttgatccaatcgagatctggcgggtgctctcctcgcgcgagcgactccgccggccgcgtgctgcggcagcgatggcggccgcagctgaagcaggcgcgtgcggtgggggcggcggagggcgcggctgtcagcagggcaagcgcagctcgggcgggcgcgtcgcgcactgaacagcggcgagagcggcggggcatgctgcgttgcggtggctggctcgactccggcagccggcggcgggaggctcgtgggttgcgaggccagcacggctccggcagtgtgctgcagcagcgatggcggccgcggttcaagctagcacgtgcctggggaggcggagggcgcgcctggccgccgggcaagcgcggctcgggcgggcgcgttgcgcaccgggcagcgtcaagcacggcggtgcgttgcgatggctggcccagctctggcagcaggccgcgggcgtctcgtgggccgcgaggccagcacggctcgagtgagcgcgttgtgagaccgtcaacggtctgcgcggctcagtcgtttcagctaataacactggagcaaagaacctgtacatcatttcagtgaagggaatcaaagggcgccttaacaggcttcctttagcctgtgttggtgacatggttatggcaactgtgaagaagggaaagcctgacctcaggaagaaggtgatgccagctgttattgtgaggcagcgcaagccatggcgccgaaaggatagtgtctacatgtactttgaaggtacatctcttatgatgagcgggtgattgactttgcaaggatttaattgttttagctaaactgactatagttctcttgaatatgtgacttcttttcattcgatttttctttagaatcagcagtctacggtcattcgccgctacaactgccactgctagaaaatctctcattagtactgatcgggaacccccggtttgtaccggtttctcgaccggtaccgctcctccagtactaagtgcacgcgcacttagtaccagtcagctggtccggtactaaacggcctgtaaatttcaatttcgtactcaaccggtactaaacgattttttttctttttgatgcttt

SEQ ID NO: 11455 - protein, 32 aa, Panicum virgatum
  misc_feature: Ceres CLONE 1728097
  misc_feature: The sequence is a functional homolog of SEQ ID NO 1016 in the 11/435,388 US patent application
MAAAAEAGACGGGGGGRGCQQGKRSSGGRVAH

SEQ ID NO: 11456 - DNA, 765 bp, Panicum virgatum
  misc_feature: Ceres CLONE 1728103
  misc_feature: Encodes the peptide sequence at SEQ ID NO. 11457
tctcaccgtttgcaaacatggacgtctcaccgtttgctgcactgttgctcggtgctctcgtctccctgctcttcttcgccactaggaggaggaatccctcctccgatggccggcgtcgtctgcctccgtcgccgccggggcttcccctcctcggccacctgcccctccttggccccctgcctcaccgtacgctccaggccatggccgccaagcacggctccgtgatgctcctgcgcctcggccgcgtgcccaccgcggtggcctccttggcggccgcggcgcaggaggtgatgaagacccacgacctggccttcgcgagccgcccgagggcgcgcatgacggagcgcctcgtctacggccgcgacatggccttcgccccctacggtcgggagcaggaggccgccgcgatggtcggccgcgtccgccgcgcctcaccgggcgccgtcaacgtcaccgccctcatcatctcctacaccaacggcgtcatctcccgcgccgcgttcggcgaccaagggagattcggggtggacgacggcgagaagctcacccagctgttcgtcgacttcgaggagctcctcgggacggtcaccatcggggacttcgtgccgtggctggcgtgggtcgacgcgctcatggggctggacgccaaggcggcgcgcacgtccgcgcagatggacgccttgctcgagcaggtcatcgcggaccaccgccggaggcgacgtgacggccggcgagaggatgacggccaccgggacttcgtcgacg

SEQ ID NO: 11457 - protein, 249 aa, Panicum virgatum
  misc_feature: Ceres CLONE 1728103
  misc_feature (59)..(123): SWISSPROT Homolog: EC 1.14.13.68 4-hydroxyphenylacetaldehyde oxime monooxygenase
  misc_feature (156)..(227): SWISSPROT Homolog: EC 1.14.13.88 Flavonoid 3',5'-hydroxylase
MDVSPFAALLLGALVSLLFFATRRRNPSSDGRRRLPPSPPGLPLLGHLPLLGPLPHRTLQAMAAKHGSVMLLRLGRVPTAVASLAAAAQEVMKTHDLAFASRPRARMTERLVYGRDMAFAPYGREQEAAAMVGRVRRASPGAVNVTALIISYTNGVISRAAFGDQGRFGVDDGEKLTQLFVDFEELLGTVTIGDFVPWLAWVDALMGLDAKAARTSAQMDALLEQVIADHRRRRRDGRREDDGHRDFVD

SEQ ID NO: 11458 - DNA, 666 bp, Panicum virgatum
  misc_feature: Ceres CLONE 1728103-R
  misc_feature: Encodes the peptide sequence at SEQ ID NO. 11459
catcaaccacccacacgagatgcgccgggtccaggacgaggtccgcgcggccgtcggcggcggcggccacgtcaccgaggaccacctgccgaagctgcgctacctcaggtgcgtgatcaaggagacgttccggctgcgcacgccgctgccgctcctcctgccccgggagacgatggaggacacgcagctgctcggctaccacgttccggcgcgcagccgcgtcatcgtcaacgcctgggccatcgcgcgctaccccgcgtcgtgggatcgcgccgacgagttcgtgccggagcggttcgccggcggcgacctgacggcggactacctgctcgggcaggatttccggttcgtgccgttcggcgccgggaggagaggctgtcctgggatcgggttcgccgtgccatccatggagctggcgctggcgagcctgctccaccacttcgactgggagctgccggccggcgggccgtcgaaagtggagatggacgagctgaacgggctatcggtgcggctcaaggcggcgctgcttttggttgctaagccatggtctccttaattaggagggaaatttgaatctgtacattaaaaaattctaaggttagcgttatctcactaacttgtggagcacatgattcaataacatatgggtcacgatggtatatatct

SEQ ID NO: 11459 - protein, 184 aa, Panicum virgatum
  misc_feature: Ceres CLONE 1728103-R
  misc_feature: SWISSPROT Homolog: EC 1.14.13.68 4-hydroxyphenylacetaldehyde oxime monooxygenase
INHPHEMRRVQDEVRAAVGGGGHVTEDHLPKLRYLRCVIKETFRLRTPLPLLLPRETMEDTQLLGYHVPARSRVIVNAWAIARYPASWDRADEFVPERFAGGDLTADYLLGQDFRFVPFGAGRRGCPGIGFAVPSMELALASLLHHFDWELPAGGPSKVEMDELNGLSVRLKAALLLVAKPWSP

SEQ ID NO: 11460 - DNA, 2028 bp, Panicum virgatum
  misc_feature: Ceres CLONE 1728104
  misc_feature: Encodes the peptide sequence at SEQ ID NO. 11461
gctcgcacgccggcggacctgctcctctactgccttcgcccgccgcgcccaacccaacccaccaccacccccacgcgcccccacgcggttgtgctccgcgccgcgctgaaccctcctccccctctgtcctcgcctgctgcttcaaacaccagacccgcaaaccgggagccccccgtcactccctccccccctcttcctccgtcagccccccagcccggcactccgccatgggcaaccgcgggtcgcgctaccaccgccacgcagccgaccaacagaagccggcggcggcgcccaagccccagccccatgcgccgccgccgccgccgccgcagcagcagcagcagcagcagcagccgcaggcgaggcccaagccggcggccgcgcaggcggcggcggcggcggacgcgggggcggtggggcgcgtgctggggcggccgatggaggacgtgcgcgcgacctacaccttcgggcgcgagctcggccggggccagttcgggatcacctacctcgtcacgcaccgggagaccggccagcgcttcgcctgcaagtccatcgccacgcggaagctcgtccaccgcgacgacatcgaggacgtgcgccgggaggtgcagatcatgcaccacctcacgggccaccgcaacatcgtcgagctccggggcgcctacgaggaccgccactcggtcaacctcgtcatggagctctgcgagggaggggagctcttcgaccgcatcatcgccaggggacactacaccgagcgcgccgccgccgcgctctgccgcgagatagtcaccgtcgtccacagctgccactccatgggggtcttccaccgggatctcaagcccgagaacttcctcttcctcaacgacaaggaggactcgccgctcaaggccacggacttcggcctctccgtcttcttcaagcccggggagactttcaaggatcttgtgggaagcgcatattatgttgctcctgaggtactcaaacggcactatggggcagaggctgatatttggagtgctggagttattctttacatccttctttccggtgttcctcccttttgggcagataatgaggatggcatatttgatgccgtcttgcgtggtcacattgatttctcttctgatccttggccttccatatctaatggtgccaaggatttggttaagaagatgctgcagcaagacccaaaagagcgcctgactgctgctgaaattttgaatcatccatggattagagaggatggagaggccccagataagccacttgacattacagtcatcagtagaatgaaacagttcagggcaatgaacaagctcaagaaagttgctttgaaggttgttgctgagaacttatcagatgaagagattatgggccttaaagaaatgtttagatctcttgatacagataacagtgggacaattactcttgaagagctaagatctggtttaccaaaacttggcactaaaatttctgaatcagaaatcagacagttgatggaggcggctgatgttgatggaaatggtaccattgattatgcggagttcatatcagccactatgcacttgaataaattggagaaggaagaccacatactcaaagcttttgaatattttgataaggaccacagcggatacataacagtagatgagttggaagaagctctgaagaagtatgatatgggagatgataaaacaataaaagagatcattgctgaagtagatacagatcacgatggaagaattaattaccaggagtttgttgccatgatgaggaacaacagccctgagattgttccgaaccggaggcgcatgttctaactgccgtgtacaatttgagtggacacttctggggatattttgccttagacatcttctcctggagccattttcttttggggaaagccattaagagaactacatttgagatccatatctctgcagccaggaccagtttgtaccagaatgggacgcatgatattgggactcagacaccgtttagttcccaaaataaaagtttttggttgtc

SEQ ID NO: 11461 - protein, 530 aa, Panicum virgatum
  misc_feature: Ceres CLONE 1728104
  misc_feature (78)..(336): Pfam Name: Pkinase Pfam Description: Protein kinase domain
  misc_feature (490)..(518): Pfam Name: efhand Pfam Description: EF hand
  misc_feature (455)..(483): Pfam Name: efhand Pfam Description: EF hand
  misc_feature (383)..(411): Pfam Name: efhand Pfam Description: EF hand
  misc_feature (419)..(447): Pfam Name: efhand Pfam Description: EF hand
  misc_feature: SWISSPROT Homolog: EC 2.7.11.1 Non-specific serine/threonine protein kinase
  misc_feature: The sequence is a functional homolog of SEQ ID NO 2 in US patent 7084323
MGNRGSRYHRHAADQQKPAAAPKPQPHAPPPPPPQQQQQQQQPQARPKPAAAQAAAAADAGAVGRVLGRPMEDVRATYTFGRELGRGQFGITYLVTHRETGQRFACKSIATRKLVHRDDIEDVRREVQIMHHLTGHRNIVELRGAYEDRHSVNLVMELCEGGELFDRIIARGHYTERAAAALCREIVTVVHSCHSMGVFHRDLKPENFLFLNDKEDSPLKATDFGLSVFFKPGETFKDLVGSAYYVAPEVLKRHYGAEADIWSAGVILYILLSGVPPFWADNEDGIFDAVLRGHIDFSSDPWPSISNGAKDLVKKMLQQDPKERLTAAEILNHPWIREDGEAPDKPLDITVISRMKQFRAMNKLKKVALKVVAENLSDEEIMGLKEMFRSLDTDNSGTITLEELRSGLPKLGTKISESEIRQLMEAADVDGNGTIDYAEFISATMHLNKLEKEDHILKAFEYFDKDHSGYITVDELEEALKKYDMGDDKTIKEIIAEVDTDHDGRINYQEFVAMMRNNSPEIVPNRRRMF

SEQ ID NO: 11462 - DNA, 1055 bp, Panicum virgatum
  misc_feature: Ceres CLONE 1728114
  misc_feature: Encodes the peptide sequence at SEQ ID NO. 11463
atcctttccccatccttctctaatcagcttctatccatctcgccattgaacaatctccgatagctagcagcttgcctgattgatcctcccggaagatcaaacactccaaggacactgaagaaaagatggcggagcgttcagagaacgcggcgggggaaatgatgagcaacatcatggacgccatcgccgagaacctcccgagcaagaagtccgtcaggttcgacgacggcgagggctccatctccgaccaggcccggaagctgttgggcggcaagaagtccgtccaccacgtcctgggcggcgggaagtccgccgacgtgctgctgtggcggaacaagaagatctcgtcgagcgtgctgggcgtggcgacactggcctgggtcttcttcgagtggctcgactaccacctgctcaccatcgccagcttcgcgctcgtgctcggcatggccgtgcagctcgcctggtctgccctcgcctcgaacgtgccccgcctcgaggtgccggaggagctgttcgcggacgccggcaaggccgccggcgcgcaggtgaaccgggccctcggcgcgctccaggacatctcctgcgggcgagacctgaggcggttcctcattgcgatcgccgtgttcttcgtggtcgccgtcgtcgggagcttctgcaacctgctgacggtcatctacatcgggttcgtgtgcgcgcacacactgccggtgctgtacgagaagtaccaggaccaggtggacgagttcctgtgcaacatgctgggcctgctccagaaccagtaccagaagctcggcagcaagggcgtcttcagcaaagggaaggccaggaagagcgactagttcgatctctgctggctgctgcttgtgtacatagttagcctcattgcgtgtatgcaatcagctgcgattgcctgaacagcgggtgtctccgtttatttctgccaactcgatgtcctgtacagtgctgaaagaactaccattcttgtgtaatgcaaataatgcttagtagcttcgaacagcacattaaacgaggttcagatggttcatctttttttt

SEQ ID NO: 11463 - protein, 237 aa, Panicum virgatum
  misc_feature: Ceres CLONE 1728114
  misc_feature (62)..(236): Pfam Name: Reticulon Pfam Description: Reticulon
MAERSENAAGEMMSNIMDAIAENLPSKKSVRFDDGEGSISDQARKLLGGKKSVHHVLGGGKSADVLLWRNKKISSSVLGVATLAWVFFEWLDYHLLTIASFALVLGMAVQLAWSALASNVPRLEVPEELFADAGKAAGAQVNRALGALQDISCGRDLRRFLIAIAVFFVVAVVGSFCNLLTVIYIGFVCAHTLPVLYEKYQDQVDEFLCNMLGLLQNQYQKLGSKGVFSKGKARKSD

SEQ ID NO: 11464 - DNA, 2022 bp, Panicum virgatum
  misc_feature: Ceres CLONE 1728116
  misc_feature: Encodes the peptide sequence at SEQ ID NO. 11465
ctctctcttctgctgctgccgctgctgctgccgacgcttctcctcctcctcctcccccttcgatccctcctcgctaggcctccagcggccagggatgtaccgcgccgccgcctacgacagcccggtctttcccatctccctcgcgcaggtgctgctgtccgtgagaattggaaggagctgaggttccatccgaggtggtggaagagaggagcttggagttcagggaacggattgcttcttttcaccccctctccggctgcttctccacttcagccatggaggaggtggaggtggccaacagggccgcggtggagagctgccaccgggtgctgaccctgctctcccagtcccagcagcaggatccggccctgctcaagagtgtagcttcggtgatgggtgaagcctgcgccaagtttaggaaggtgaccgccctcctcggcaatggcggtagcaccgggcatgctaggggtagattctccaggagaggcaggcctgcggggctcttcaccctgaagagcctcttggggagcagcagcgatacccggtcggagcttatgccgagcactgctgctgctccatctccgtcttctagctatgcgcaattgcgtgctcggattagtggcgcgccagacccacgagggctggatttggctagttcgagcggcaagagcggcactcatccgtttggagctccaaagatggtccagccattgtcggtgcagttccagattgggaacgtcgcgcatcggtacccattccaccagcagccttcgcggcagaagctgcaggctgagatgttcaggaggagcaatagcgggatcagtctgaagtttgatagccctagccccagtggtggtgctgggacgatgtcgtctgcgaggtcattcatgtcatccttgagtatggaggggagtgtggctagcttggatggaaagcggccattccatttggttggtgcgccagtggcaagtgacccggctgatgcaaaccgtgtgcccaagcgaaggtgcacaggtagggggcaggatggcacaggcaagtgtgccactaccggcaggtgccattgctcaaagaggaggaaattgcgaattaagagatcgataaaagtgccagccattagcaataaaattgctgatatacctccagatgaatactcttggcgaaagtatgggcagaagccgattaagggttcccctcacccaaggggttactacaaatgcagcagtgtcaggggctgcccggcaaggaagcatgttgaacgctgcgtagatgacccagctatgctaattgtgacttatgaaggcgagcacaaccatactcgaccgccagcacagtctgtccaaacctagagaatcagtaaaactcagcactccacacatgaagcgcaggccatgcctttgcttggatggccaagctgttcatcatgtagaaactcggtccattgatctactgatctttgaatgcacagtgaccgacatagagctatttgggaatctgatgagctgcttggcccctcctgagctacatgttgttagagatgctatagtggggacattcaagctgttcacctatcttgtgagttgtggcacatataattgaaaaatgatgcaggaaagaaagggaaatctggcatttgataatgaccggagagctttgcgagtgagtttgaaggggttgaaagcaaagattgaggaaaagaagtgaacgactgagcattatgcaaggatggattaagatggccggatcggcttttagcgtgcacaagttcacttgcgatgacttgcctgtgtatgttgcttttgctttatcgaaagatcacctcttttgttgacaaaagtaacattccagtatgaaaggtggtctgtactgactgctgacaagttaggaccatatgggttttccaggcgtaaccattcgagaatgaaaggtgcaagttattggtgtgatttgccatcttggtactgttgcccttgtgtaaagcattctatgtcaatgatttcggcatcgatttgtgccatctgc

SEQ ID NO: 11465 - protein, 357 aa, Panicum virgatum
  misc_feature: Ceres CLONE 1728116
  misc_feature (289)..(349): Pfam Name: WRKY Pfam Description: WRKY DNA -binding domain
  misc_feature: The sequence is a functional homolog of SEQ ID NO 1254 in the 11/479,226 US patent application
  misc_feature: The sequence is a functional homolog of SEQ ID NO 510 in the 11/435,388 US patent application
  misc_feature: The sequence is a functional homolog of SEQ ID NO 578 in the 10/412,699 US patent application
MEEVEVANRAAVESCHRVLTLLSQSQQQDPALLKSVASVMGEACAKFRKVTALLGNGGSTGHARGRFSRRGRPAGLFTLKSLLGSSSDTRSELMPSTAAAPSPSSSYAQLRARISGAPDPRGLDLASSSGKSGTHPFGAPKMVQPLSVQFQIGNVAHRYPFHQQPSRQKLQAEMFRRSNSGISLKFDSPSPSGGAGTMSSARSFMSSLSMEGSVASLDGKRPFHLVGAPVASDPADANRVPKRRCTGRGQDGTGKCATTGRCHCSKRRKLRIKRSIKVPAISNKIADIPPDEYSWRKYGQKPIKGSPHPRGYYKCSSVRGCPARKHVERCVDDPAMLIVTYEGEHNHTRPPAQSVQT

SEQ ID NO: 11466 - DNA, 1858 bp, Panicum virgatum
  misc_feature: Ceres CLONE 1728129
  misc_feature: Encodes the peptide sequence at SEQ ID NO. 11467
aaaagcggaggcgaaagcgaagggggaggggagagtggaggcagagcggtcggctggtcgggccggcggcgacggtgacgcctcgctcgctcgctgtggccctacgcattccgcgcaggttgagctcctcctcccgattcgttttgctgaggagtttcttggagcgcgggcggtgtgaggtcgatgggattgctgagcataggtgctagctgttgagctcacagaagaaaaaaagggagggctaccatggggatttcagctaagtggataaaatcacttgttgggctaagaaagcatgaaaaggagcgaaatgctgaaaccagcgccgggaggagctctggtgcccacttgctacacaaacaggatcattctgtagatacaaaaggtgctcttgcagctgaagaactcagagtacaagctgaaccattggctgctgaagcaaatacagagacaatatcaaattccacttcctcaccgagcacatcttttcaagtttctcagactgaacatggtacaaaggagtatcaggctgctgtggttattcagtccgccttccgagcattcctggctagacgtgctttacgggcgttaaaagggctagttagactccaggcacttgtaagaggtcatgctgtaagaaagcaagcagcagaaacacttcagtgcatgcaagcgctggtgagagctcaagctcgtgtgagagcaagacgagtccgtgtttctttggaaagccaagggacccaaaagaaacctcctgaaaagaatgttcatgaggaccatgttcaagatattgaggaagactggtgtggtagtataggctcagtagaagaaattaaagctaaggcattgaaaaggcaagaagctgcagctaagcgggaaagggcgatggcgtatgctttaacccatcagtggcaaacaggttcgaagaaacagaaagcagcgagcctccaagaccaaggacttgtagggaacgaaaatcagtgggggcgaaactggttagagaggtggatggctgcacgcccatgggagaacaggttacttgacagtaatgccaaagaaagtgtcacagttggtgatgacaaacctgctgaggaagacaaggctaaagctctgaacaaaccaaagggaaaactacccgtttcaaccacacaatcaaatggatcacggcagaagaaaggcacaggccacaagaagtcacattctgatgtaagtgactcttcatcggggcagtctgcaagtgtgcaaccaactgcttctttggagtcatccaagataaaagagaagctatcagatgaaatcgcagatgaagtcagctctcaacctttgaaattggcttcccgatccacgagcaatccaaaagaaaggccagcacaaatcaatgcaccagcgaagaagcgattatcccttcctaacaatgcaacagccaatggtggtgtaggaaaacgtcctgccaatagtacccagacaacccaggccacgagatcgaagaatgcagtgaaaggaggttccaaatctgaatcaagagagaagccgaagccttctagcacaaccacgaagccagttgaggcgcaagcctgagacaaaaccactcccatttcattcagaccattggtgatgcccctttgtcatgcgtgctgttgcgtttgtgtctgtgtacataaaatcggaaaacaaatccagcatctgaactgatgccatgttgtattctacaattgtgcgagaagattgttagcgttgtctagagtgatgtacatcgtttgtgctgttgttatcgacaattgtgtatgttcccttcagattgctcggtgtatgaagattcgaaaaccatctttctaaatgtcatgatgtagttgtagtc

SEQ ID NO: 11467 - protein, 443 aa, Panicum virgatum
  misc_feature: Ceres CLONE 1728129
  misc_feature (93)..(113): Pfam Name: IQ Pfam Description: IQ calmodulin-binding motif
MGISAKWIKSLVGLRKHEKERNAETSAGRSSGAHLLHKQDHSVDTKGALAAEELRVQAEPLAAEANTETISNSTSSPSTSFQVSQTEHGTKEYQAAVVIQSAFRAFLARRALRALKGLVRLQALVRGHAVRKQAAETLQCMQALVRAQARVRARRVRVSLESQGTQKKPPEKNVHEDHVQDIEEDWCGSIGSVEEIKAKALKRQEAAAKRERAMAYALTHQWQTGSKKQKAASLQDQGLVGNENQWGRNWLERWMAARPWENRLLDSNAKESVTVGDDKPAEEDKAKALNKPKGKLPVSTTQSNGSRQKKGTGHKKSHSDVSDSSSGQSASVQPTASLESSKIKEKLSDEIADEVSSQPLKLASRSTSNPKERPAQINAPAKKRLSLPNNATANGGVGKRPANSTQTTQATRSKNAVKGGSKSESREKPKPSSTTTKPVEAQA

SEQ ID NO: 11468 - DNA, 626 bp, Panicum virgatum
  misc_feature: Ceres CLONE 1728130
  misc_feature: Encodes the peptide sequence at SEQ ID NO. 11469
ataagtgaaagttcaagcaatcgaacaacagtctcctaatctacactctaatggagcgccacacagtctcgagatcccccgatagagctctccccccgtagcctctgtactgagatggctccggagattgcgggcaagatgactgccaaggccgccgccgcaggcgcggtgaaaccagcgaccagtgcgtacgtgacgttcctggcgggcgacggccaatactggaagggcgtggtgggtctggtcaagggcctgcgcaaggtgggctcggtgtacccgctggtggtcgccgtgctgcctgacgtgccggaggcccacctccggatcctcgtctcccaagggtgcattgtccgcgagatagagcccgtgtacccgccagagaagcacacgcaactcgtggtggactactacctcatctgatactgcaaacttcatatctggtagttcttggagtacgagaggatagggtaactgcacgcacagattcaggtgttcgataacatcgactacctgtgcaagatcgagaaggtccacttcgacgccgcgatggactgcttctacgagaagacatgaagccgcacccatcatgataagatctgctactgccagtactgctccgacgaggt

SEQ ID NO: 11469 - protein, 101 aa, Panicum virgatum
  misc_feature: Ceres CLONE 1728130
  misc_feature: Useful for making plants with altered carbohydrate content
  misc_feature: Useful for making plants with altered cell wall content and/or composition
  misc_feature: Useful for making plants with modulated water use efficiency
MAPEIAGKMTAKAAAAGAVKPATSAYVTFLAGDGQYWKGVVGLVKGLRKVGSVYPLVVAVLPDVPEAHLRILVSQGCIVREIEPVYPPEKHTQLVVDYYLI

SEQ ID NO: 11470 - DNA, 424 bp, Panicum virgatum
  misc_feature: Ceres CLONE 1728130-R
ggcggtgcccaagaagccgatcggtgtggcgctgggggaggcagccacggtcaagtatgtcacggagcagtggtctgcgtgatccccgctgctggggagggagtgttcatcactcatcagaacataagaaagatcttaatacgaggcctttagtttttgtttctttcacttcccgtttcgtttcctgatgaattagggtgtctgaattcagatcagttccgtttccaggtgggggagggtggagcttacaataccattccaagcctcacacgggtttggtcaggattgggatttggaacacgccccctctggtcacagccagagtatttgtccagtgcggagggataataaggtttagaatttcggcatggtaacataataccgaagaatcttttacataataggaaaccacaagattacgggc

SEQ ID NO: 11471 - DNA, 2651 bp, Panicum virgatum
  misc_feature: Ceres CLONE 1728134
  misc_feature: Encodes the peptide sequence at SEQ ID NO. 11472
aaaaaaatacccaaaaaatatcaattattgcataaaacacctctcggccacctccccgcgacccgcccagatgccggccacggcgagcggcggcgcgtggccggaggaggcggcggcggcggcggcacccgcggcctcctgcatggggacgaggccggaggagctgacggcgaggctggcggcctcggggcccgccgccccgggcgcgggccgcggcggttccggcgccagcgtgggcggagaggaggcggaaaacgagcgcgtgcgggcgctgcgtgagatcaagaaccagatcatcgggaaccggaccaagaagctcctctacctccgcctgggcgccgtgccggcggtcgtggcggcgctggcggagcccggggcctcgccggcggcgctcgtccaggcggcggccgcggcggggagcttcgcgtgcggcatggacgacggcgcgcgggccgtgctggccgccggcgccgtggggcacctcacccggctccttgcgcaccacgacgagaaggttgtggatgcaagtgctcgtgctctcagaatgatatatcaatcaaaactagctccaaagtttgatgttaataatgggaaaaacatggattttattctttcccttttgaacagtgagaacgagaatgtcaccgacctggctgctactattatatctcactcctgtgagaatagctcagaacaattgtcactatgcagtgctggagttccacagaaacttgttagtcttttcggaggttctatgaatttgcgggatgcttgcttagattctgttactgcagttattcgaaacaacagagaagttgcttcaagatttgcatcaacggaccacggaaaaggttttcgttcagtagttgggttaatacatgatcggagtccacgcacaagactacttgcttgtctgtgcttgatagcacttgggcatgcttctccctgtcatttccaggacaaacagattaagaccaagttgattatggtcttacttgagctaattgaagaaccaggtcaagtaggtgatgaagctcccttggcgttaaccaccctgatgaaagacagcctggaactgcagaaacaagcccttacaacgagtgcagttgagaagctcagcaaccatctgctagcaaactcactggaatcaaggcgagcagtgaccatattgcttgcattatctgaactttgctcaaaactggaagaatcaagatctcagcttatgtcagttgaggcatcaaccttaatccttgaggcattgaagcatgattgggctgatatccgtgttgcagcatgttcatgtctgaagaatatctccaggtcacctaaggtactcagtggaggccgattatcctgtgatacagttattggtcccttggtccagcttttacaggactcatctacttcagtccaggtcgctgcccttggtgccatttgcaatattgccgttaatttgacacccaggaagtcagttcttcttcattctggggttgtctcacaacttgttcatttatcaaagtccatggatccaacattgaggctaaagtctgtatgggctctcagaaatattatgtttcttctgagtccaaaagataaagacttcattgttaaggagttgactctatctactctttcaagcctcatatgtgactccgaacattttgttcaggaacagaccttggcacttgtgcacaatctggttgatggatatgttgactctgctaattatgtcattggcgaagatggaatggttattgatgctattgcaagacaactgaataatgcatctgccccgggagtgtgcatacagggtatgtttgtgcttgcaaacattgcggccggaaacgaaatgaacaaggaagctgtgatgaatgttcttcttcctcaccgagccgatcgcgttaggccatcctttgtggtgaactttctgcaaagcaaggataagcagttgcgggttgccactctctggtgtcttctgaacttgatttacccaaaatgtgaagcctcatctggtcgagttgtcagactacaaaattctggagtgatcctacaagtgaaaagcatgataaatgacccgtgcttggattgcaagcttagagtacgtatggtgcttgagcactgcgtggacaacgctgatgattgtttcatgtgagcaaccggcattttcatctaggcaacggaagttcacggaatcatattcggaccgggcaagaaaccagtgtgctatggatccaatacacgccctgaactgtggaacatgagcacctgcaggaagactgctgctttgtctgatctctccgggtcggctcaagccaactgctgcccttttcgcaccatgagaacccaccaaacaggatctgctgtgcccattgtcgatcagcttgtttttaaccgtgccatcctcgagaacttgagcttcctgctccaagactggatggttttcgcactagctacaggagtccaaaattttcctagtgccttccgaacccagtgcttgcatcgcgatgctgagtgtataattgagggtctgctgttggtgccgtcactgttgttgtacaaaacctgtatttttgttccaataaggccgttttacattcatgggtgggttgttcatttactcccatgttccaaggaatatgcaaaagttcgtc

SEQ ID NO: 11472 - protein, 693 aa, Panicum virgatum
  misc_feature: Ceres CLONE 1728134
  misc_feature (462)..(502): Pfam Name: Arm Pfam Description: Armadillo/beta-catenin-like repeat
MPATASGGAWPEEAAAAAAPAASCMGTRPEELTARLAASGPAAPGAGRGGSGASVGGEEAENERVRALREIKNQIIGNRTKKLLYLRLGAVPAVVAALAEPGASPAALVQAAAAAGSFACGMDDGARAVLAAGAVGHLTRLLAHHDEKVVDASARALRMIYQSKLAPKFDVNNGKNMDFILSLLNSENENVTDLAATIISHSCENSSEQLSLCSAGVPQKLVSLFGGSMNLRDACLDSVTAVIRNNREVASRFASTDHGKGFRSVVGLIHDRSPRTRLLACLCLIALGHASPCHFQDKQIKTKLIMVLLELIEEPGQVGDEAPLALTTLMKDSLELQKQALTTSAVEKLSNHLLANSLESRRAVTILLALSELCSKLEESRSQLMSVEASTLILEALKHDWADIRVAACSCLKNISRSPKVLSGGRLSCDTVIGPLVQLLQDSSTSVQVAALGAICNIAVNLTPRKSVLLHSGVVSQLVHLSKSMDPTLRLKSVWALRNIMFLLSPKDKDFIVKELTLSTLSSLICDSEHFVQEQTLALVHNLVDGYVDSANYVIGEDGMVIDAIARQLNNASAPGVCIQGMFVLANIAAGNEMNKEAVMNVLLPHRADRVRPSFVVNFLQSKDKQLRVATLWCLLNLIYPKCEASSGRVVRLQNSGVILQVKSMINDPCLDCKLRVRMVLEHCVDNADDCFM

SEQ ID NO: 11473 - DNA, 2307 bp, Panicum virgatum
  misc_feature: Ceres CLONE 1728136
  misc_feature: Encodes the peptide sequence at SEQ ID NO. 11474
gcgattagcatcttgttccttttgtttcgtggacgaggaggggagagcatgaaggaggaggaggcggcggctgacgcgcgctgatcggcggatggcgcgtcggactggagctgcggagcttgcgggattccgagcccctctggaggcggatcgaatgcggagcctgctcggcggattgcgaggagctctggtttcagcttcagactgtggtgttcttgtcgcctgcttcagctaagctccgactctactcagtccttgttgcaagttgctgtttgctctcccgtgtccagcctgttctgggcgtccgtttgacttgtgactccgaggagatggacgacgaggactactcgtgggtgcggcgcaccagattctcgcagtccatcgtcaggtccagctccggcagggagcagtacggcgccgacctgaagctcaacggattgggcacggggcgcaggcttcatcgccaggatctgcagcacttggcgaagggatccgtgctctccaactcggcgaggctgccgattcccaaagccaaatcgacaggccctcagtcggaacggaagctgaagcatgcgtcttcagaaggccaattgaaccgagacaggagcagcgatcgctcgttgcggcaagcatcgccggagcagaaccggaagggggtcgggatgagcttggacattccacagcggcatgcgttccggccatcagacgatgagagcccagacgcgctggatttctccttccactcggatgagcaaagccagcagcttcagagagtgtgctccagccctgctcctttctacgcgcaggatgcagcaacaccgccagctgatgatcccagagcgcgaagtgcatccatgaagggcgctggagaggtatccaagccgatgccaaagccgaagcgcagggcaaaatcccctatccccaagcgcgccatctctgacgtgttcaaggaggccaaggctgccaccaagcgattctccagcccgcaacggcagaggaagcccacgtctccaaggtcacctgatgacagccctccgtttggctttgcttcgctgagaacaccgagcaaactgaagattaataggaggacctcctcatggccgaggaggaaccttgatgatggaccggcaaaggttgctgcatcggatatccttgagaaatggacggttgaccgctcggagttgctcatcggccatagatttgcatccggcgcatatagccgattgttccatgggatctacaaggagcaacctgttgcagtgaagtttatcaggcagcctgatgatggtgaggatgacgagttgtctgctcggcttgagaagcagttcactgcagaggttaccattctggcaaggctccaacatcgaaatgtcatcaagcttgttggtgcgtgcaattgtccaccggtcttctgtgtcatcaccgagttcctgtctgggggttctttgagggctttcttacgcaagttggagcgtaagactcttcccatggagaaggtcattttgattgccttggatattgctcgtggtctggaatacattcacctgcaaggaattgttcaccgtgacgtgaaacccgagaacattctatttgatggagaattctgcgctaaggtcgtcgattttggagtggcctgtgaagaagcacactgcaatttgttaggggatgatccgggtacttatagatggatggcaccggagatgtacaagcacaagccatatggccggaaggttgatgtttatagctttggacttgtcttgtgggaattggtcactggctcactcccttatgaagatatgacaccactccaagcagcttttgcagttgtcagtaagaacttgagacctgctattccttctagctgcccggcagcagtaaaattcctgattgagcagtgctggtcctggcaaccagagaggaggcctgagtttcgacagattgtttcaatccttgaaaacctcaagacagtacttgaaagagatggaacgctcaacaaaatcccaagcttcatctgccagccccaggaatgcaacgatcagaacaagaagaaagtttccagctggatccagaggctatcatacactcaacctgatttttccggacctccacccccgaagttactgtaattatgcgtcttcttgtcaatttttagtagcgtgttgtctggtagatagcaactctgtaaatttatttgttctctttttttttgttgagagatcagaagttttcaatgggtgttgtcctgatgatacttgagagcatatggtagaaaacttggcatgttcgtgggagaagataagtgatatt

SEQ ID NO: 11474 - protein, 598 aa, Panicum virgatum
  misc_feature: Ceres CLONE 1728136
  misc_feature (285)..(541): Pfam Name: Pkinase Pfam Description: Protein kinase domain
  misc_feature: SWISSPROT Homolog: EC 2.7.11.1 Non-specific serine/threonine protein kinase
MDDEDYSWVRRTRFSQSIVRSSSGREQYGADLKLNGLGTGRRLHRQDLQHLAKGSVLSNSARLPIPKAKSTGPQSERKLKHASSEGQLNRDRSSDRSLRQASPEQNRKGVGMSLDIPQRHAFRPSDDESPDALDFSFHSDEQSQQLQRVCSSPAPFYAQDAATPPADDPRARSASMKGAGEVSKPMPKPKRRAKSPIPKRAISDVFKEAKAATKRFSSPQRQRKPTSPRSPDDSPPFGFASLRTPSKLKINRRTSSWPRRNLDDGPAKVAASDILEKWTVDRSELLIGHRFASGAYSRLFHGIYKEQPVAVKFIRQPDDGEDDELSARLEKQFTAEVTILARLQHRNVIKLVGACNCPPVFCVITEFLSGGSLRAFLRKLERKTLPMEKVILIALDIARGLEYIHLQGIVHRDVKPENILFDGEFCAKVVDFGVACEEAHCNLLGDDPGTYRWMAPEMYKHKPYGRKVDVYSFGLVLWELVTGSLPYEDMTPLQAAFAVVSKNLRPAIPSSCPAAVKFLIEQCWSWQPERRPEFRQIVSILENLKTVLERDGTLNKIPSFICQPQECNDQNKKKVSSWIQRLSYTQPDFSGPPPPKLL

SEQ ID NO: 11475 - DNA, 730 bp, Panicum virgatum
  misc_feature: Ceres CLONE 1728159
  misc_feature: Encodes the peptide sequence at SEQ ID NO. 11476
actcgcgaatcgcccacaggcgaacaggccacagcgccaccgcccgcccaggcgtccgccggccgccgccagaccgccaccgcgccacctccaaagccacagcccactgcgcctccgcgagcgtgcagccgtgcagccccctaccccttccggccttcccccctgaccccgaggcggccaccggcgtccggcgaggccccttcacccggccgacccgaaatttttgggtaacccgaacgcccagtcatagctgcaggctgcacacgcacgcatcgacgcatcgtcgagaactcaagaccagtctcactagcccagccaccagtccacccggctccggccatcctccatgatttcgccgccgatgccgacgcatctcctcccgacgcgggcgatctcatctctctcaaatggctgcgcagcgacagcgagcccctcctctccctcgatggctgcacggccgcggcgattccctacagggcttcaatctgtggctggcagagggaagttttcagtggcagccatcactctagatgattatcttccaatgcgaagcactgaggtgaagaaccggacatcaacaggtgacatcacaagtctcagactaatcaccgctgtgaaaaccccctatttgcctgatggaaggtttgatcttgaagcatatgattctctcataaacatgcagatagagggtggtgctgaaggtgtaattgttggaggaacaacaggagag

SEQ ID NO: 11476 - protein, 127 aa, Panicum virgatum
  misc_feature: Ceres CLONE 1728159
  misc_feature: SWISSPROT Homolog: EC 4.2.1.52 Dihydrodipicolinate synthase
MISPPMPTHLLPTRAISSLSNGCAATASPSSPSMAARPRRFPTGLQSVAGRGKFSVAAITLDDYLPMRSTEVKNRTSTGDITSLRLITAVKTPYLPDGRFDLEAYDSLINMQIEGGAEGVIVGGTTG

SEQ ID NO: 11477 - DNA, 586 bp, Panicum virgatum
  misc_feature: Ceres CLONE 1728159-R
  misc_feature: Encodes the peptide sequence at SEQ ID NO. 11478
ttaagcactacacggacaaaggtatagcaatatggagtggtaaggacgacgaatgccatgattctaggtggcaacatggtgctactggagtcatttctgtcgcaagtaaccttgttcctgggctcatgcacagcctcatgtacgaaggcgagaatgcgacactaaacgagaagcttttgcctcttatgaagtggttgttctgccagccaaatccaattgcgctgaacactgctctggcccagcttggggtggcacggccggtcttcagattgccatatgttccccttcctcttgaaaagaggattgagttcgtccggattgttggggctattggaagggagaactttgtgggacagaaagagttgcggattctcgatgatgacgatttcgtgttgatcagtaggtactaggaagtgggtttgtccgtatctctgtattttgatgaataaagctgagagtgtgcacgttgcgtttacagacttggttctgttcatcagtagttggttttatctattttattggtgctgccttggattctttgtataatacaagtttacagtttcttagctacgtatattggttcatg

SEQ ID NO: 11478 - protein, 135 aa, Panicum virgatum
  misc_feature: Ceres CLONE 1728159-R
  misc_feature (1)..(111): Pfam Name: DHDPS Pfam Description: Dihydrodipicolinate synthetase family
  misc_feature: SWISSPROT Homolog: EC 4.2.1.52 Dihydrodipicolinate synthase
KHYTDKGIAIWSGKDDECHDSRWQHGATGVISVASNLVPGLMHSLMYEGENATLNEKLLPLMKWLFCQPNPIALNTALAQLGVARPVFRLPYVPLPLEKRIEFVRIVGAIGRENFVGQKELRILDDDDFVLISRY

SEQ ID NO: 11479 - DNA, 2224 bp, Panicum virgatum
  misc_feature: Ceres CLONE 1728170
  misc_feature: Encodes the peptide sequence at SEQ ID NO. 11480
atgtctctctctcggcattctcccttcctagcttagtttcgcttctcgcgatcgccatgggcacctcttcccgccgcaatgccaccacagcggaggcgctgcttcttgcactgatgctgtcgtcctcggcagcgcgggcggcggccgccgacccggggttctcgtgcggcccgtcgtcgccgtcgcggtcgctcccgttctgcgaccggtcgctcccggcggcgcggcgcgcggcggacctggtgtcccggatgacggtggcggagaaggtgtcgcagatgggggacgaggcggcgggcgtgccccggctgggcgttccgccgtacaagtactggtcagaggggctccacgggctggccttctggggccacggccttcggttcaacggcgccgtccggggggtcaccagcttcccgcaggtgctcctcaccgccgcctccttcgacgagggcctctggttccgcatcggccaggaaaaccctggggtcaacggcgtgccggcgtgcgccagctccgacctgctcaccaggacgttcaggggcgactggggcctcggcggctacgtcgcgtccgactgcgacgccgtggccatcatgcgcgacgcccagcggtacgcgcccacgccggaggacaccgtcgccgtcgccctcaaggccggattggacctcaactgcgggaactacacgcaggtgcacggcatggcggcgatccggcaggggaagatggcggagaaggacgtggacaaggccctcacgaacctcttcgccgtgcgcatgcggctgggccacttcgacggcgacccgcgcggcagcgcgccctacggtaggctcggcgcggcggacgtgtgcacgacggagcacaagagcctcgcgctcgaggcggcgcaggacggcatcgtgctgctaaagaacgacgcgggcatcctcccgctcgaccggtccgcggttggctccgcggccgtcatcggccacaacgccgacaacccgctcgtgctcagcggcaactacttcggtccagcgtgcgagaccaccacgccgctcaaggggctccagggctacgtcaagaacgtgaggttcctggccggatgcaactcggcggcgtgcggcgtcgctgcgacgggtcaggcggccgcgctggcgagctcgtcggagtacgtgttcctgttcatgggcctgagccaggaccaggagaaggaagggctggacaggacgagcctcctgctcccgggcaagcagcagagcctcatcaccgccgtcgccagcgcggcgaagcgcccggtgatcctggtgctcctcaccggcggccccgtggacgtcacgttcgcgcagtctaaccccaagatcggcgccatcctctgggcaggataccccggccaggccggcggcctcgccatcgcaagtgtcctcttcggcgaccacaaccccagcgggaggctgccggtgacgtggtacccggaggacttcaccaaggttcccatgacggacatgcggatgcgcgccgacccggccaccggctaccccggccggagctaccgattctacacgggcaagaccgtctacaatttcggctacggcctcagctactccaagttctcgcgccggctactcgccggcgggaagaaccctgctcccaacacgagcctactcgccggtctgcccgcgacgtccaaggacaccacgagctactaccacgttgacgacatcggcgccgacgggtgcgagcagctcaagttcccggcggaggtccaggtagagaaccatggccccatggacggcaagcactcggtgctcatgttcctccggtggcccaacgcgaccaacggccggccgtcgagccagctgatcgggttccggagccagcatctcaaggcaggggagaaggccaatgtcaggatcgacgtcagcccgtgcgagcacttcagcagggcgagggaggacggcaagatggtgatcgacagagggtcccacttcctcatggttggcagagacgagtgggagatcagcttcgaagcatgaggttatttcaggtatggctggagaaagcattacgatctacaggtgggtccagtgcaattctttggttattagtaactatacaggaattcaccagacaggtacatgacataagaacttaagttatttataatttatgattcatagttttgcctcgaaaaaaatgaggctgttacatgtaatttattatcaataagaatgtttaccagtgg

SEQ ID NO: 11480 - protein, 652 aa, Panicum virgatum
  misc_feature: Ceres CLONE 1728170
  misc_feature (280)..(511): Pfam Name: Glyco_hydro_3_C Pfam Description: Glycosyl hydrolase family 3 C terminal domain
  misc_feature (79)..(207): Pfam Name: Glyco_hydro_3 Pfam Description: Glycosyl hydrolase family 3 N terminal domain
  misc_feature: SWISSPROT Homolog: EC 3.2.1.21 Beta-glucosidase
MGTSSRRNATTAEALLLALMLSSSAARAAAADPGFSCGPSSPSRSLPFCDRSLPAARRAADLVSRMTVAEKVSQMGDEAAGVPRLGVPPYKYWSEGLHGLAFWGHGLRFNGAVRGVTSFPQVLLTAASFDEGLWFRIGQENPGVNGVPACASSDLLTRTFRGDWGLGGYVASDCDAVAIMRDAQRYAPTPEDTVAVALKAGLDLNCGNYTQVHGMAAIRQGKMAEKDVDKALTNLFAVRMRLGHFDGDPRGSAPYGRLGAADVCTTEHKSLALEAAQDGIVLLKNDAGILPLDRSAVGSAAVIGHNADNPLVLSGNYFGPACETTTPLKGLQGYVKNVRFLAGCNSAACGVAATGQAAALASSSEYVFLFMGLSQDQEKEGLDRTSLLLPGKQQSLITAVASAAKRPVILVLLTGGPVDVTFAQSNPKIGAILWAGYPGQAGGLAIASVLFGDHNPSGRLPVTWYPEDFTKVPMTDMRMRADPATGYPGRSYRFYTGKTVYNFGYGLSYSKFSRRLLAGGKNPAPNTSLLAGLPATSKDTTSYYHVDDIGADGCEQLKFPAEVQVENHGPMDGKHSVLMFLRWPNATNGRPSSQLIGFRSQHLKAGEKANVRIDVSPCEHFSRAREDGKMVIDRGSHFLMVGRDEWEISFEA

SEQ ID NO: 11481 - DNA, 1810 bp, Panicum virgatum
  misc_feature: Ceres CLONE 1744306
  misc_feature: Encodes the peptide sequence at SEQ ID NO. 11482
gcttcaggatacatgggccgcgatgggcgatacgaagcttattggtcttgcggacgatgcataggagcccccctatccgccgggaattattgcggctctccggcctccgcccgccaccgcgagcagctcccgccggagaatgagatggtggcattgactcgcggcgccgagaagaggagaatggaggccgcccaggggcagcacccggaggcgatcgcaggctctccagcctccaccagctgagcccgcggccaccgcctgcaaatggcgacggagccgccccatcccaaatctacaggcaagccgcaagggcagccgccgccgccgctcggcgccggcgaggaaggaggcggcggatgcttctgcggcggcgatcgcatcagcggcgtcccggacgccattctcggcgagatcatctccctgctccccatcaaggacgccgcccgcacgcaggcgctcgcctcccggtggcgccacctgtggcgctcctcccctctcagcctcgacggcggcgacctcccaaccgagggtgaggtctcccgcgccggcctcgtctcgcgggtcctcgccgcccacccgggccccgcccgccgcttctccgtctccgcgctccagctcctgctctgcccctcggcggtcggctcctggatccgctcccctgcgctcgacggcctccgggagctcgagttccacatcggcgagctgataaatctgcagtcgcccttgccgtggctgccggactccgccttgttccgtttctcggccaccctccgcctggccaccatcagcagatgccgcatctcggaaggcgctgtcggagcgcttcgcttcccccagctcagggagctttcgcttgagagcgtccgcatctcggaggaatcactgcagagcatgattgctggatctcctgtcctggagtgcttgctgcttagccgcagcgttggcttcagtcgtgtccggatcaactcccggagccttgtaagcatcggtgtgcgagatttctcaggggaactcatcatcgggaacgccccttcgcttgaacggctgctgcaactcgaactatttcgggaccttcgtgtgtcaatagtttcagcaccaaagctggaaacgttgggctggatttctgaccgtgatcactacttcaagctggcatttggcactgcagcagttcaggacttgcgttctgttagcgctacggcagtggtgcgtagtatcaagattctagctgttgatattcatacacttagcatggatatggttcttgatttagtgagatgctttccatgcttggagaagctgtacatcgagttttttctgtcggtggacagaaattcatggtgtcgtaaacaacatgatgttattagatgccttgatatccgtctgaagactgtagtgttgaagaattattgtggcacaatgtctcatgttaactttgcgtcattctttgtattgaacgcaaaaatgctggagtcaatgacatttgagggtggagcctgccataatcaaaggtttattgcagagcagcatagtttacttgagctcgagaaaagggtttcgagaagcgcacagttttatttcacagttcgtagatctcaggacaaaaatcttacacatgtcaaatatgtccatgatttgtcaataactgatccttttgaatatagatgttgaaactgggttggtttgtgtagttcagtagttattcttgcctagctcatttccacatctgtgttttgttcatattgatcggttctcttgtgtgtagtgttttgtaatttgtacaattctgcaaccttctgatattagccggccc

SEQ ID NO: 11482 - protein, 467 aa, Panicum virgatum
  misc_feature: Ceres CLONE 1744306
  misc_feature (357)..(408): Pfam Name: FBD Pfam Description: FBD
MATEPPHPKSTGKPQGQPPPPLGAGEEGGGGCFCGGDRISGVPDAILGEIISLLPIKDAARTQALASRWRHLWRSSPLSLDGGDLPTEGEVSRAGLVSRVLAAHPGPARRFSVSALQLLLCPSAVGSWIRSPALDGLRELEFHIGELINLQSPLPWLPDSALFRFSATLRLATISRCRISEGAVGALRFPQLRELSLESVRISEESLQSMIAGSPVLECLLLSRSVGFSRVRINSRSLVSIGVRDFSGELIIGNAPSLERLLQLELFRDLRVSIVSAPKLETLGWISDRDHYFKLAFGTAAVQDLRSVSATAVVRSIKILAVDIHTLSMDMVLDLVRCFPCLEKLYIEFFLSVDRNSWCRKQHDVIRCLDIRLKTVVLKNYCGTMSHVNFASFFVLNAKMLESMTFEGGACHNQRFIAEQHSLLELEKRVSRSAQFYFTVRRSQDKNLTHVKYVHDLSITDPFEYRC

SEQ ID NO: 11483 - DNA, 1877 bp, Panicum virgatum
  misc_feature: Ceres CLONE 1744372
  misc_feature: Encodes the peptide sequence at SEQ ID NO. 11484
aatcccggcgcgcgcacccccgcctcactgccactgccatggccctggtcctctgagagctctctcgttcccgctttgccgccgtgcatccaggctctcagcttctcccacgggcagctagttggaccaagcttgacgatggcgccggtcatcaggtcgtgcgtgtccgtgaaggccgccgcgagcccggtcaggtacagatccgcgagggtcggggcggcgggcttggggacgccgcgaagcctgcggatatgctcctcatccgtgccgctcggcggcgacgcctgcagcgacggcggtcgcgccgccagcatcagcgggagggacgtcgtcgtcagtggcggtaccggctcgctcggcggcggtgggccgagcgtcaggcggcgggacgtcgccgcctcgggcagcgcgagcttcgacggggtccggcccgtccccgtccccggcgccgctgccgtggcgagcgccgtccagcccgcggtggcgtcggcgttcccggagcgggccaaggtggtggcactggtggcggccatcatgctgatctgcaacgccgaccgggtcgtcatgtccgtcgccgtcgtgccgatggccgcgcagtacggatggtccagctccttcgtcggaatcgtccagtcatcatttttgtggggatacgttttctcatccatggttgggggagctttggcagacaaatatggcggcaagaaggtgatggcaggtgctgctgcactctggtccttggctacaatcctcactccttgggccgcctcccgctccaccatcatgttgcttgctgtgcgtgcactctttggcctagcagaaggtgttgcatttccgacaatgagcaccttcttaccaaagtggttcccaacacaagagcgtgccacggctgttggcatttctatgggtggatttcatcttggaaacgtcatcagcttccttgcaacaccgatcatcatgtcacacataggcattactggaacatttgccttctttgcatcgcttggttacttgtggctccttgtatggatgtttaatgtagaaagcgatcctgttgacagccgtaccataagcaaatctgagctgcaatttatcctagctggaagaagtggatctaaagctaaaggcagtaaatgcccatccctaagggaattgttctcaaaacttgagttcttggctgtcactgtagccaatgtggtcaacaactggggctactttgtcctactgtcgtggatgcctgtgtacttcaaaacggtttataatgtaaatctcaaacaagcagcatggttcagcgccataccttgggcagtcatggctatgtctggttatgttgcaggagcctctgcagatttcctgatcaaatctggtttctccataggactagttcggaaaattatgcagtccattggttttatggggccgggtgtgtcattgctatgcttaagatttgcccaaaccccatcagttgctgcagttctcatgaccactgccctgagcttgagttctttcagccaagccggatacttctgcaatgtacaggacattgctcccaaatacgctggatccttgcacgggctcacgaacggcatcggaacagtggcagccatagttagcaccatcggggccggctacttcgtgcagtggctagggtccttccaggccttcctcaccctcacggcggcgctctacttcagcgccaccgtcttctacaacgtctacgcgaccggcgacctggtttttgactgagaaacaaaattggttagattctttggtgcagaatcccaaagtgtaccaacatttatttgtatctccccaggaaaggaataagatagaccctcttattcgctttcaatatataaagcggagttttcgccgtc

SEQ ID NO: 11484 - protein, 535 aa, Panicum virgatum
  misc_feature: Ceres CLONE 1744372
  misc_feature (128)..(493): Pfam Name: MFS_1 Pfam Description: Major Facilitator Superfamily
MAPVIRSCVSVKAAASPVRYRSARVGAAGLGTPRSLRICSSSVPLGGDACSDGGRAASISGRDVVVSGGTGSLGGGGPSVRRRDVAASGSASFDGVRPVPVPGAAAVASAVQPAVASAFPERAKVVALVAAIMLICNADRVVMSVAVVPMAAQYGWSSSFVGIVQSSFLWGYVFSSMVGGALADKYGGKKVMAGAAALWSLATILTPWAASRSTIMLLAVRALFGLAEGVAFPTMSTFLPKWFPTQERATAVGISMGGFHLGNVISFLATPIIMSHIGITGTFAFFASLGYLWLLVWMFNVESDPVDSRTISKSELQFILAGRSGSKAKGSKCPSLRELFSKLEFLAVTVANVVNNWGYFVLLSWMPVYFKTVYNVNLKQAAWFSAIPWAVMAMSGYVAGASADFLIKSGFSIGLVRKIMQSIGFMGPGVSLLCLRFAQTPSVAAVLMTTALSLSSFSQAGYFCNVQDIAPKYAGSLHGLTNGIGTVAAIVSTIGAGYFVQWLGSFQAFLTLTAALYFSATVFYNVYATGDLVFD

SEQ ID NO: 11485 - DNA, 1723 bp, Panicum virgatum
  misc_feature: Ceres CLONE 1744404
  misc_feature: Encodes the peptide sequence at SEQ ID NO. 11486
gacccacgcccaaacgcacgcacacacgggcagaggcgcggcggtggtggggtgcgggcgggaggaagcggagcggggcgaggcgcgggcgtcggcggccgcctccgcggactgcgaggtcggcgggaggtgcgcgtcggggagctgacgttcccggcggcggtgggggcaccgagcgaccgggcaccacggcggccgcgacggaggccagcggcgggggcggggaccccggggcggcggcgaggcggcgctgggatctgcccggcaaggcggccgggagcattgcaatggagaaagaagttgtagatatgtctacagatgaagaatcagattgtgtagttatatgcccacctaacggaaatgctgatcacgagcaagttgtgagtggcagccatgacgaaaattctccagaaaggcatgagacccctcatgccatagactcgcatatggacagcaatggccaggaagacatgcctgtaaaccaagactcaccaaagctgattgatgagcaggagtcgtctctcaccaattcaccagcacagcctgctatagctggacagccagggtctaggcgtagtgttcctgagccatgcactgttgcagctgaaaggaggtcttctaccgctggaaattgtgctccaatttctcatcccaccagcagtggtgaaaaattttctgataaaagtagctcctcaccaagaagcatggcaaagaagagtccgttagtcacacccaggaagcctgtccaatctgacaatacttctcacagtctagaagatgactcatattctgtcacttcttcaactgtaacttcagcaagagctggaaaaactaagaagacaacagttgctgttgcacctacgtttgtctgcgataatcgtgctgagaagagaggagagttctatacaaaattagaagaaaagcggaaggctttggaagaggagagactccaagcagaggccaggaaaaaggaagaggaagaagaagctctaagacaactaaggaagaacttggttgtccgagcaaaacccatgccgagcttctaccaagagggacccccgccaaaggttgaacttaagaaggtgcctccaactcgtgctaggtcaccaaaattgacacggagaaagagctgcagtgactcccctcaaacacccgagggaggaaatggcagtgcagtatgctgtcggttgcatcgtcacagcattgggaactccaaagatgttagcagcaaggcacaatgttctccgaagagctctccaaagactgggtctgctacgaaatccaggaccaccaaatccagggaagacctgaagggtacaattaagaaagttggaaagccaagctccgcaaatgtcgctgtacaaacctaactgatgaatcattctcactcccatgccatttttcattttaatttatacctcacatcaccaaaaggatggcctcatgccccgacagcagtgtgtttgttgctggattattttttgcattgtccttgtaagaaccatgctacaagagaccatgtgatgttctgtgttgtacatttattgagggttttgtatgtggtaaccgagtcggttctgcaagaaccaagctggcagctgatgagctgttggagtgagtaacattgttgttgtatggcggcatttgcagatcctatgtattgtatgagctgtaacttattatgggtgtttgttgcaaaatctgatcaggtcatcgttcatgt

SEQ ID NO: 11486 - protein, 360 aa, Panicum virgatum
  misc_feature: Ceres CLONE 1744404
  misc_feature (193)..(249): Pfam Name: TPX2 Pfam Description: Targeting protein for Xklp2 (TPX2)
MEKEVVDMSTDEESDCVVICPPNGNADHEQVVSGSHDENSPERHETPHAIDSHMDSNGQEDMPVNQDSPKLIDEQESSLTNSPAQPAIAGQPGSRRSVPEPCTVAAERRSSTAGNCAPISHPTSSGEKFSDKSSSSPRSMAKKSPLVTPRKPVQSDNTSHSLEDDSYSVTSSTVTSARAGKTKKTTVAVAPTFVCDNRAEKRGEFYTKLEEKRKALEEERLQAEARKKEEEEEALRQLRKNLVVRAKPMPSFYQEGPPPKVELKKVPPTRARSPKLTRRKSCSDSPQTPEGGNGSAVCCRLHRHSIGNSKDVSSKAQCSPKSSPKTGSATKSRTTKSREDLKGTIKKVGKPSSANVAVQT

SEQ ID NO: 11487 - DNA, 770 bp, Panicum virgatum
  misc_feature: Ceres CLONE 1744456
  misc_feature: Encodes the peptide sequence at SEQ ID NO. 11488
agcccacagggccacaagctcctggcggccaggccatggccttctcttcttcgctggcgttccccttcccttccccgccttctggaaccttccaaacccgatccgcaggaaggctccggactggcgccaccgagagattcctggagcgctcctcgcccccgccagacgtcgtggtgacacgcgagcggggaaagaacgccaagctcatcgccgcgctggaaaaacacaatatacagtctctggaacttcctcttattaagcatgttgatagccctgatacagataggcttccagaagtcttaagtaatgacaagtttgactggattgctataacctctcctgaggcagctgcagtgttccttcgcggatggaaggctgctggaagtcctaaggtgcgagtagcggttgttggagcaggaactgcaagggtttttgatgaagtatcacagtctgatgatcaatcccttgaggttgcattttcaccttcgaaagctatgggtaaagtcttagcctcagagctacccagggtcagtgagagcacatgtaaagtgttgtatcctgcatctgcaaaggctagtcgtgaaattcaagaggggctatcagatcgaggatttcatgtgaccagactgaatacatatacaaccgtacctgttgaagatatcgaaccactaactttgaagcttgctatttcagctcctgttgttgcagtagcttctccttctgcactgaaagcttggttaaagctggtttccaaagtcgattgttggaat

SEQ ID NO: 11488 - protein, 244 aa, Panicum virgatum
  misc_feature: Ceres CLONE 1744456
  misc_feature (52)..(242): Pfam Name: HEM4 Pfam Description: Uroporphyrinogen-III synthase HemD
MAFSSSLAFPFPSPPSGTFQTRSAGRLRTGATERFLERSSPPPDVVVTRERGKNAKLIAALEKHNIQSLELPLIKHVDSPDTDRLPEVLSNDKFDWIAITSPEAAAVFLRGWKAAGSPKVRVAVVGAGTARVFDEVSQSDDQSLEVAFSPSKAMGKVLASELPRVSESTCKVLYPASAKASREIQEGLSDRGFHVTRLNTYTTVPVEDIEPLTLKLAISAPVVAVASPSALKAWLKLVSKVDCW

SEQ ID NO: 11489 - DNA, 1946 bp, Panicum virgatum
  misc_feature: Ceres CLONE 1744928
  misc_feature: Encodes the peptide sequence at SEQ ID NO. 11490
taacaaagttaagctcggaaacggcaaaagccatggcgagcgcaggctgcaggcaggccgaccagtctcctcctccgcccgcttcccaccgagctcgcactgcacactcccccacggcccctcccctcccctgcaacagcagcagcagccttgcgagctcacgggaggcgggcccaggccccagctccctgcattctccccgtattcgcggatcggccctcgcccccggagaggcctgtgggcttttctgtgagtgagaagggcgttcttgaattttttcgagagacgggagggggcgagaggaaaaaggagagcaggagacgttgctgtctttgctgagcgtggctgagctgagcgcctgagcggtgggagggagaggaagtgttcagtgctgcggctgcgagtgggggagcgcatggcgagggcgcgcggcggcggcctcgccgcgtgggcggtggccgtggcggcggcatgggtgctgtgggcggccgcggtggcgggggccaggtcgccggcggggagggtgcaccggcacctcaagcggctcaacaagccggccgtgaagagcatcgagagcccagatggagacatcatcgactgcgtgcatatctcccaccaaccagccttcgaccatcctctcctcaagaaccacacaatacagtttagaccagcctaccaccctgaaggtctatatgatgatgccaagagcagcatacgctccaacaatgccggtgagaagccgatgctccaaatgtggcatcgaaatggcagatgtccggagggcacggtcccaatcaggagaaccaagaaggatgacctgctccgagccagctccatgaggcggtatggcaggaagcgtcatactgttccgaacccactgtctgttgatcctaacatgcttagtgagggtggtcaccaacacgcgatagcgtatgtcgaaggtgataagtactatggtgcaaaggctaccataaatgtgtgggagcccaagattcagcaggctaacgagtttagtctgtcccagctctggatcttagggggttcatttggggaggatctgaacagcatagaggttggttggcaggttagccctgacctctatggagacaacaacactaggttgttcacatattggactagtgatgcatatcaggcaacagggtgctataacatgttgtgctcagggttcattcagatcaacaatgagatcgccatgggggcgagcatcttccccatctcgaactatgcgggctcccagtatgatatcagcatcctgatctggaaggatccaaaggaaggcaactggtggatgcagtttggcaaggagtatgtcttaggctactggccgtccttcctcttctcctatctcgcggacagcgcatcgatgattgagtggggtggtgaggtggtgaattcagagccggatggcacgcacacgtcgacgcagatgggcagcgggcacttccctgaggaagagtttggcaaggcgagctacttcaagaacattcaggtggtggacagcggcaaccagctgagcgccccaaaggggatgggtaccttcaccgagcagtccaactgctacgacgtgcagaacggtaacaatggtgactggggcacctatttctactacggtggccctggcaagaattcaaattgcccatgactactttctagtgtgtagtagaagtgctgtcaccatgcaaaaatgtaaccaagcattcaagtgtgcaatacagctttgatctgcatcttattcagtcctaggtagtgtgtaacatatgtatgtgccctagagcctagagttttttttttgccctttttttcattttttttcatgtgccatgtaaagtttctgaagagaagaagcatggcttgaggtggtggtgctgggctggtgagtgacctctacggtttttttgcaactctgctttttggtcatcttcccc

SEQ ID NO: 11490 - protein, 415 aa, Panicum virgatum
  misc_feature: Ceres CLONE 1744928
  misc_feature: Useful for biocontainment applications
MARARGGGLAAWAVAVAAAWVLWAAAVAGARSPAGRVHRHLKRLNKPAVKSIESPDGDIIDCVHISHQPAFDHPLLKNHTIQFRPAYHPEGLYDDAKSSIRSNNAGEKPMLQMWHRNGRCPEGTVPIRRTKKDDLLRASSMRRYGRKRHTVPNPLSVDPNMLSEGGHQHAIAYVEGDKYYGAKATINVWEPKIQQANEFSLSQLWILGGSFGEDLNSIEVGWQVSPDLYGDNNTRLFTYWTSDAYQATGCYNMLCSGFIQINNEIAMGASIFPISNYAGSQYDISILIWKDPKEGNWWMQFGKEYVLGYWPSFLFSYLADSASMIEWGGEVVNSEPDGTHTSTQMGSGHFPEEEFGKASYFKNIQVVDSGNQLSAPKGMGTFTEQSNCYDVQNGNNGDWGTYFYYGGPGKNSNCP

SEQ ID NO: 11491 - DNA, 2052 bp, Panicum virgatum
  misc_feature: Ceres CLONE 1745878
  misc_feature: Encodes the peptide sequence at SEQ ID NO. 11492
ctcccaactccggccatattgccgggggcggaagaggaggaggacatcgtcagagaggcgccgcggacctcctctccccccccccccccccccgccgctggtgcttcctcagcctgcctgccaatcccaggcctccgccgccatgtcgatccgcaaggsgctgggcgcggtcaaggaccaggccagcatcggcatggcccgggtctcgggcgccgtcaagcccgacctcgacgtcgccatcgtgcgcgccacctcccacgacggcgcgccccccgacgaccgccacgcgcgcgaggtgctccgcctcgccgcggggggstcccagcgcgcctgcgtcgcctccctcgcgcgccgtctcgcgcgcacccgcgactacgtcgtcgccgccaagtgcctcgcgctcctgcaccgcctcgccgccgagggggccccgcacctccgcggsgagctcctccgccccgcccaggctgggaggcgcgccggcgagcccgtcctctcgctgctcctcgacttccgcgacgaggcgcacgccgcgtcctgggaccactccgccttcgtacgggcctacgcgctctacctcgacgagcgcgtccgcttcctcgcctcgctcctccccccgccccgcgtcgtgcgcttcgccgacgactacaccagcggcatcggcggcggcggcggcgcgtccccgaccgcgccggcgtcggtgcgcgacatggaccccgagggcctcctggtccgcgcgcgccagctgcggctgctgctcgaccgcttcctcgcgtgccgccccgcgggcgccgccagggacagccgcgtcgtgctcgccgcactctacccgctgctcaaggagagcttccagctccacgaggacctctccgccgtgctcgccatcctgctcgatcgcttcttcgacatggactaccccgagtgcgtcaaggcgttcgagacctacgtcagcaccgccaggcagatcgacagcctcctcgccttctacgcctggtgcgacgacgtcggcgtcgcgcgatcctccgacttccccgaggtcaagcgcatcgacgagaagctcctcgagacgctcgagcagttcctgcgggagcgcggccaggcaggccgcagctcgccgccgccagttcaggcacaatcggcgccccaatccaccgggcaagcccaagacgacgccgacatgaacagcgtcaaggcgctcccggcgccggagaccacccgatcggtgccggcgaaagcctctgcggctgcggcactggcggccaacaacatgaccagtcaggctgatctggtcgacctcagagaaccggcggacgagcaggagaacaagctcgcgctcgcgctcttctccgcggcgccggcgacgagcagcggcgccgacagcagctgggtcgcgttcccgtcggactcggacgacgctccaccggcggcgacctcggcgtggcagacgccggccgcggagcccgggaaggcggactgggagctggcgctggtggagacggcgagcagcctgtcccggcagacggcgtccctcggcggcgggatggaccctctgctcctgggcgggatgtacgaccagggcgcggtccggcagcaggtggccgcgcaagccgcgtcggggagcgcgagcagcgtggcgctgccggcgcccgggcgcggcgcggcggcggcggccgtgctgatgctgccggcgcccgacggcacggtgaaggcggtcgggggcgacccgttcgcggcgtcgctggcggtgccgccgccgtcgtacgtgcagatggcggagatggagcggaagcagcagctgctggtgcaggagcagcagatgtgggcgcagtaccggcagggcggcatgcgggggcagcccgccgggttcagcgggctcgccgccggcagcgtgttcgcgccgaacaccgccgtggccatgccctacggctacggaatgccggtggcgtacaatcatggttgtgtgaataactgttgtgatgggaagagatttttttccagtgaagcttctacactttcctctccattcatttgtgtatataaagtacatgttac

SEQ ID NO: 11492 - protein, 636 aa, Panicum virgatum
  misc_feature: Ceres CLONE 1745878
  misc_feature (26)..(317): Pfam Name: ANTH Pfam Description: ANTH domain
  misc_feature (6)..(6): Xaa is any aa, unknown, or other
MSIRKXLGAVKDQASIGMARVSGAVKPDLDVAIVRATSHDGAPPDDRHAREVLRLAAGGSQRACVASLARRLARTRDYVVAAKCLALLHRLAAEGAPHLRGELLRPAQAGRRAGEPVLSLLLDFRDEAHAASWDHSAFVRAYALYLDERVRFLASLLPPPRVVRFADDYTSGIGGGGGASPTAPASVRDMDPEGLLVRARQLRLLLDRFLACRPAGAARDSRVVLAALYPLLKESFQLHEDLSAVLAILLDRFFDMDYPECVKAFETYVSTARQIDSLLAFYAWCDDVGVARSSDFPEVKRIDEKLLETLEQFLRERGQAGRSSPPPVQAQSAPQSTGQAQDDADMNSVKALPAPETTRSVPAKASAAAALAANNMTSQADLVDLREPADEQENKLALALFSAAPATSSGADSSWVAFPSDSDDAPPAATSAWQTPAAEPGKADWELALVETASSLSRQTASLGGGMDPLLLGGMYDQGAVRQQVAAQAASGSASSVALPAPGRGAAAAAVLMLPAPDGTVKAVGGDPFAASLAVPPPSYVQMAEMERKQQLLVQEQQMWAQYRQGGMRGQPAGFSGLAAGSVFAPNTAVAMPYGYGMPVAYNHGCVNNCCDGKRFFSSEASTLSSPFICVYKVHV

SEQ ID NO: 11493 - DNA, 1452 bp, Panicum virgatum
  misc_feature: Ceres CLONE 1745904
  misc_feature: Encodes the peptide sequence at SEQ ID NO. 11494
atctcacggccatatccgcctgtatgctccttctccaagatccatccctgcagctaggatccttcaagagttcttctccagaagcctcgatttgtagcaggtcagatccatagctactccaatcatcagaaatggcgagcctgcagagccaggagagtcttgcgagtacattaccgacaaacctaccagcgacctttatgaaggaaattaccgccgattttgcttctgagcgagaacttggccgctctgtatttggaatagcttacaagggtgttcttccagagacagaagggaaccgcatgattgctgtgaagaggcttgctgaaaactcacctgtgccggctggcaaaacatttgaaactgaggttacaaatcttatggcacttaaacacagaaatgtagtagagctggttagcttctgccacgaagcgcagaagaaagtagttcagcataatgggagatatgtgattgtagacgtgatcgaaagctgtctttgctacaaatatctaccaaagggaagtcttgacaagcatctttatgtggacactacgtcactaaactgggacacacggttcaaaataattaaggggatctgcgaaggtttacatttccttcacaaggaattggatgggccccttgttcatatgaaccttgtgcctagctcaatatggttggatgataactgggtgccaaagattgccgattttggtctctcaagactctttggccaagagcagaccaggatgtacacagtcaatgttaagggatataatgggtacatggctccagaatatctatacagaggtgaaatttccaccatgtcagacatatatagtttaggcatgcttattcttgagatcacgactggagagaagaactgtggatattctgaagacagatctgcaagaaactttgttagcaatgtacatcaaaattggaacacaaaagagcaaataatacacaagtacccatcactagattcaaatggcctgcagcaagtaaatgcatgcattgtaattgggctaaagtgtgtggaggctgaacggaacaaaaggccttccatagttgatattgttgataagctcaatgggaaacgtgtaccaatttttgaccaggcctccacttcccaggagcgatgagaaatggtctttccaagttgacatcaatatccaagatgaagtagaacctgctctatgatcagaagatgacatgaattttcttctgaacaaatatctacgtttatatatatatatatatatatatatatatatatatatatatatatattagctcttccttgcaacaacgtaactgccactttacttatctttctaattagatttggcactgtattgttgaagcactcttctctctgttgaccctgtcactgtgaattggtgtggaatcttttgtggtatttcgaattaaatatggacatacgagatcagaatc

SEQ ID NO: 11494 - protein, 335 aa, Panicum virgatum
  misc_feature: Ceres CLONE 1745904
  misc_feature (30)..(318): Pfam Name: Pkinase_Tyr Pfam Description: Protein tyrosine kinase
  misc_feature: SWISSPROT Homolog: EC 2.7.11.1 Non-specific serine/threonine protein kinase
MASLQSQESLASTLPTNLPATFMKEITADFASERELGRSVFGIAYKGVLPETEGNRMIAVKRLAENSPVPAGKTFETEVTNLMALKHRNVVELVSFCHEAQKKVVQHNGRYVIVDVIESCLCYKYLPKGSLDKHLYVDTTSLNWDTRFKIIKGICEGLHFLHKELDGPLVHMNLVPSSIWLDDNWVPKIADFGLSRLFGQEQTRMYTVNVKGYNGYMAPEYLYRGEISTMSDIYSLGMLILEITTGEKNCGYSEDRSARNFVSNVHQNWNTKEQIIHKYPSLDSNGLQQVNACIVIGLKCVEAERNKRPSIVDIVDKLNGKRVPIFDQASTSQER

SEQ ID NO: 11495 - DNA, 1916 bp, Panicum virgatum
  misc_feature: Ceres CLONE 1745990
  misc_feature: Encodes the peptide sequence at SEQ ID NO. 11496
agtgttgtagcccgcctcgctccctccgtcctcagcgagcatggaggtctcagccatggaggaagccctccccaaggcgaggaggaagggaggcctcagaaccatccccttcatcatctcgaacgagatcttcgagaaggtggccacgttcgggctgacagccaacatggtcctctacctcaccgagcggtacctcatgtcgagcgccttcgccgccatcgtgctctacaactggcacgccgtctccaatttcctccccatcttcggcgccgtgctcgccgacgcctgcatcggccgcttccgggtcatcgccctcggctccttcgtcagcctctctgggatgtgcctgctgtggctgacggcgatcctgccggtgtaccagaggaccccggagtgcgcggcgcggctggcggactgcgtggtggtgccgtggcaggtgccgctgctgttcacgtcgttcgcgctcatgtccctcggctcgggcggcatccggccgtgcgcgctggcgttcggggcggaccagctggacaagcgggacaacagcgccaggaacgtgcggacgctgcagaccttcttcaactggtactacacggtgctgggcctctcgatcgtgttcgcggccaccgtcgtcgtctacatccagcaggccaggggctgggtcgtcggcttctccgtgcccgtggtgctcatggtcaccgcgctcgcgctgttcctcctcggctcgcccttctacctcaaggcggcggccgacaggagcgccatcgtcggcttcgtgcaggtgctcgtcgccagctacaagaaccgccacgagcccatgccgccggaggcggccaacgcctcgagcttctacaacaaggccggctccaagcccaggactcccaccgacaagctaaggtacttgaaccgggcctgcgtgcttaggaaccccggcaaggagctgagcgccgacggggcggcgtgcgacccgtggaggctgtgcacggtgcagcaggtggaggacaccaaggccgtcatccgcgtgctgccgatatggtcgacggggatcttgcccggcttgatcgtcgggcagcagatgttcccgacgctgcaggcgaagacgatgcagcggaaggtgggcggcctggagatccccgcggccaccttcggcgtcttcagcatcctgacgctcaccgtctgggtggccgtgtacgaccgcgcgctggtgcggcccctgtcccggctcacgggccacgcgcgcgggctcagcctgcggcagcggatgggcgccggcctggtgctcttcgccgtggccatggccgtggccgcgcgcaccgagagcgtccgccgcgccgccgcgatcgccgaggggctccgcgactccgacccgcgcacggggcccccgatgcacatgtcggccatgcggctggcgccgcagcactgcctgacggggctcgccgaggcgctgaacctgatcgggcagatcgagttctactactccgagttccccaagaccatgtccagcatcgggatgtcgctgctggcgctcggcctcgggttcggcgccctgctgggcagcgccgtcgtcgcgatcatcggcgccgcgacccggagcggcggccacgacgggtggctgccgagcaacctgaacaggggccgctacgactactactacctggtcctggcggtgctgggcacggccaacgtggtgtacttcgtggtgtgcgcctgggcgtacggcgaggagggccagaaccgggtggcggcggccgacgccgctgcggtggaggaggacggcaaaggaggagaggagcagcacaaggcggtgatcatttaggcttttgagctagtatgaacaagcgttgatctgggatggtatctttcagcggtgtaaatcgacgtggtaatatgcgaacatatatatgctaatgtttaagatt

SEQ ID NO: 11496 - protein, 590 aa, Panicum virgatum
  misc_feature: Ceres CLONE 1745990
  misc_feature (87)..(497): Pfam Name: PTR2 Pfam Description: POT family
MEVSAMEEALPKARRKGGLRTIPFIISNEIFEKVATFGLTANMVLYLTERYLMSSAFAAIVLYNWHAVSNFLPIFGAVLADACIGRFRVIALGSFVSLSGMCLLWLTAILPVYQRTPECAARLADCVVVPWQVPLLFTSFALMSLGSGGIRPCALAFGADQLDKRDNSARNVRTLQTFFNWYYTVLGLSIVFAATVVVYIQQARGWVVGFSVPVVLMVTALALFLLGSPFYLKAAADRSAIVGFVQVLVASYKNRHEPMPPEAANASSFYNKAGSKPRTPTDKLRYLNRACVLRNPGKELSADGAACDPWRLCTVQQVEDTKAVIRVLPIWSTGILPGLIVGQQMFPTLQAKTMQRKVGGLEIPAATFGVFSILTLTVWVAVYDRALVRPLSRLTGHARGLSLRQRMGAGLVLFAVAMAVAARTESVRRAAAIAEGLRDSDPRTGPPMHMSAMRLAPQHCLTGLAEALNLIGQIEFYYSEFPKTMSSIGMSLLALGLGFGALLGSAVVAIIGAATRSGGHDGWLPSNLNRGRYDYYYLVLAVLGTANVVYFVVCAWAYGEEGQNRVAAADAAAVEEDGKGGEEQHKAVII

SEQ ID NO: 11497 - DNA, 479 bp, Panicum virgatum
  misc_feature: Ceres CLONE 1746033
  misc_feature: Encodes the peptide sequence at SEQ ID NO. 11498
cgacctccctcatctctcttcgtcccgccgccgcagctcccgtctcgtgctcgtctctcccttcccagaaggatccattgttgctgtatcccccgagttgccatcatgcaaaacgaggagggtaagatggtggacctttacgtccccaggaagtgctctgccacgaacaggatcattactgccaaggaccatgcctcagtccagatcaacattgggcacttggatgagaatgggctgtatgatggccgcttcaccacatttgctctctctggattcgtccgtgctcagggtgatgctgacagttctttggacaggctgtggcagaagaaaagagccgagatcaaacagtagatgaatttacatggaatgtttcggtagaccttgacgtattatatattattagtaaaccttgaagaatttgtaatggatgtttgtcctatataaatatgaatggtcaatggtgggtattgtgaaagtgc

SEQ ID NO: 11498 - protein, 81 aa, Panicum virgatum
  misc_feature: Ceres CLONE 1746033
  misc_feature (1)..(81): Pfam Name: Ribosomal_S21e Pfam Description: Ribosomal protein S21e
MQNEEGKMVDLYVPRKCSATNRIITAKDHASVQINIGHLDENGLYDGRFTTFALSGFVRAQGDADSSLDRLWQKKRAEIKQ

SEQ ID NO: 11499 - DNA, 2453 bp, Panicum virgatum
  misc_feature: Ceres CLONE 1746069
  misc_feature: Encodes the peptide sequence at SEQ ID NO. 11500
accactattcctccatcacccccagctccagctgtgtccccgagctccgacgcagccaagggaatcgtccccaacccaaaccccctcaaattctccgtccgtcgccagcaagtaccacgagcaggggatcccggccccaatgcggctgctcccgctcttcatgctcctcctcgccgccgccgccgccgccagcgcctccgacgaccccttcctctccggcgcggcgaaccacagctacaacatcgactgcggcggcgcggcggacttcacttcgaccttcggccgccgctggctcgccgaccagttcttctcccccggcggggccgcggggatggtcgccgagccgcaccgtttcccgcagccgcaggagcgcacgctccgcttcttcccgccctcgtccgccggcaagtcctcctgctactcgctacccctcccgcccggccgctactacctccgcatcttctccgtctacgacaactacgactccaaggcccggaccccgtccttcgacgtctccgcggccgccacgctcgtgctctccttccgctcgccctggcccgagcccgccgcgcgctacggggcctactccgacctcatcttcccctccgccaccgagcccgcctccgacgtctgcttctactcgctctccaccgacgcgcccgtcgtcgcctccatcgaggtcgcccccgtccacccgctcgcctacgacggcgccaccaccggcgccgacctcgtcctcgtcaactacggccgcgtcacctgcgggaacagcctcttcggccctggcttcaccaaggaccccgacgccttcgcacgggtgtggcaggcggacgtcgatttcaggaacaacgacctcaagtacgacgccattactgccggcgggaggaagattttcggcagcaatcagccgcccaactacttcccaaccaagctgtacgagtcggcggtcaccacgggcagcgacgccagcaatgagatcgagtacctcatgccggtggacgcgagactgtcctacatggtctggctgcatttcgcggagatcgacgcggggatgggggcggctggacagcgggtgttcgacgtaatgctggcgggggagaatgtcacgaggatcgacatcttcaagcaggtcggagggttcacggccttcaagtggacctacgttgtggagaatctgacgagctccacgttgaccgtcaagcttgtgcctgtggtgggacggccgattctctgcgggctcgagaattatgcgatggtgccacttgagatgagaaccgtgccaagccaagtggctgcaatgaaggcactgaaggagtcgctcaaaattcctgcaaggatgggctggaatggtgacccatgtgctccaagggcgtgggatgcatgggagggagtcacttgccatcgcggtgataaagaacttgtgatcacccaactggatctggcaagtcaagggctaaaaggtttcatcacagatgaaataagtcatctcaaagacttggtaagcttgaacttgagctacaattcactgacaggaagcttaccacctggtttaggccaaccttcacttgtgtcactggatctgtcatcgaatgagtttactggaagcattcctggcaccataggttcgtccaaattacaaactgctttactaaacaacaatcaactcgatgggcaagttccagaaagactttactcgattggcgtacatggtggtgtcatagatctctctggtaacaaaggtctctgtggtgtgcctacattgcctgcttgtgcattattctgggagaaaggagggttgaacaaaactggcaaaattgcacttggagcatcattcgggtttgttcttcttgtcatacttatagtggtctacattctgtgcatcagaaggggcccatatgactatgactttgagttccctcaagatttgacttccatatcggcaatctcagcaaaaaggaatagataccagagggcaaagtccgtgatgcttgctgagatggaggcacatagtccggatggtttctacacaaacgggagcccacactgaatgacatgcgctggaaatggtctcactcacggatcgccgtatttattattgaggaaacactcatggctgttgctggcgtgatacagggatatttggttctggatggcgtccatactgctttcgtcagctccctccatggcagttacactcactgctaggctattcgaaatgtagcatatatgcatgtgtaatatgaggccgttgttgtagcttctgtagcgcagcaattctttttgtggatgctcaactctttgctggaggagcctccggatagtttagcttaggcaatgtgcactgagcgaatcatgtaaaaggcgccaggagtccccaggactgggacaggttgttgtagcgttgtgacatgggttatggggactaatagtgaatggagtattcgtttttgtac

SEQ ID NO: 11500 - protein, 635 aa, Panicum virgatum
  misc_feature: Ceres CLONE 1746069
  misc_feature: SWISSPROT Homolog: EC 2.7.11.1 Non-specific serine/threonine protein kinase
MRLLPLFMLLLAAAAAASASDDPFLSGAANHSYNIDCGGAADFTSTFGRRWLADQFFSPGGAAGMVAEPHRFPQPQERTLRFFPPSSAGKSSCYSLPLPPGRYYLRIFSVYDNYDSKARTPSFDVSAAATLVLSFRSPWPEPAARYGAYSDLIFPSATEPASDVCFYSLSTDAPVVASIEVAPVHPLAYDGATTGADLVLVNYGRVTCGNSLFGPGFTKDPDAFARVWQADVDFRNNDLKYDAITAGGRKIFGSNQPPNYFPTKLYESAVTTGSDASNEIEYLMPVDARLSYMVWLHFAEIDAGMGAAGQRVFDVMLAGENVTRIDIFKQVGGFTAFKWTYVVENLTSSTLTVKLVPVVGRPILCGLENYAMVPLEMRTVPSQVAAMKALKESLKIPARMGWNGDPCAPRAWDAWEGVTCHRGDKELVITQLDLASQGLKGFITDEISHLKDLVSLNLSYNSLTGSLPPGLGQPSLVSLDLSSNEFTGSIPGTIGSSKLQTALLNNNQLDGQVPERLYSIGVHGGVIDLSGNKGLCGVPTLPACALFWEKGGLNKTGKIALGASFGFVLLVILIVVYILCIRRGPYDYDFEFPQDLTSISAISAKRNRYQRAKSVMLAEMEAHSPDGFYTNGSPH

SEQ ID NO: 11501 - DNA, 1766 bp, Panicum virgatum
  misc_feature: Ceres CLONE 1746074
  misc_feature: Encodes the peptide sequence at SEQ ID NO. 11502
aaaccactacatcaccatttgtttctatctaacattttgggagcactgagctcttccagcttgcagggacggagtcttcatcaaagctctttcttcaccacaggcagcaatggcgccggcaaatggtgatgctgccggaccaagctccagccaggatggcttggtagccaccatgaagaagcgcaacaagcctcagtatcatccgtttactcagcagcagcttccagcttgcaagcctatactggcgcctcagacagttatccctgtacttttgtttgtgggcatagtttttatcccgattggccttggttgcattgcagcatcaaatagggttgttgaagtgatctatcaatatgaaacttcatgtgtaccacgatacatgattgacaacgaaattgcctatatccaaaatccttctatagataagacctgcacaaggattctcaaggttcctaaggatatgaagcaaccaatctacatatattatcaactcaacaagttttaccagaaccatagaaggtatctgacgagccgcagcgataaacagttgcgaagtcctaatgaggtcaacaacagacagtcatgcaaacctgaagctactgagcatggaagccccgtcgtcccctgcggactcgtagcttggagcctgttcaacgacacgtacagcttcgctcgtggcaatgaggtgctgatggttcacaagcgaggcatttcatggaggaacgaaagggaggacatttttgggaagcaggtgtttccgaggaattttcagaatgggactctgattggtgggggcacgcttgacccaagaatacctctgagcaggcaggaagacctgatcgtctggatgcgaaccgcggcgctgccaacgttccggaagctgtacgggaggatcgaggcggacctccacgccgacgagctgatcacggtgactctgcagaacaactacaacacgtacagcttcggcgggaagaagacgctggtgctgtcgaccgccggcgtgctgggaggcaagaacgacttcctcggccgcgggtacgtgatcgtcggcctcgcctgcctcgcgctggcgatgctcctgacgctgctctgcctcgcctccccactgagagaggagcatcttgcgctgcggtaccctctgtccggcagacctgcacgatagataaccacgcatgcctgattcatgtagtgttcatgtacagattgaagccgtttctttttcaggcttggattcggttggcggttccttgcaaggatcgaaagaagaacagcagctacagacagagctgcgtcgtgtatatatgcatccgacaggattgaaattgatttgcttccggtatattcagacatgttggttgtaggggtgggtatcaagctggctcggctcggctcggctcgttagtagcttaagtcagctcggctcgttagtagctcacgagctggagggggcccgcatgaggcatgagctcgcgctgccggggcccggggtccaatgcccatggtgaagcacaaattttagcaaaattcagaatatacaacaaccaaaagaatgaaattccagtccgagaagcacaccacacgagctgaatctgacaaaaaaaaagaatcttccgttggatcttgcgagtgaaacaagaacaaagattgagcagattcagatgcatcaatcaagcagtacacggattcaatcaacacatgttttgtgtttcgagagacagagaaaggaaaaaaatatactactaaattgctgtctcgttaccgatctg

SEQ ID NO: 11502 - protein, 350 aa, Panicum virgatum
  misc_feature: Ceres CLONE 1746074
  misc_feature (68)..(339): Pfam Name: CDC50 Pfam Description: LEM3 (ligand-effect modulator 3) family / CDC50 family
  misc_feature: Useful for making plants with modulated nitrogen use efficiency
MAPANGDAAGPSSSQDGLVATMKKRNKPQYHPFTQQQLPACKPILAPQTVIPVLLFVGIVFIPIGLGCIAASNRVVEVIYQYETSCVPRYMIDNEIAYIQNPSIDKTCTRILKVPKDMKQPIYIYYQLNKFYQNHRRYLTSRSDKQLRSPNEVNNRQSCKPEATEHGSPVVPCGLVAWSLFNDTYSFARGNEVLMVHKRGISWRNEREDIFGKQVFPRNFQNGTLIGGGTLDPRIPLSRQEDLIVWMRTAALPTFRKLYGRIEADLHADELITVTLQNNYNTYSFGGKKTLVLSTAGVLGGKNDFLGRGYVIVGLACLALAMLLTLLCLASPLREEHLALRYPLSGRPAR

SEQ ID NO: 11503 - DNA, 2515 bp, Panicum virgatum
  misc_feature: Ceres CLONE 1746075
  misc_feature: Encodes the peptide sequence at SEQ ID NO. 11504
acccgcaaagccaccgccgcacggcgactcctccctcctcacctgctcctccccatctctcagttcgaggcgggcgcccctcgtcgccggcgacgaccgaagcggcgcccgtagcatcgcacctccggcgccggcgagcgcgcccgcccggcggaggcggcggccgagatggcgatgcggcacctcatcacgggccagaacagctgcgccccggacggcgcctcgtcgtccaaccccctcaacgccttcgccaacgccgtcctcggccagtcctccaagacgcagtccattaaggaacttcctggctcagtcagtgttccatctacatctgattttggcacagctcctcccttgtcaacaatccctggttcagagaatgagttcaaacaagatcagcgaccccttgcacggggtgccgacttcattcatgggggtcctgctaatgattggattgaatcttttcgccctccaggggttcctgaatttggaggagcagaatcacaatatgcagaatttgaccaaatctataacaatgcagggacaaccatcagaccacccttggatggtccaccacaaagggtgttgtctggtgtcttgcattcttttcttgcaagtagcagagcaggcgtgccgtttcaacctgttccagtaccagctcttggtttatctgaaagcgacaaacaatgcatacgtgatcgtagctgcataatggcacggcatattctggctgaccaaccagaggaatatatacaggctcagatcaatactttgttgcattctcttgatattgacaaccgaatgagaggccctatgcatggacagtacccagagctggagcagtactggaatcagtcccaaagttctatgggacctgcctcgatgcataatgctgcagataaatggattaccgagtttggcaatcaaaataataacccagaaagctgggcaaattcttttgagcagcaatatggcccaaatggttgggcctctgagtttgaacagatggccatgggtcagatgggaggagcgaacatggctaacctggctgctatggagcaatctcgtatgcttgcacaaacattagcaagtaataacgaccccaagtttcagctttcacaaggggcggataaatgggctagcgagttcgctagtgaacataatcagggtgcgttaaatgataactgggttgacgagttttcaaaattaaatgttactgatgaatgggcagaagaattcagtggtggtggtgttggcgaaagctcggcagatccatgggcagatgagttccaagaacagttgtcatccttcaaacaaagcttgagtacttctcgaggggtttatgtcttttctgagatgaacccgtatgttggtcaccctaatccaatgcaagaaggacaagagctcttccgcaagggcctcttaagtgaagctgttcttgctttagaggctgaagttttgaagaatcctgataatgctgaaggttggaggttgctaggagtaacacatgcagaaaatgatgatgaccaacaggccatcgcagcaatgatgcgtgcgcacgaagctaatcctacaaaccttgaggttcttctcgctttaggtgtcagtcacacaaacgaattggagcagggagaagcattaagatatctttataggtggcttcagaatcatccaaaatatgggggccttgcccctccacaggcgactgattcaccttatggtccagatgttgttagattgtttaatgaagctgctcagatgtcacctgaagatgcagacgttcatatagttctgggagtcttatacaacctctcaagagagtatgataaagctatagcttcatttaagacagcactgcagctcaaacctcaggactattcactctggaataagcttggtgcaacccaagcaaacagcatccagagtgctgatgcaatattggcgtatcagaaggctctagacttgaaaccgaactatgtccgtgcatgggctaatatgggaatcagctatgccaaccagggtttgtacgaagattctattcgatactatgtaagagtagttgtgatgaatccgaaagctgacaatgcctggcagtacttgaggatttctctcagcaatgcgtcacgagctgacatgattgctgcatgcgatgcccgcaacctcgatgctcttcagaaattgtttcctctctgagtcccggtcctgaacatcagctgttgagcagatcctcatccagcaaggaagccgcaaattagcaaggcgcatgctatcattggctgcactcatggaaatggaattcggaatccaggagccttttgttcttctgattcttctatttaacaagcttggagtgtacagtggggaacagcacccgattgtagatgtgaaataccatggcaaaaggcaatggtggcaaaggggagaacatttgtagttacacacgggtggcacagcaggaataaaagaatgatttgaataaaaaaatatttatttcgaggatgataccctctgcttgttc

SEQ ID NO: 11504 - protein, 673 aa, Panicum virgatum
  misc_feature: Ceres CLONE 1746075
  misc_feature (535)..(568): Pfam Name: TPR_1 Pfam Description: Tetratricopeptide repeat
  misc_feature (603)..(636): Pfam Name: TPR_1 Pfam Description: Tetratricopeptide repeat
  misc_feature (436)..(469): Pfam Name: TPR_2 Pfam Description: Tetratricopeptide repeat
MAMRHLITGQNSCAPDGASSSNPLNAFANAVLGQSSKTQSIKELPGSVSVPSTSDFGTAPPLSTIPGSENEFKQDQRPLARGADFIHGGPANDWIESFRPPGVPEFGGAESQYAEFDQIYNNAGTTIRPPLDGPPQRVLSGVLHSFLASSRAGVPFQPVPVPALGLSESDKQCIRDRSCIMARHILADQPEEYIQAQINTLLHSLDIDNRMRGPMHGQYPELEQYWNQSQSSMGPASMHNAADKWITEFGNQNNNPESWANSFEQQYGPNGWASEFEQMAMGQMGGANMANLAAMEQSRMLAQTLASNNDPKFQLSQGADKWASEFASEHNQGALNDNWVDEFSKLNVTDEWAEEFSGGGVGESSADPWADEFQEQLSSFKQSLSTSRGVYVFSEMNPYVGHPNPMQEGQELFRKGLLSEAVLALEAEVLKNPDNAEGWRLLGVTHAENDDDQQAIAAMMRAHEANPTNLEVLLALGVSHTNELEQGEALRYLYRWLQNHPKYGGLAPPQATDSPYGPDVVRLFNEAAQMSPEDADVHIVLGVLYNLSREYDKAIASFKTALQLKPQDYSLWNKLGATQANSIQSADAILAYQKALDLKPNYVRAWANMGISYANQGLYEDSIRYYVRVVVMNPKADNAWQYLRISLSNASRADMIAACDARNLDALQKLFPL

SEQ ID NO: 11505 - DNA, 2201 bp, Panicum virgatum
  misc_feature: Ceres CLONE 1746089
  misc_feature: Encodes the peptide sequence at SEQ ID NO. 11506
gtttcacgttccacaacacttggcgccgaaaatttcttggcgccgttcaccagccgcccgctggttacgtcgcgtgagctcgcccaccgattaaccaagcgcaaacagccacgttccccggcgacgaggacccaaccatcatccccatcgcacgcagccacaccgcgccggcgcaccagtccgcgagctgaggactcagccaacgaacccaggcctcgcgaatgcggcgcgccgaggtggccgtggtgggcgcgggcgcggcggggctggtggcggcgcgcgagctgctccgcgagggccacggcgtggccgtcttcgagaagtccggccgcgcggggggcacctgggcgtacgacccgcgcgcggacgccgacccgctgagccgcgacccgggcgcgcccggcgccgtccacggcagcctctacgcgtcgctgcgcaccaacctgccgcgcgagctcatgggcttctcgggcttccccctggccggccgcgtcttcgcgggcgacgcgcgcgcgttcccgggccaccgggaggtgctcgccttcctcgacgccttcgccgaggagtcagacgtcgccgcgcgcgtcatgctccgagcggaggtgctgcgggtgcggccgctcggcgaggggcagggggagcggtgggcggtggcgtggcgcggggaggacggagaggtcgcggaggaggtgttcgacgccgtcgtcgtctgcagcggccactgcacggtgcctctggtgccccagatccgaggaatcgacaagtggctggggaagcaaatgcacagccacaactatcgcgttccagaaccatttcgcgatcaggtgctttcctttcctctgtctcttgtttcttgcaggctggaggcgaaagtccgggcggttgagatggctagcccggcccggtagcgtcgcgctcccagcaggtcatgagttcgaatctcatttgaagcgaatttcaggctgctgggagaaaaaaaaacccctcgctgtgctcgccgcaagatttggtcctctcgggcataggccagggttcggggggtttctctacccggttagctggttaggcttcctcttaatgaaaaaacgatggggttcgtttctcatccccgggtagagtttttttttcttgcaggctggagtacttgactgttaccagtctgatacacccgcgctgcgcagagtgttgttgttgtaggactgggagccagcggaatcgacatcatcgctagagagatctcacatgtggccaaggaagtccacatcgcggctaggtactcggaggacaggcttggaaagattgaactctaccagaacgtctggatgcacgcagagatagattgcatccaagacgatggccgagtgcgatttgctgaaggttcagcagtggctgcagacaccattctttactgcacaggatatcgctaccatttcccgttcctggacctggatgggctcgccgtcgacgacaaccgcgtcgggccgctgtacgggcacgtcttcccgcccaagtacgcgccgagcctctccttcgtcggggtgccatccaagaccctcatcttccaggcgctggagctggaatccaagtgggtcgccgccgccctgtcggggcgcgccgcgctgccgggcgaggagggcatgatggccgccgtgcgggagggctaccggcggatggaggcggccggcaggcccaagcgccacacgcacgcgctgtggcctgaatgggtggagtacatgaactggctggcagaccaggtgggcgagccgcacctggaggcgcggcgtaaggaggtgtacgagagggcgctcaggtgcatctggtcactggacgacaggtacagagaccgatgggaggaggaagaggaacagaatggcggcgactgtggcaccgtagaggtcgatacgccgaagcatcacggtatcgtagtgattcctcctctagttgacgagtgatgagcagtaatctaccgggaaacaatttctcgtttgaaatatttccaagaaaagtaactgtcgctacactggaacggatctatcatccatactagaaaagcccgtggctttgccgcgtgggacctatataataattatggtatctaagtaaatgtatttttttagaaaaaaacaacggtggtaagacaaatttgttgcttcgttatttttgcatggtgtcatagtcggcaactagttgtaactcttggt

SEQ ID NO: 11506 - protein, 228 aa, Panicum virgatum
  misc_feature: Ceres CLONE 1746089
  misc_feature: SWISSPROT Homolog: EC 1.14.13.8 Flavin-containing monooxygenase
MRRAEVAVVGAGAAGLVAARELLREGHGVAVFEKSGRAGGTWAYDPRADADPLSRDPGAPGAVHGSLYASLRTNLPRELMGFSGFPLAGRVFAGDARAFPGHREVLAFLDAFAEESDVAARVMLRAEVLRVRPLGEGQGERWAVAWRGEDGEVAEEVFDAVVVCSGHCTVPLVPQIRGIDKWLGKQMHSHNYRVPEPFRDQVLSFPLSLVSCRLEAKVRAVEMASPAR

SEQ ID NO: 11507 - DNA, 1287 bp, Panicum virgatum
  misc_feature: Ceres CLONE 1746093
  misc_feature: Encodes the peptide sequence at SEQ ID NO. 11508
agatcacagctgtgcttgttggtttggtgatccgccccttgtcggctcggctcctttcagctccgagctctgggacagggaggtctgcgctgtcgcccgcctcggctcccttttgtgttgtgcgcctaggggcactgagcagtgagctcctttcctccccggcctttgttgccccccttcttgctgtatctggcttgcaagatccgatctttcctgccccctttggccaaagatctatcgctcgggtggttcgtgcagatcgctgggaggatgcagcacgacctgaagaagaagggaccttcagaaatggattttttcacggaatatggtgagggcagcaggtacaagatagaagaggtcatagggaaagggagctacggtgtggtttgctctgcgatggacacccatactggcgaaaaggttgctataaagaagataaatgacatcttcgagcatgtgtctgatgcgacaaggatactccgcgagatcaagttgcttagactactgcgacatccagatattgtggaaataaaacatattctacttcctccatcaaggagagaattcagggatatatatgtagtttttgaactcatggagtctgatttgcaccaagttataaaggctaatgatgacttgaccccagagcactatcagtttttcttgtatcagttgcttcgaggattgaaatacatacatacagcaaatgtatttcatcgagatctgaaaccaaaaaatattctggcaaatgctgattgcaagctcaaaatatgtgacttcggcctggccagagtagctttcaacgatactccaactgccatcttttggacagattatgttgcaactaggtggtaccgagcacctgagctgtgtggatcttttttctccaagtatacaccagcaatagatatatggagtattggctgtatatttgcagaactattaactggaaaacctcttttccctgggaaaaatgttgtacatcaactcgatataattacagatctcctgggaacaccttctccagaagcaatatctaggattcgaaatgagaaggctaggcgctacttgagcagtatgaggcggaaaaagcctataccgttcacacagaagttcccaaatgcggatccacttgcactaaatttgctggagcgaatgctagcttttgagccaaaagacaggccaagtgctgaagaggctcttgcttatccttatttcaagaatatagccaatgtggatagggagccttctgcacaggctgtcacaaagcttgaatttgagtttgag

SEQ ID NO: 11508 - protein, 338 aa, Panicum virgatum
  misc_feature: Ceres CLONE 1746093
  misc_feature (25)..(316): Pfam Name: Pkinase Pfam Description: Protein kinase domain
  misc_feature: SWISSPROT Homolog: EC 2.7.11.24 Mitogen-activated protein kinase
  misc_feature: Useful for making plants with altered cell wall content and/or composition
MQHDLKKKGPSEMDFFTEYGEGSRYKIEEVIGKGSYGVVCSAMDTHTGEKVAIKKINDIFEHVSDATRILREIKLLRLLRHPDIVEIKHILLPPSRREFRDIYVVFELMESDLHQVIKANDDLTPEHYQFFLYQLLRGLKYIHTANVFHRDLKPKNILANADCKLKICDFGLARVAFNDTPTAIFWTDYVATRWYRAPELCGSFFSKYTPAIDIWSIGCIFAELLTGKPLFPGKNVVHQLDIITDLLGTPSPEAISRIRNEKARRYLSSMRRKKPIPFTQKFPNADPLALNLLERMLAFEPKDRPSAEEALAYPYFKNIANVDREPSAQAVTKLEFEF

SEQ ID NO: 11509 - DNA, 600 bp, Panicum virgatum
  misc_feature: Ceres CLONE 1746093-R
  misc_feature: Encodes the peptide sequence at SEQ ID NO. 11510
tgttgtctattcggataaccgacaacaaagcacagccaacatcacggaggatctttccaagtgtttaatcagagaaaatacacaaaagacacagcaacattctgcttcagttgctgcaaataaatttccactccatgttactcatggtgctgccacgagacctggtaaagcagttggttcagtgctgcagtacaaccctggtccagcatctgctgctgaacagtatgaccaacgaagggtcgctaggcacccagcaattgcccccaacaatatcccttctggaagctcataccctagaagaaatcagacctgcaagggcgagacaggtgatccagaaaggatggacgtgaatcaagctggacagccaaagccatacgcagcaaacaagttacctgctaccgtcgatggtcgcggtggccactggtagatttccactgtgcaccagcaaactatttcctgacatgctataagcatcagttacttatgctaagtgctacatcattctgacaaattcagaaatgtagtcctgtacagatttgtattctttgtcctgatgcctaaattctgaaagatcgtagaactaaaagattctctaaattc

SEQ ID NO: 11510 - protein, 141 aa, Panicum virgatum
  misc_feature: Ceres CLONE 1746093-R
  misc_feature: SWISSPROT Homolog: EC 2.7.11.24 Mitogen-activated protein kinase
VVYSDNRQQSTANITEDLSKCLIRENTQKTQQHSASVAANKFPLHVTHGAATRPGKAVGSVLQYNPGPASAAEQYDQRRVARHPAIAPNNIPSGSSYPRRNQTCKGETGDPERMDVNQAGQPKPYAANKLPATVDGRGGHW

SEQ ID NO: 11511 - DNA, 621 bp, Panicum virgatum
  misc_feature: Ceres CLONE 1746134-R
  misc_feature: Encodes the peptide sequence at SEQ ID NO. 11512
taatgactaattcccagtgttgctatgtgtaataacttttctttatcttctgttagatggagctccctgagtgggttgacattgtgaagactgcgaggttcaaggagctccctccttatgaccctgactggtactacaccagggctgcctcaattgcaaggaagatctacctcaggcaaggcattggggtgggtggattccagaagatctatggtggccgccagaggaacggctcccgcccaccacacttctgcaagagcagtggtgccatttcacgcaacatcctgcagcagttgcagaagatgggcatcattgatgttgaccccaagggtgggcggctcatcacctcccagggtaggcgtgatcttgaccaagtggctggaagagttgctgttgacgcatgagcatctcagcgttctgttttgatgatgtccgtgtttgatggttaagatggctacactttatttgcagttttgaactaggacttgccctgccttgctggttcagagaatttaagatttaatgcatctagttatggaactgcactatgttttccccaagtacctaatgcagtattggaactcgttctggaatgaaacaaaggaattgtgcttgtgatgt

SEQ ID NO: 11512 - protein, 115 aa, Panicum virgatum
  misc_feature: Ceres CLONE 1746134-R
  misc_feature (1)..(115): Pfam Name: Ribosomal_S19e Pfam Description: Ribosomal protein S19e
MELPEWVDIVKTARFKELPPYDPDWYYTRAASIARKIYLRQGIGVGGFQKIYGGRQRNGSRPPHFCKSSGAISRNILQQLQKMGIIDVDPKGGRLITSQGRRDLDQVAGRVAVDA

SEQ ID NO: 11513 - DNA, 725 bp, Panicum virgatum
  misc_feature: Ceres CLONE 1746134
gacaaaaccctagcccccagcagccgcagcggccaccacttcgcgtcccctgtctccctctcgtcacccgtcggcggcggcggcagcggcaggatggcggcttcgacggcgaggacggtgaaggatgtcaacccgcacgagttcgtcaaggcctactccgcccacctcaagcgctccggcaaggtaatgccccgcctgactcgcctttcctttccgatccggcgctgcagtccgtagagtggtcgcgccctccgtcggcgctagtggccacatcttgccccatgctgtacctagctccggatcccgccgtcgcagcacgggttcggtcgcgcacggcaaccgctctccactgctcgcggcgttggcggccgtgacccggcgcctagtctctggttttggaggaaaagcggtcttcacagatttgcttgattagatgtaggggataacttgtttgggattggtagggtttggagtaagaaatgaactgaatcattagttgtactgctggaagggaaccactagcatcttcagttgtctacacttcaatgattgtatgtcttttcgaattaagtacacacacaagttagtctttgtcatactatctgctatagctctgtggaaatgatgctctcgttggtctttttgaccaacgaggaaggtaaatggtctttgttgctgtggttatttggtttatgcctatgtagattgtaaaagttagtcttgag

SEQ ID NO: 11514 - DNA, 764 bp, Panicum virgatum
  misc_feature: Ceres CLONE 1746144
  misc_feature: Encodes the peptide sequence at SEQ ID NO. 11515
atcctcgtcagctttgatcatctctgctccgtggtggccgccatggcgtcgcccatgctctccgccgccaccgtcccgctccagggcgccgccggcctctgcgagttctccgggctcaggagctccgcgtcgctgccgctgcgccggagcaatgccgcctccgacgacttcatgtccgccgtctccttccggacccacgcggtcggcacgagcagcggcgggccgcggcgggcgccggtggaggcgaagctcaaggtggcgatcaacgggttcggccgcatcgggcgcaacttcctgcggtgctggcacgggcgcgacgactcgccgctggacgtcatcgccatcaacgacacggggggcgtcaagcaggcgtcgcacctgctcaagtacgactcgacgctcggcatcttcgacgccgacgtgaggcccgagggcgacagcgccatctccgtcgacggcaaggtcatcaaggtcgtgtccgaccgcaaccccagcaacctgccgtggggggagctcggcatcgacctcgtcatcgaggggacgggggtcttcgtcgaccgcgagggcgccgggaagcagagtcgtattgttgtcttgcctttatccatccaaatcgcgagaaattccccgtcaccatgaagctccggttgcgatcgatggaggcgcgcggcggcggtcgcgccgccgtcgagacccaccgcgtggatctgccgcccacggccacgctgccctacgtgaaggccctcctcgccgccaagctctcc

SEQ ID NO: 11515 - protein, 198 aa, Panicum virgatum
  misc_feature: Ceres CLONE 1746144
  misc_feature (70)..(195): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MASPMLSAATVPLQGAAGLCEFSGLRSSASLPLRRSNAASDDFMSAVSFRTHAVGTSSGGPRRAPVEAKLKVAINGFGRIGRNFLRCWHGRDDSPLDVIAINDTGGVKQASHLLKYDSTLGIFDADVRPEGDSAISVDGKVIKVVSDRNPSNLPWGELGIDLVIEGTGVFVDREGAGKQSRIVVLPLSIQIARNSPSP

SEQ ID NO: 11516 - DNA, 616 bp, Panicum virgatum
  misc_feature: Ceres CLONE 1746144-R
atcttttacctggggatgatcttgcaagggttgagtgcacttgcaaggaaatgaggaatcttgcagcagatgatagtctttgggagaagtttatagcgaagtacaaaaattatggtgagggttctagaggggccatgagcgcgaaggccatgtttggagaagcttggctggccaataagaggcggcagaagaggccccatccaaccttttggaactatggctggggaaacaatccttatagccgtccacttaggcagccattgattggtggggactcagacagactgccttttattggtaatcacggttctgttgggcgtaactttggaaatcaacgaaggaacattgtgccgaactgcattcttgatggtcaccgccataacttcctttgaagtttctttgggttttcttgtatgccaagagtattttgtaagaaggggtgcatagacggatagaccgtcttgttaatatcttcaagttgcacacttatccatgcgcagagcacccttatccttatatatccttttagtatcttagatcctgtcttttctgtttttgtttttatgataccgatgtaacccatgctctagtaataaagtacccttgttctactgtc

SEQ ID NO: 11517 - DNA, 1453 bp, Panicum virgatum
  misc_feature: Ceres CLONE 1746163
  misc_feature: Encodes the peptide sequence at SEQ ID NO. 11518
aacacgagcgagataattatcgtctacccgatccgcctccaaccttcccttctccaagcagagcaaccctcacagcggcgagcatcacactgggacgggatgggaagcgcgggagcgctgctctcgcacccgcggcctcagctgcaccctggcggcgtcctcatcagccagagccggcctctccggagcgcgcgcaacctgcccctattgtctctcactgccgcggcgcctggattccagcgcggcggccgccgccgccgcctctgctgcgctgctgtcaacggggaaggcggacaacgggaggcggggccaccgccgcagatggagaagtctccatccagcggtctcggcgccgcactcgaggacccgcctccaggacctccagtggaaaatggttcctttggaagcctctcacaagaacaagaacagagtcctctgtataattttctttatccaagcaaagagttacttcctgatgacaaggacatgagtatatttgatcatctagaggagcttcgtgagaggatattcatctcagttttggctgttggagctgcaatacttggctgttttgctttctcgaaagatttgattctgcttctagaggcaccagtgtctgttcagggtgttcggtttttgcagctctcccctggggaatttttctttacaacattaaaggtctctggttattgtggccttttacttggaagtcctatcattttgtatgagatcattgcatttgttctcccaggtttaacaagggatgagcgcaaatttctagggcctattgttttgggttcttctgttctattctaccttggcattttcttctcctacacagttcttagccctgctgcattgaacttcttcgtgaactatgcagatggggcagtggaatcgttgtggtcaatagaccagtactttgaattcatacttgtgcttatgttcagcacaggattatcctttcaggtaccagttatccagctattgctggggcaagttggattggtttctggtgaccaaatgctttcaatctggagatatgttgttgttggtgccgttgttgctgctgccgtgcttacaccctcaacagatccattgacacagatgctgttggcaggtcctctgctaggtttgtacttgggtggtgcatggatggtcaagttaattgggcgataagtggtccatgtatgaggatcgttgttcatgagtgtagctgcatgataggtgaggtgcttctgcagaaagcaagagtccccacgccctacagtcactgacagtggcatataagggatttagggatttagggtttaactagtggcatgtgagggatttctccttgtattattaaaaatgattggacgctcctggctctccagatcattgtgttgccatttcagtttctaaagttcaagatcagaaatggagttaattattttcgtgtacataaagc

SEQ ID NO: 11518 - protein, 359 aa, Panicum virgatum
  misc_feature: Ceres CLONE 1746163
  misc_feature (141)..(342): Pfam Name: TatC Pfam Description: Sec-independent protein translocase protein (TatC)
MGSAGALLSHPRPQLHPGGVLISQSRPLRSARNLPLLSLTAAAPGFQRGGRRRRLCCAAVNGEGGQREAGPPPQMEKSPSSGLGAALEDPPPGPPVENGSFGSLSQEQEQSPLYNFLYPSKELLPDDKDMSIFDHLEELRERIFISVLAVGAAILGCFAFSKDLILLLEAPVSVQGVRFLQLSPGEFFFTTLKVSGYCGLLLGSPIILYEIIAFVLPGLTRDERKFLGPIVLGSSVLFYLGIFFSYTVLSPAALNFFVNYADGAVESLWSIDQYFEFILVLMFSTGLSFQVPVIQLLLGQVGLVSGDQMLSIWRYVVVGAVVAAAVLTPSTDPLTQMLLAGPLLGLYLGGAWMVKLIGR

SEQ ID NO: 11519 - DNA, 1555 bp, Panicum virgatum
  misc_feature: Ceres CLONE 1746206
  misc_feature: Encodes the peptide sequence at SEQ ID NO. 11520
tcggctcggctccactgctccctgctgctcctccgtccccatccctgagacccaggccagaccaggcatgccgcgcacggcggcggctgcggcgccccccgcgcggaaggtgcccctccgcaagctgctgcgcgcggcgtcggtggcctgcggggtgcagttcggctgggcgctgcagctgtcgctgctcaccccctacgtgcaggagctcggcatcccgcacgccttcgccagcctcgtctggctctgcggcccgctctccggcctcctcgtccagcccctcgtcggccacctctccgaccgcatcgccccggccgcctccccgctcggccgccgcaggcccttcatcgccgccggcgccgcctccatcgccgccgccgtcctcaccgtcggattctccgccacgaaggcggaggcggccagggcgggagggggcggcgcgcggccgagcctggccgagcggctgcggctggggagcctcctggaggacgggctctcgtacaaggagagcttcatcgtgcgctgctacgaggtgggcatcaacaagacggccaccgtcgagaccatcgccaacctcctccaggaggtaggatgtaaccatgcccaaagcgttgggttctccactgatggttttgccacgaccactacaatgagaaaactcggacttatttgggtgacgaaccgaatgcacattgagatctacaagtaccctgcttggggtgatgttgttgagattgaaacctggtgccaagaagatggaagaatcggcactcgtcgtgattggatcctcaaggacctggctaatggtgaagttattggcagagctactagcaagtgggtcatgatgaaccaaaatacacggagacttcagcgagttagtgatgatgtgagggatgaggtgtttatacactgtccaaagactccaagattagcattcccagaggaaaataatggcagtttgaagaagattccaattctttcagatcctgcacaatactcaagactaggactagtgccaagaagagctgatctggacatgaaccaacatgtcaataatgttacctacattggttgggtccttgaaagcatacctcaagatataattgatacgcacgagttgcaaaccatcactcttgactacagaagagagtgccaacacgatgacatagttgattcacttacttacatagaggaaggagaggagaaaagcatgaacggttctgcttcttcaacacaacacaaagaagagcggcagcagttcctgcactgcttgagatttgccgggaacggggatgagatcaaccgtgggcgcactgtgtgaaggaagctagctagataaaaatggttgagtgttctgttgtttgctccattttgcttatcgcggctggcctagcgtcctttcagaatcaaagtaccacaattttgtgatggttttgttaccatttgggccgtatcatgtaactgtgccgatttgtgacattcgttggagcctgtaactgtccgttttgtaccagtggacaatgtttcgtgatgcaataaccagtgtttctccagc

SEQ ID NO: 11520 - protein, 417 aa, Panicum virgatum
  misc_feature: Ceres CLONE 1746206
  misc_feature (142)..(417): Pfam Name: Acyl-ACP_TE Pfam Description: Acyl-ACP thioesterase
MPRTAAAAAPPARKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSATKAEAARAGGGGARPSLAERLRLGSLLEDGLSYKESFIVRCYEVGINKTATVETIANLLQEVGCNHAQSVGFSTDGFATTTTMRKLGLIWVTNRMHIEIYKYPAWGDVVEIETWCQEDGRIGTRRDWILKDLANGEVIGRATSKWVMMNQNTRRLQRVSDDVRDEVFIHCPKTPRLAFPEENNGSLKKIPILSDPAQYSRLGLVPRRADLDMNQHVNNVTYIGWVLESIPQDIIDTHELQTITLDYRRECQHDDIVDSLTYIEEGEEKSMNGSASSTQHKEERQQFLHCLRFAGNGDEINRGRTV

SEQ ID NO: 11521 - DNA, 778 bp, Panicum virgatum
  misc_feature: Ceres CLONE 1746257
  misc_feature: Encodes the peptide sequence at SEQ ID NO. 11522
tctagagctaatacgtgcaacaaaccccgacttccgggaggggcgcatttattagataaaaggctgacgcgggctctgctcgctgatcagatgattcatgataactcgacggatcgcacggcccttgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaactgcccctcgcgttcccctctcccctgcgtcgtcgtctcttctccccccaaatcccccgaaccctaccgccgatccgggcccagatcgccatggccgcccccaacagcaacgatgcagccaacgccagcgccagcgccagcggcaccgcccccgccggcgaggaggacacctccatcgaggcgctggcgcggcgcgtgcaggagcatatgaccctcgcctccaaccccaccgcccgccgccacaagttctgggagactcagcccgtcggccagttccgcgacgccgccgacacgtcgctcccggatggccccatcgagccgccgacgccgctctccgaggtgcgcgccgacccctacccgctccccgccgccttcgagtggctcacctgcgatctcgacgacgacgcgctcctcgccgacctctactcgctgctcgccccacactacgttgaggacgac

SEQ ID NO: 11522 - protein, 122 aa, Panicum virgatum
  misc_feature: Ceres CLONE 1746257
  misc_feature: SWISSPROT Homolog: EC 2.3.1.97 Glycylpeptide N-tetradecanoyltransferase
  misc_feature: Useful for making plants with altered alkaloid content
MAAPNSNDAANASASASGTAPAGEEDTSIEALARRVQEHMTLASNPTARRHKFWETQPVGQFRDAADTSLPDGPIEPPTPLSEVRADPYPLPAAFEWLTCDLDDDALLADLYSLLAPHYVED

SEQ ID NO: 11523 - DNA, 627 bp, Panicum virgatum
  misc_feature: Ceres CLONE 1746257-R
  misc_feature: Encodes the peptide sequence at SEQ ID NO. 11524
gagacgcatgaggtcacagatttctgcagcttttacacgctgccgtcatctgtgctgaacaatgctaactatgcgacgctcaaggctgcatactcgtattacaatgtttccaccaaaaccccattgcagcagctgatgaacgacgcgctaattgttgccaagcagaagaactatgatgtgttcaatgctcttgatgtcatggagaatgagccattcctcaaggagctcaagtttggtcctggagatgggcagctccactattacctctacaactaccggattcgcaatggcatcaagccttcagagcttggccttgtactgctataggcagtccaatcaggacagtcctcagtttacacctgtacttcacagcaggttgttcactgtgcaatctggtggtttctcattttgtttatcggggtagtgattctccttgatatgattgccatggccattgatgggagtccaagatgatttgcaaacgaggagtcttgaattagaaatccttttcttcatttaagattattgtttcccattagtgacattttgtgtgcgtggtcgaaatatgtatgatggcactgagtttaccaagaaattttgatagaacttgtgatatcgatgtcattc

SEQ ID NO: 11524 - protein, 108 aa, Panicum virgatum
  misc_feature: Ceres CLONE 1746257-R
  misc_feature (1)..(107): Pfam Name: NMT_C Pfam Description: Myristoyl-CoA:protein N-myristoyltransferase, C-terminal domain
  misc_feature: SWISSPROT Homolog: EC 2.3.1.97 Glycylpeptide N-tetradecanoyltransferase
  misc_feature: Useful for making plants with altered alkaloid content
ETHEVTDFCSFYTLPSSVLNNANYATLKAAYSYYNVSTKTPLQQLMNDALIVAKQKNYDVFNALDVMENEPFLKELKFGPGDGQLHYYLYNYRIRNGIKPSELGLVLL

SEQ ID NO: 11525 - DNA, 1171 bp, Panicum virgatum
  misc_feature: Ceres CLONE 1746270
  misc_feature: Encodes the peptide sequence at SEQ ID NO. 11526
atcacccaccgccgccgccgccgacacagccgccggagcaccttgactgcttgagcgtagtttaggagagaggattcgaggagtgatgtcgaccgaggaggctgccgctgcggcgaccgaggtgcccgcgaccgaggtcgagtccgaggcgccggtcgccgaggaggcggaggcgaagcccgccaaggccaagaaggcggcgcccaaggagaagaaggcccccaaggagaagaaggcggccaaggagaagaagcccgccgcggcgaggaagccggccgcccacccgccgtacgccgagatgatctcggaggcgattgcggcgctcaaggagaggaccgggtcgagttcggtggccatcggcaggtacgtggaggagaagcacggcgggcagctgccgcccaacttccgcaagctgctggccgggcagctcaagaagctcgccgccgcggggaagctgacccgcgtcaagaactcgttcaagctgccggccgccgccgacgccaagtccaaggcgcccaagcccgccgccgcggccaagccgaagccagccaaggccgccaagcccgccgtcaagcccaaggcgtccccgaaggcgaagaccaagaccgccgccaagcccaaggcggccgccgcctcccccaagcgcaaagccaaggccgcccccgccgcggcgcccaagccccgcggccgcccgcccaaggccgccaagaccgacgccaaggcctcccccgccaaggccgccgccaagaaggcgaagcccgccgccgccgccgccaagaaggagaagaaggccgcggcgacgcccaagaaggccgccgcgaagcccaagaaggccgccgcatccccggccaggaagggcgcggcgaggaaggccaagaagtagacccccctccctcccgtccgtgctcgccgccggcgaccccgccatcccgcctatagatgttccccctcctgcatctggattttgcaatccattcgtcgtagctttgtctgaaaatggaaatggaaatcagtgcctagctctagtagatcccgtcggtagtagcaccagcagtagtcggtctgtaaaatcttgaggtgccggtcgcgtcccgtcttatcgatcggcacgctcctctctcttgctctgtatgatgaactgagttattattataccagtaatgttatctcc

SEQ ID NO: 11526 - protein, 265 aa, Panicum virgatum
  misc_feature: Ceres CLONE 1746270
  misc_feature (65)..(135): Pfam Name: Linker_histone Pfam Description: linker histone H1 and H5 family
MSTEEAAAAATEVPATEVESEAPVAEEAEAKPAKAKKAAPKEKKAPKEKKAAKEKKPAAARKPAAHPPYAEMISEAIAALKERTGSSSVAIGRYVEEKHGGQLPPNFRKLLAGQLKKLAAAGKLTRVKNSFKLPAAADAKSKAPKPAAAAKPKPAKAAKPAVKPKASPKAKTKTAAKPKAAAASPKRKAKAAPAAAPKPRGRPPKAAKTDAKASPAKAAAKKAKPAAAAAKKEKKAAATPKKAAAKPKKAAASPARKGAARKAKK

SEQ ID NO: 11527 - DNA, 728 bp, Panicum virgatum
  misc_feature: Ceres CLONE 1746273
  misc_feature: Encodes the peptide sequence at SEQ ID NO. 11528
acgcgacgcgacaaccccgaggggcgggcgggagagagagagatgagcggggcggaggaggccgcggcagggggaggagggtccggcgggggcagcagcggcgcggggtcgtcggggggcgggagcgggggcggggccgcgcggcggaggttcgacgacaagggcctcgtcgcgcgcacctcgctcatcctctggcacacgcaccagaacgacgtcggcgccgtgcgcaagctgctcgaggaggacgccgcgctcgtcaacgcccgcgactacgacagccgcacgccgctccacgtcgccgcgctccacggctggcacgacgtcgccgagtgcctcatcgccaacggcgccgacgtcaacgcgcaggaccgctggcagaacacgccactagctgatgcagagggtgcaaagaggcagaccatgattgagctgctcaaggagcatggtggattgacatatgggaaaactggaagccattttgaacccaagacaattccaccacctctaacaaacaaggctgattgggagattaacccacttgaattggacttcgcaaaagcagttgtgatcggaaagggctctttcggtgaaattctgaaagcaaattggcgaggaacacctattgctgtcaagcgcattcttccatccctatctgatgacaggctggtgatccaagattttaagcatgaagtcaacttgctaataaagctgagacatcccaatatagt

SEQ ID NO: 11528 - protein, 228 aa, Panicum virgatum
  misc_feature: Ceres CLONE 1746273
  misc_feature (78)..(110): Pfam Name: Ank Pfam Description: Ankyrin repeat
  misc_feature (148)..(228): SWISSPROT Homolog: EC 2.7.10.2 Non-specific protein-tyrosine kinase
  misc_feature (49)..(151): SWISSPROT Homolog: EC 3.5.1.2 Glutaminase
MSGAEEAAAGGGGSGGGSSGAGSSGGGSGGGAARRRFDDKGLVARTSLILWHTHQNDVGAVRKLLEEDAALVNARDYDSRTPLHVAALHGWHDVAECLIANGADVNAQDRWQNTPLADAEGAKRQTMIELLKEHGGLTYGKTGSHFEPKTIPPPLTNKADWEINPLELDFAKAVVIGKGSFGEILKANWRGTPIAVKRILPSLSDDRLVIQDFKHEVNLLIKLRHPNI

SEQ ID NO: 11529 - DNA, 2288 bp, Panicum virgatum
  misc_feature: Ceres CLONE 1746281
  misc_feature: Encodes the peptide sequence at SEQ ID NO. 11530
gcaaatctcgcagcctcccctcccgtctcccgccgccgcacgctcgctcgctcgcgcgccgccgccccgcccgatccgatggctctcgcggccgccgcggggccctcgcctcgccggcggttcgccgcggccgtcgtcgcgctcgcgctcgcactggtcctagcgccggcggccgcgaggcccgacaaggagatgcgggagaagttctacgggacgctcgtcaccaacggcacgcacaacgccaccggggatggcagcatcgccgagatgttcggccgcgtgctcgacaaggagttcgcggacagcgacacgcccgacgctcctgacaagagtagcttcaacaacagtgtatcagatcatcaagctgttttggagacagtagctgtcattacacatgacaagaagaagaatgattcacagcacacaaattccccaaagcctttccaaataggtgacatgtttggaggtcaggatgagacctctgatgacttggaaactgtgatagataaagaggataatgtttttgtgatgtcaaatcgtaaaacaaagtatccaacacttcaattagatttaagattgattaaagatctggtggttataattgtttcagctactggtggtggtatcatattctcttgtttggggcagccggttattgttggctacctacttgctggttctctagttggacctgggggtttgaactttatcagtgaaatggtgcaggtggaaacttttgctcagtttggtgtagtgtttcttctttttgctcttggtctcgagttttcactaactaagttgaaagtggttggtcctgttgctgtacttggtggtctacttcagattgcactgttcatgttcttgtgtggcctcactgcagcgttgtgtggtgctaaatcatccgaaggggtgttcgttggtgccttcttgtctatgtcgtctactgcagtggtttccaagtttttaatagaaaaaggcagtacaaacacgcttcatggccaagtaacaattggaacgcttatacttcaggattgtgcagttggcctgctatttgctctccttcctgttcttggaggtgctagtggcatttttggaggagtgatgtcaatggcgaaattgttgcttgtgctctccgtatttgtagctgttacatatatgatgacatggtcaattgttcctagattcttaaaattgatgattcagttatcttcacagacaaatgaactctaccagttggcctccgtcgctttctgcttgctgctagcctggtgcagtgattatttcggattgagtcttgaattggggtcatttcttgctggtgttatgatatctaccacagattttgctcatcatactttggagcaggtggaagccattcgcaatttatttgcagcactcttccttgcaagcattggaatgctcatacatgttaagttcttgtggaatcatgttgacatattacttgcagctgttatactggttataatagtaaagagtatagtcgtaactgttgtcgtaaaggcatttggatacagcatcagaacagcttttgttgttgggctatccttagctcagataggagagtttgcttttgtgcttttgagccgcgcctcccatctgcatcttgttggggggaaaatgtatctgctattactgggaacaactgcccttagcttggtaacaactcctctcattttcaaactaattcctgtggtaatgcaccttggcatccttatgcgttggttccccatggaaaacagcatgcaaaatgaggagaaagccgccatgcttgaagcccacaacagatcgctctaacattttgcttagatacaacattctttcaactgacggtgatttatttgtgtgctgactctttgcacatgccgtggttgcataggagaatcaactacacaagtccccttttgcgggaacacgaagcgatggccaaaattaacagctcagccagccacggagcctagcattcatttgattgaaattttgaggtgtacatactgtatatgttcaaggtagcatacacgagggtttgtccatagataaggcgctgatgggccttggttttgtatatcgttcttgccaactcaaattagggaggtagaatagggattttggtgccttgtgctcaaatgtaccactattttattgtcagaagatgatggcaaagctgtattttgtagtgtgaatttgctctgttgttgtcaattttcatgtcatcgacacatgaacacatgcatccatccggttgatcataacagagtttagttcctgtc

SEQ ID NO: 11530 - protein, 578 aa, Panicum virgatum
  misc_feature: Ceres CLONE 1746281
  misc_feature (171)..(541): Pfam Name: Na_H_Exchanger Pfam Description: Sodium/hydrogen exchanger family
MALAAAAGPSPRRRFAAAVVALALALVLAPAAARPDKEMREKFYGTLVTNGTHNATGDGSIAEMFGRVLDKEFADSDTPDAPDKSSFNNSVSDHQAVLETVAVITHDKKKNDSQHTNSPKPFQIGDMFGGQDETSDDLETVIDKEDNVFVMSNRKTKYPTLQLDLRLIKDLVVIIVSATGGGIIFSCLGQPVIVGYLLAGSLVGPGGLNFISEMVQVETFAQFGVVFLLFALGLEFSLTKLKVVGPVAVLGGLLQIALFMFLCGLTAALCGAKSSEGVFVGAFLSMSSTAVVSKFLIEKGSTNTLHGQVTIGTLILQDCAVGLLFALLPVLGGASGIFGGVMSMAKLLLVLSVFVAVTYMMTWSIVPRFLKLMIQLSSQTNELYQLASVAFCLLLAWCSDYFGLSLELGSFLAGVMISTTDFAHHTLEQVEAIRNLFAALFLASIGMLIHVKFLWNHVDILLAAVILVIIVKSIVVTVVVKAFGYSIRTAFVVGLSLAQIGEFAFVLLSRASHLHLVGGKMYLLLLGTTALSLVTTPLIFKLIPVVMHLGILMRWFPMENSMQNEEKAAMLEAHNRSL

SEQ ID NO: 11531 - DNA, 2217 bp, Panicum virgatum
  misc_feature: Ceres CLONE 1746299
  misc_feature: Encodes the peptide sequence at SEQ ID NO. 11532
atagccgcaagccctgcagcgcaaaggaaagcacagccgcacagcacagcggcggttttcaaaagaacccgccacctctctgccctgcaccacagcaccagtgcaccgtcccctcaacctcctcctccctctctctcatctcgaattaatttcgctgcgcctgcccccatccgccatttttcttgggtgccgtgcgagctccaagtaccactgactccctcccatctcgcttgcctgttcgtttccgtctccagttggtgtagtgttgttgtttcaatgcgagactgcgtcgggaggagctgtcctcgacgagcttgattgcccttgaaagcgaagttgttggtgccggcgaggaggaagaagggagaggatatatggctcccaaggaagaggcaggggaggacgagcggctgctcaaggatcctcctggttcttcagataaggaagcccatgctatctctgtaggagaggatcaagagaacattaagagcaaccctgatgaaacgaccaaggaggattgtgataacggtgggtccgtaatcgaagccactgtatcgagtgaagatctcaatgataggcatgaaagtgacagcaacagccagtgtgctgaatctaatggtgcttgtaaaccagtcccagaaatgagctccaagagcatcaacggtgagtgcgctagtgaagtgcctgaaatgagatccaagagcagtaatgatgacaacagtgggagcactgatgaaatgcccacaattggcaccaagagcagtagcgacgacaacagcgagtgtgctgaccggagctctccacgtggcgtgctcgatatgtcagtatctggcagtgtggactccgatgacagtgcttcagttgagcagccagcagaatcaaaccaccatatgcaatggaggaacctgatcagcgggctaatacttcggagaaagaagtccatgggtagagcagtgacgttccctcagagatccaagagcagagggcttagagggtatctggaaagaatgcggagtggtaagaaccaaatggactgcagtaccattgctccggagatccttcctgagattgggaagtggagaccatcatggcgaagctttgactatgaagagctttgtgctgcaactgacagatttagtccagaaaaattgatcggcaagggagggcatgccgaggtatacaaaggacagcttgctgatggacaatttgtggcagtgaagagattaacaaaaggtggtaacaaagaggacagagttagcgacttcttgtccgagcttggaataatagcccatgttaaccatccaaacgccgcccagctgttggggttcagtgtggaagggggcttgcacttggttcttcagttctcacctcatggaagcctagcttctgttctgcatggtacaaaagaatccctcaagtggaaagtcaggttcaacattgctcttggaatcgctgaaggattgctttacctacatgaaggatgccatcgccgcataattcacagagacatcaaggcttctaatatccttttaactgaagactaccaacctcagatatcagattttgggcttgcaaaatggcttcctgacaaattgacccatcatgttgtatatcccattgaaggcacatttgggtatatggccccagaatactttatgcatgggatcataaatgagaagacagatgtgtttgcatatggagttctacttcttgagttagttacagggcggaaagcagtggactcctccagacagagcctagtaatatgggcaaaaccgctgcttgacgccaacaacatcaaagagctggtggatccttccctcggcaatgaatacgaccccgaagagatggtgtacaccctagcagtggcatccttgtgcattcaccacagctcaaccacacgtccgagtatgaaatcggtggtctgtttcttgaagggagaccggaagtcacttgagctagtgagaaggcctaaaatcgtaaagcccctgatgtttgactcatgtgattcagaagattacacgcgctcaagctacctcaatgatcttaaccggcacaagcagcttgccttggagcagtgaacttcaaattgagaaatttggacagattcgccgtaattttgtacatcattcactatctagctacactatgatcctcccgctttccacataggttttaaagattgtatggattgatgtgagggatcagttatcattc

SEQ ID NO: 11532 - protein, 568 aa, Panicum virgatum
  misc_feature: Ceres CLONE 1746299
  misc_feature (254)..(520): Pfam Name: Pkinase Pfam Description: Protein kinase domain
  misc_feature: SWISSPROT Homolog: EC 2.7.11.1 Non-specific serine/threonine protein kinase
MAPKEEAGEDERLLKDPPGSSDKEAHAISVGEDQENIKSNPDETTKEDCDNGGSVIEATVSSEDLNDRHESDSNSQCAESNGACKPVPEMSSKSINGECASEVPEMRSKSSNDDNSGSTDEMPTIGTKSSSDDNSECADRSSPRGVLDMSVSGSVDSDDSASVEQPAESNHHMQWRNLISGLILRRKKSMGRAVTFPQRSKSRGLRGYLERMRSGKNQMDCSTIAPEILPEIGKWRPSWRSFDYEELCAATDRFSPEKLIGKGGHAEVYKGQLADGQFVAVKRLTKGGNKEDRVSDFLSELGIIAHVNHPNAAQLLGFSVEGGLHLVLQFSPHGSLASVLHGTKESLKWKVRFNIALGIAEGLLYLHEGCHRRIIHRDIKASNILLTEDYQPQISDFGLAKWLPDKLTHHVVYPIEGTFGYMAPEYFMHGIINEKTDVFAYGVLLLELVTGRKAVDSSRQSLVIWAKPLLDANNIKELVDPSLGNEYDPEEMVYTLAVASLCIHHSSTTRPSMKSVVCFLKGDRKSLELVRRPKIVKPLMFDSCDSEDYTRSSYLNDLNRHKQLALEQ

SEQ ID NO: 11533 - DNA, 1545 bp, Panicum virgatum
  misc_feature: Ceres CLONE 1746374
  misc_feature: Encodes the peptide sequence at SEQ ID NO. 11534
ttgttcctcccaaatccctccaagaaaaggcggctccaacaaccagagcgctcatcagcaaaaatctgaacaagatccgccaccgatttggggagcaccaggcgaaagtgcggccgacgcggcgagttgaagcaagattcgccatgggccggagcaggaaggattccagcgatctggcggaggctctagaggaggacgaagaagagggggaggaacagactgagggcgaagaggaagagggggaggaacaggagcagacggaggaaggtgaggaggatgaggccggggcaggcgctgatgcggagacgctggcccaggacgccgttgagccgccgaagctggccgagggttacttcgagatcgaggccatccgccgccgccgcctccgcaagggccagctccagtacctcgtcaagtggcgtggatggccggagagtgctaacacatgggaaccccttgaaaacctgaaggcctgctcggacattgttgatgcttttgataagaggtcacggtcaccaaggtcctctcggaagcgaaaacgtaagactgcaactactccaacatcagatcctaaaccttctcgtggaaaacggggtcgcccacctcggtcggaggcccgctctacgactggacatcatgccccagaccccaagaaattgccatgcaggacaagtagtaggagagtcagtaataatggtaacaagaccttgtttggtgaactcggggcatcagtgaatgtgcttgggcaaagagtagtacaggagggtagttctggtgtggtttcagttggttttccatcacaaggggttcctctatctgttagcttgactgaccaacaagatgagcatcaccctgcaaatggttcatcaaaggtggaaaattcagtacgagcacccccatctcaaggtggccagataactggtgcaaagaagcgcaagtctggatgtgttaggaggttcaagcaggatgaagcagcaatacaagagcaaggaggtattcgtgatggcacaagtgacaagccaggcaacgagtatgttgattccacagaaggagaaactggtgataagaacaagggggaggactctgctagccaaattcataatcctaagatcttgaagatcatcaagccagtgcgctattttgccactattttggatggtgtgcaggaagttgcaataacgttcaaggcactcaggtctgatggaacagaagtattagtagatgacaagcagttgaaagctaaggagcccttagtgcttatagaatactatgagcagcatcttcgatataaccccacctcgacacattgaagctactgtgttcagttgcctgtgctgcccctatgcttggaacggatggagattgtatttaatgtagcattttttttgtgctagatagatatatctgtacctcgattcggtttgcgctgagtgcgcgtaaacttcgatgttatggtatgctactatgccaaattaacccggacgtttttgtgtgtattggatcctctgcgtagttaatcggatcctctgcgcaattgcgcttgcc

SEQ ID NO: 11534 - protein, 388 aa, Panicum virgatum
  misc_feature: Ceres CLONE 1746374
  misc_feature (71)..(121): Pfam Name: Chromo Pfam Description: 'chromo' (CHRromatin Organisation MOdifier) domain
  misc_feature: SWISSPROT Homolog: EC 2.1.1.43 Histone-lysine N-methyltransferase
MGRSRKDSSDLAEALEEDEEEGEEQTEGEEEEGEEQEQTEEGEEDEAGAGADAETLAQDAVEPPKLAEGYFEIEAIRRRRLRKGQLQYLVKWRGWPESANTWEPLENLKACSDIVDAFDKRSRSPRSSRKRKRKTATTPTSDPKPSRGKRGRPPRSEARSTTGHHAPDPKKLPCRTSSRRVSNNGNKTLFGELGASVNVLGQRVVQEGSSGVVSVGFPSQGVPLSVSLTDQQDEHHPANGSSKVENSVRAPPSQGGQITGAKKRKSGCVRRFKQDEAAIQEQGGIRDGTSDKPGNEYVDSTEGETGDKNKGEDSASQIHNPKILKIIKPVRYFATILDGVQEVAITFKALRSDGTEVLVDDKQLKAKEPLVLIEYYEQHLRYNPTSTH

SEQ ID NO: 11535 - DNA, 743 bp, Panicum virgatum
  misc_feature: Ceres CLONE 1746416
  misc_feature: Encodes the peptide sequence at SEQ ID NO. 11536
aacccacccacctcccacccctcaccaccgcgtcactgatccaaggatcggatcatatcgcccgatcctgcctcgcctctgaacgagaacgcgtcttgctgtgattccttcactatgtgctccgggcctcgcaagccgtcgaccccgccgctgccggcggcgacggccaaggactcggcgatgacggcggccctgctcctggagctggcggcggcggacgacctcgtggcgttccggcgcgccgtggaggaggacaaagtctcggccttggacgccgcgtgccagtggtacggcccctccgcggcgggggcccgcccgcgcctcgagctgcgcacgccggccatggtcgccgcgctctacgggagcacggcggtgctggcgtacgtgctgtccgccgcgccggcggaggcggcgcgcgcctcgcccacggacggcgccacgccgctccacctcgccgcggccggcggcgccgcgggcgccgtcgcggccgcgcacctcctcctcgcagcgggcgcgtccgcggacgcgctcgccttctcgggcctccgcgccggcgacctcctcccgcgcgccaacgccgccgccgagagggacagggcgctccgcgtgctcctcaagtcccccgcggtgtcgccctcgtcctcccccaagaagtccgcctcgccgccgccggccccggagccgaggaaggagtacccgcccgacctcacgctcccggaccctcagagcggcctcttcagcac

SEQ ID NO: 11536 - protein, 187 aa, Panicum virgatum
  misc_feature: Ceres CLONE 1746416
  misc_feature (84)..(119): Pfam Name: Ank Pfam Description: Ankyrin repeat
MTAALLLELAAADDLVAFRRAVEEDKVSALDAACQWYGPSAAGARPRLELRTPAMVAALYGSTAVLAYVLSAAPAEAARASPTDGATPLHLAAAGGAAGAVAAAHLLLAAGASADALAFSGLRAGDLLPRANAAAERDRALRVLLKSPAVSPSSSPKKSASPPPAPEPRKEYPPDLTLPDPQSGLFS

SEQ ID NO: 11537 - DNA, 619 bp, Panicum virgatum
  misc_feature: Ceres CLONE 1746416-R
gcggccgcgcaccggccacccgctccctcatgtcgcaggccaccaccggcgccccgtccatgctctccgactggggatcgccggacggcaagctggactggggcgtccagggcgacgagctgcacaagttccgcaagtccgcgtctttcgctttccgtgggcaatccccggcgccggtgccagcccccaccgagccagacgtctcatgggtgaactctcttgtcaaggacggccacgccggcgacatatttgcgcagtggccggagcaggagcagatggtggcctaattcatcgttggctcatagcatctagctgaccaaagttctttccttcaattatttttcccctttgtttgcttaatttgattcgtatgagatgttttttagtacatatataggctgttcacaataattatatttgttcatcaatcaacaagaagcatggatgccccccaaagggagcttatactgatgaagaacagccaatgtttactcctttctttattttgtttctcctctcaacggttttataaatacatatgtacacaggaattccaacaagagtttatttactctgcttgttatatgaaagatatctggagagcagcaagatttgattc

SEQ ID NO: 11538 - DNA, 1614 bp, Panicum virgatum
  misc_feature: Ceres CLONE 1746427
  misc_feature: Encodes the peptide sequence at SEQ ID NO. 11539
attctcgaattcgaatctcgatggagctgggcggtggcggcggcgacgagagcgccgccaagcgcgcgaagctctcctccggcgaggaccgcctcagcgcgctccccgacgacgtcctcgtcctcatcctcctccgcctcggcaccaccgccgccacccggacgagcgtcctctcccgccgctggcgccgcgtctgggccctcctcccggagctctgcatccccgtcgcccccgagccccaccgcttccgcgacgccctcgacgcccacgaggtgcccctccgggacctccttgtcgtggtcgagggcgccgaagccctggcggtctggctccccgccgccgcgcgccgcgtctccggcaacctagcccttgtcaactttgatccggagaaaaatgccgaggaggaggaggaggaggccgcgcaaggaggcgcctttgagttgccctgcttcgacaaggccacctcgatctcgctcatcctagggttccacggccttgccatgccaaccgccggcgtcttcgcccagctcaccggggtctacctgagccgcgtccggttccatggcccgtgcgcgctcggcgatgccgtgtcctcgccgcggtgcccgtgcttgcagaagctcaccgtcaccgactcccgtggtctgggcaatctcaccatcaactccgagtcgctgctgcggatggagctcagcaacctgcgcgggctgtggcagatcactgttgtggcaccggcgctcacggaactaactgtgatatactgctttagcaacgatgagacgcaaccggttgccaacatctcagcccctcagctgctgagcctcgtgtggagagatgcatatgatccgagctccgtccagcttggcaagatgacacatctccgattgctgggcaccttcttttatcttgtatatggacacgatggccttagtcacaatcactcctgtttaacgctcttgcagcgctttgaggccatcgaaaccctttttctaacactggcgtatatacgggagatagagaactacgaatacttgatggaggacatgacagtgctacctaacactacgattttgtgcctggttgtaattgcaaatggacatgcctttggggccagcgcattccatgttctgagattgtgcactggcataagaagactgatgctgctatttgctgctcctgttggctttgaggcacaaactgtatgcccatcaggttgcatttgtgatcagccaggagagtgggaaaccgaggaattatcattgagccacctcgaagaatttgaaatccgtgacctgagaggatctgtccgtgaagttgcttttctgaagcagtttttcagttgggcgacagtgctaaaacagatggaagtaactttctactataaaatccctgaaatcaaggccaaggaattgtaccaaatgctttggagcttctctaggccaggaatacgcatgacattttatatctatcggaaatttaggaaggtagtatatgtgcctgaggactagtgcaccaggtgtccaggttgtcgctctagtttaagcacttatcatttgtgttttctcagtatgaagtgcactgcctgagaaatgcgagcatatctttattttgtcc

SEQ ID NO: 11539 - protein, 495 aa, Panicum virgatum
  misc_feature: Ceres CLONE 1746427
  misc_feature (23)..(70): Pfam Name: F-box Pfam Description: F-box domain
MELGGGGGDESAAKRAKLSSGEDRLSALPDDVLVLILLRLGTTAATRTSVLSRRWRRVWALLPELCIPVAPEPHRFRDALDAHEVPLRDLLVVVEGAEALAVWLPAAARRVSGNLALVNFDPEKNAEEEEEEAAQGGAFELPCFDKATSISLILGFHGLAMPTAGVFAQLTGVYLSRVRFHGPCALGDAVSSPRCPCLQKLTVTDSRGLGNLTINSESLLRMELSNLRGLWQITVVAPALTELTVIYCFSNDETQPVANISAPQLLSLVWRDAYDPSSVQLGKMTHLRLLGTFFYLVYGHDGLSHNHSCLTLLQRFEAIETLFLTLAYIREIENYEYLMEDMTVLPNTTILCLVVIANGHAFGASAFHVLRLCTGIRRLMLLFAAPVGFEAQTVCPSGCICDQPGEWETEELSLSHLEEFEIRDLRGSVREVAFLKQFFSWATVLKQMEVTFYYKIPEIKAKELYQMLWSFSRPGIRMTFYIYRKFRKVVYVPED

SEQ ID NO: 11540 - DNA, 1457 bp, Panicum virgatum
  misc_feature: Ceres CLONE 1746519
  misc_feature: Encodes the peptide sequence at SEQ ID NO. 11541
ctggccccagtggccccagagcaaccgaggcaccgagcacgcctctcggccagcggcggcacacgggaaccggagacacgagcgattccgtccccaatttccttcgcatccatcgcaatcctcttcccgaaaaccccaatcgccccacttccctcccagacgcgcagcaattccgccataaataccggttgatcgagggcgggagagagcgcacccgccggagcagcgcgcggaggaacgaggccaaacccttcctcagctttcgtctgcgcctggggggatccttcctccggaggaagaagataagacatgggtcaagcacttggtttgattcaagtggatcaatcgacagtagccatcaaggaatcttttggaaagtttgatgagatcctagggcctgggtgccacttcttgccatggtgcatagggaagcaaattgctgggtacctttcactgcgtgttcagcagcttgatgtccgctgcgaaacaaagacaaaggataatgtctttgtcaatgttgtggcatctgtgcaataccgtgcccttgcggacaaggcgtctgatgccttttacaggcttactaacaccagggagcagatccagtcatatgtctttgatgtcatcagggctagtgttcctaagatgaacttggatgatgcatttgagcagaagaatgatattgctaaagcggtggaagatgaacttgaaaaggcaatgtcaatgtatggatatgagattgtgcagactctgattgttgatattgagcctgatgagcatgtgaagagagccatgaatgagatcaatgcagctgctaggctgaggctggctgccaatgagaaagctgaagcagagaagatcctgcagatcaagagagctgaaggtgatgcagaatccaagtacttggccggtatgggtattgcaaggcagcgccaggctatagtggatgggctgagagacagcgttctcgccttctctgagaatgtccctgggacctccgccaaggatgtcatggacatggttctggtgacccagtattttgacaccatgaaagagattggggcatcttccaagtcctcttcggtcttcatcccgcatggacccggcgccgtgaaggacatcgctgcacagataagggacggacagctccaggccaggatgctgtgagagagcactacatgctttgaatattcccatcagtaaagaagttcaagagccactacaatatctagttatttgagtaaaagttaggcatatggtagcaatgtgagtactcgcacttcagtacagcttgtttcattctctgtgtcacgtatgtttattatctagatggatgctatgtaggactgcatggattgtgtcaggaaaggataaagacctgtttgttactgtaagcttttgtgctgccctggtgttctcttgtggtgaatgagcaaatatcatgtctattttctgagccc

SEQ ID NO: 11541 - protein, 284 aa, Panicum virgatum
  misc_feature: Ceres CLONE 1746519
  misc_feature (8)..(182): Pfam Name: Band_7 Pfam Description: SPFH domain / Band 7 family
MGQALGLIQVDQSTVAIKESFGKFDEILGPGCHFLPWCIGKQIAGYLSLRVQQLDVRCETKTKDNVFVNVVASVQYRALADKASDAFYRLTNTREQIQSYVFDVIRASVPKMNLDDAFEQKNDIAKAVEDELEKAMSMYGYEIVQTLIVDIEPDEHVKRAMNEINAAARLRLAANEKAEAEKILQIKRAEGDAESKYLAGMGIARQRQAIVDGLRDSVLAFSENVPGTSAKDVMDMVLVTQYFDTMKEIGASSKSSSVFIPHGPGAVKDIAAQIRDGQLQARML

SEQ ID NO: 11542 - DNA, 736 bp, Panicum virgatum
  misc_feature: Ceres CLONE 1746542
  misc_feature: Encodes the peptide sequence at SEQ ID NO. 11543
aagcagataaagcgcggcagctcagctctgctcagcgcgcgcaccggcgacgcccgcctccgctccctcccgatcgccgccttctccttcgctcccgttcccatggctctgtccgtcggctcgttcgcggcatgcagcctccagccaagagctagtagcattcgggcgggccgtgcgccgccgccgccgccgggcgctgccgcggtggtctcgtttacgaggacggggcgccgggcgaacgcgaccaagggcgtgtccgccgcgtgcgagccgctgggccccgaccggccgctctggttccccggcgcatcccctcccgcgtggttcgacggcagcctccctggagactttggatttgacccgcttggactagggtcggagccggagcagctgcgttggttcgcgcaggcggagctgatccacgggcggtgggcgatgctggcggcggtggggatcctggtcccggacctgctggcgcggtggggcttcattgacggcggcttctcgtggttcgacgccgggtcccgggagtacttcgccgacccctggacgctcttcgtgtcgcagatggcgctcatggggtgggcggagggccggcggtgggcggacctcctcaaccccggctgcgtcgacgtcgagccggacctccccaaccgcaagaagcccgtccccgacgtcggctaccccggcgggctgtggttcgactgggccaactggggccgcggctcccccgagc

SEQ ID NO: 11543 - protein, 211 aa, Panicum virgatum
  misc_feature: Ceres CLONE 1746542
  misc_feature (70)..(208): Pfam Name: Chloroa_b-bind Pfam Description: Chlorophyll A-B binding protein
  misc_feature: Useful for making plants with modulated oxidative stress sensitivity
MALSVGSFAACSLQPRASSIRAGRAPPPPPGAAAVVSFTRTGRRANATKGVSAACEPLGPDRPLWFPGASPPAWFDGSLPGDFGFDPLGLGSEPEQLRWFAQAELIHGRWAMLAAVGILVPDLLARWGFIDGGFSWFDAGSREYFADPWTLFVSQMALMGWAEGRRWADLLNPGCVDVEPDLPNRKKPVPDVGYPGGLWFDWANWGRGSPE

SEQ ID NO: 11544 - DNA, 1049 bp, Panicum virgatum
  misc_feature: Ceres CLONE 1746560
  misc_feature: Encodes the peptide sequence at SEQ ID NO. 11545
tggccgttttcgcagacgccgccgagagagtcgtcgcaaggatatggcggacgggaagcagggggcgagttcggccgtggcgttgaaggcctcgccgtcggcggcggcgatggcgcgggggctgcgcggcggtagcaaccctctggaggagtggagcgcgcgggtgaaggctatcgaggccaggttccgcgggtggatggcgaagcagcctatccacatcgaggccgcggcgaccacggccgtgggggcggtgcagggcggggcgctgggcatgctcatgggctcgctcacggcagacggagggtcgccgttccccatgccgcagccgccgcccaacgccaatccggaggccatggcgtcgttgaagcaggcccaggctttagctggtggacctttggtgcaagcccgaaattttgcagtcatgactggcgcaaatgcaggcatatcttgtgtgatgagaaggatacgagggcaagaggacatccagggaagcatggtagctgcttttggttcgggcgctcttttctccatagtgagcggaatgggaacccctaatccagttgcaaatgcaattacaactggagctgcttttgcagtatttcaaggtggctttttcatgattgggcagaaattctccaagccaccgagtgaagatacatactactctcggacaagaagcatgctgcaacaactgggccttgaaaagtatgagaagaatttcaagaagggactcctcactgatcaaacattacccctcctcactgacagtgctctacgagatgtgaagattccccctggccccagattactcattatcgatcaaattaaaagggaccctgagctggtacgtgcgaagtgaagttgcaattgtcaactactggttctgagttgcatagggtttgaaagtgatgccatctctgttttcataataagctgtctaggcgtgcgtatttagtaagcaagaatttagctatgtttttgtagttatttgttttgccaatcggtttacgccaatcctattgaattttaataacatatatttacatggc

SEQ ID NO: 11545 - protein, 271 aa, Panicum virgatum
  misc_feature: Ceres CLONE 1746560
  misc_feature (52)..(193): Pfam Name: Tim17 Pfam Description: Tim17/Tim22/Tim23 family
MADGKQGASSAVALKASPSAAAMARGLRGGSNPLEEWSARVKAIEARFRGWMAKQPIHIEAAATTAVGAVQGGALGMLMGSLTADGGSPFPMPQPPPNANPEAMASLKQAQALAGGPLVQARNFAVMTGANAGISCVMRRIRGQEDIQGSMVAAFGSGALFSIVSGMGTPNPVANAITTGAAFAVFQGGFFMIGQKFSKPPSEDTYYSRTRSMLQQLGLEKYEKNFKKGLLTDQTLPLLTDSALRDVKIPPGPRLLIIDQIKRDPELVRAK

SEQ ID NO: 11546 - DNA, 1723 bp, Panicum virgatum
  misc_feature: Ceres CLONE 1746581
  misc_feature: Encodes the peptide sequence at SEQ ID NO. 11547
aatcctcgaatcgaatcgcgaccaaatcccccgccccacgctcccctcccctggcctccctcctcaccccgcgcgcgcgcgtgcaccaacccccccacacccgccgtcctcaccacatccgccgccccaaccgatccccctcaagcgccctcgccgcgcgtgacggcgcaatgacggccgccacggcgccgccgccgccgccgccgcggcagctgagcctggaggacctgaaggcggtgtccgtgctggggcgcggcgccaagggcgtcgtgttccacgtcgtgcccaccccgggggacccggagggcgagggcgccgcggcggcggaggcggccatggcgctcaaggcggtctcgcgggaggtggcgcggcacaggaaggcggcgagcggggacggggacggccaccgccggatctggttcgagcgggacgtgctcctcgcgctgcgccacccgctgctcccctcgctccgcggcgtcctcgccaccgacgccgtcgtgggattcgccatcgaccgctgcggcggcggcgacctcaactcgctccggcgccgccagaccgagaagatgttctccgactccgtcatccggttctacgcggcggagctggtgctggcgctcgagtacctgcacagcctcggcatcgtgtaccgggacctcaagccggagaacgtcctcatccaggacagcggccacatcatgctcgtcgacttcgacctctccacgcggctcccgacgccaccgcaggagctggacgcgccggccgagagcaccaaaccggcgcctccggtcgctgcgccgtcgccgggccgcgggaagctaaggaaacccgcgggcgccgccctgtgcttcccattccgcaccggcggcaccgcgaagccggccgcggactcgccgtcgacctcgcggacggcctcctcgtcgtcctcatcctccacggagaccacggcctcctccggggcctcggccggcgcgcggacgcccgcgaagtcgaactcgttcgtgggtacggaggactacgtggcgccggagatcatcgccgggcgcggccacgacttcgccgtggactggtggggcctgggcgtggtgctctacgagatgctctacgggcgcacgccgttccgggggcagaaccgcaaggagacattctaccgcgtcctcgccaagcagccggagctcgtcggcgagcagacgccgctgcgcgacctcatcgcccgcctcctcgagaaggaccccgagaagcgcatcggcgcgcgcggcgtcaaggcccaccccttcttccggggcgtcgactgggaccgcatcctccacgtggcgcgcccgccgttcatcccgaccccgccgcaggaagaggacggcgacgacgcgctcgacgtcgagaaggtcgtgcgcgaggtgttcgcgtccaatgacgccgaggctgcaaagacgggcgagggcgagaaggcttcgccggaggcggatgggggccgcggcggcgacggcgaagggcggaggagagacccatcaaaagagggtgacttctccgtgtttttctgagcttatattttttattttttccttttttgggaaaaattaactactacttgtatttgttgtttattgagttgccttttttttaaggatttgtagtatgaacatgatgggatttagcggatgagattaggaggggagtacggcgcagtggccggtggagtacataaattaaagaggtgctccagttc

SEQ ID NO: 11547 - protein, 455 aa, Panicum virgatum
  misc_feature: Ceres CLONE 1746581
  misc_feature (20)..(370): Pfam Name: Pkinase Pfam Description: Protein kinase domain
  misc_feature: SWISSPROT Homolog: EC 2.7.11.1 Non-specific serine/threonine protein kinase
MTAATAPPPPPPRQLSLEDLKAVSVLGRGAKGVVFHVVPTPGDPEGEGAAAAEAAMALKAVSREVARHRKAASGDGDGHRRIWFERDVLLALRHPLLPSLRGVLATDAVVGFAIDRCGGGDLNSLRRRQTEKMFSDSVIRFYAAELVLALEYLHSLGIVYRDLKPENVLIQDSGHIMLVDFDLSTRLPTPPQELDAPAESTKPAPPVAAPSPGRGKLRKPAGAALCFPFRTGGTAKPAADSPSTSRTASSSSSSSTETTASSGASAGARTPAKSNSFVGTEDYVAPEIIAGRGHDFAVDWWGLGVVLYEMLYGRTPFRGQNRKETFYRVLAKQPELVGEQTPLRDLIARLLEKDPEKRIGARGVKAHPFFRGVDWDRILHVARPPFIPTPPQEEDGDDALDVEKVVREVFASNDAEAAKTGEGEKASPEADGGRGGDGEGRRRDPSKEGDFSVFF

SEQ ID NO: 11548 - DNA, 1792 bp, Panicum virgatum
  misc_feature: Ceres CLONE 1746621
  misc_feature: Encodes the peptide sequence at SEQ ID NO. 11549
aggacaatcccgtcagtcggaccccgcctccgcccctcacctcccgctcgccggaggcccggccgcggccggcggcgatggggcacggcgccagctgcggccgccccagcgaggaggtggacttcttcggcgccgcgcagtcgggcgacctcgcccgcctcgccgccgtcctgcgctcccgccccaccctgctcagccggaccacgctcttcgaccgcctctccgcgctccacatcgccgccgcccacggccacctccaggtggtctcgctggcattggacctttgcgtgcacccggatgtcgtcaaccgccacaagcagacggcgctgatgctcgcggcgatgcacgggaagacagactgcgttcgccggttgctcgacgccggcgccaatatcgtgatgttcgattcgtcgcacgggcggacgtgcctgcactacgcggcgtactacgggcacgcggactgcctccgggccatcctctcggcggccaagtccgcgccggtgtcggaatcctgggggttcgcgcgcttcgtgaacgtgcgggacgacgccggggcgacgccgctgcacctcgcggcgaggcagggctggcggcgctgcgtccacgtcctgctcgagaacggcgccatcgtgtcagcctccagtggcgccttcggattccccgggagcacgccgctgcatttggccgcgcgcggcggcaacctggactgcgtccggcagctcctctcctggggcgccgaccgcctccagcgagactccgtcgggagaattccgtacgaggtcgccgtgaagcgagggcacgtcgcgtgcgcggcgctgctgaacccgtcgtccgcagagcccctggtgtggccgtcagctctcaagttcatcagcgagctcgagcccaacgccaagtccctgctcgaagcggctctgatggaggccaacagggagagggagaggaggatcctcaaggggaccaagaatgcgtcgccgtcgccgtcgcattccgacgacggtgctcatgacgccgccgccatagctgaggcaagcgacgcggaggtgtgcagcatctgcttcgagcaggtgtgcagcatcgaggtccgggagtgcgggcaccagatgtgcgcggcgtgcacgctggcgctgtgctgccacgccaagcccaacccggcgacgcagtcccagccgctgccgacctgcccgttctgccgcggcggcatcgcgcggctcgtggtggcgacgcggacgcgggccgccgacgaggaggaagaggggagcaggctggagtcgcctaggcaccggcgggcgcgccggtccatgaacctaagcggcgacgcgggcagcaccagcagcctcatgggcagcatcgcctcgtccatcggcaagatgggccgccggcgaacggacagcagcgagcaggtcgacgacaagccgtagcaaagcattcttcgctccccggcgtccatccattcagaagaaaccagtgcatatacgatcattatcgtcgtcgtcatcctcgccggcgccgccgtctcgatcaaggaacgaacaagccgctgtttttgtagattatttttggcaaatgagttattcacctgtgtagattcatttctcaagcgatccagtgctgtagatccgatcatccaaataagcagccagtccgtccgtccttgcctggcactggcagcccccatgcggtcttgcctcctccgttggagttcttgaaacgctgctgtacatgtccggttcgcagagatctggcccggtctgataatgagaacccgggtacaaatccatgtgaccgattc

SEQ ID NO: 11549 - protein, 447 aa, Panicum virgatum
  misc_feature: Ceres CLONE 1746621
  misc_feature (195)..(227): Pfam Name: Ank Pfam Description: Ankyrin repeat
  misc_feature (79)..(111): Pfam Name: Ank Pfam Description: Ankyrin repeat
  misc_feature (158)..(190): Pfam Name: Ank Pfam Description: Ankyrin repeat
  misc_feature (46)..(78): Pfam Name: Ank Pfam Description: Ankyrin repeat
  misc_feature: SWISSPROT Homolog: EC 2.7.11.1 Non-specific serine/threonine protein kinase
MGHGASCGRPSEEVDFFGAAQSGDLARLAAVLRSRPTLLSRTTLFDRLSALHIAAAHGHLQVVSLALDLCVHPDVVNRHKQTALMLAAMHGKTDCVRRLLDAGANIVMFDSSHGRTCLHYAAYYGHADCLRAILSAAKSAPVSESWGFARFVNVRDDAGATPLHLAARQGWRRCVHVLLENGAIVSASSGAFGFPGSTPLHLAARGGNLDCVRQLLSWGADRLQRDSVGRIPYEVAVKRGHVACAALLNPSSAEPLVWPSALKFISELEPNAKSLLEAALMEANRERERRILKGTKNASPSPSHSDDGAHDAAAIAEASDAEVCSICFEQVCSIEVRECGHQMCAACTLALCCHAKPNPATQSQPLPTCPFCRGGIARLVVATRTRAADEEEEGSRLESPRHRRARRSMNLSGDAGSTSSLMGSIASSIGKMGRRRTDSSEQVDDKP

SEQ ID NO: 11550 - DNA, 688 bp, Panicum virgatum
  misc_feature: Ceres CLONE 1746636
  misc_feature: Encodes the peptide sequence at SEQ ID NO. 11551
agcggcggtgcccagcagcggcgcgccacccatggctccgtgaaccagttcgcggccgctctccctcctggactcttcactcgtcgtgatcaagctgggggttaccgatttggcaccactagcttagtgccgccgcttaggcttcgacatgagtgggcggcgctgggctgccgccgcgccggtgccggtgccgagcctcctgcaggtcctcctcgccttgcagtgcggggtcgtgttcctgcaatgctccgccgcctctgccatgagcggcgacgtgtcggcgctcatagcattcaaacgcgcaatcattgaggatcctcactccgtgctatcagactggactgatgcggacggcaacgcctgcgactggcacggcgtcatctgctccgcgccgcagggctccgtcatctcactgaagctatcaaactcatccctcaagggattcattgcacctgaacttggacggctcaacttcttgcaagagctgtatttggatcataacctgttctttggtacaattccgaaacaaattggctcgctcaggaacttgagggttctggatttgagtgttaatcggctcactggccctattccatccgagttaggcgggttgagcagcgtgagcgtgataaatttccattcaaatgggttgactgggaaaataccatcggagttgggaaaactacag

SEQ ID NO: 11551 - protein, 179 aa, Panicum virgatum
  misc_feature: Ceres CLONE 1746636
  misc_feature (39)..(80): Pfam Name: LRRNT_2 Pfam Description: Leucine rich repeat N-terminal domain
  misc_feature: SWISSPROT Homolog: EC 2.7.11.1 Non-specific serine/threonine protein kinase
MSGRRWAAAAPVPVPSLLQVLLALQCGVVFLQCSAASAMSGDVSALIAFKRAIIEDPHSVLSDWTDADGNACDWHGVICSAPQGSVISLKLSNSSLKGFIAPELGRLNFLQELYLDHNLFFGTIPKQIGSLRNLRVLDLSVNRLTGPIPSELGGLSSVSVINFHSNGLTGKIPSELGKL

SEQ ID NO: 11552 - DNA, 615 bp, Panicum virgatum
  misc_feature: Ceres CLONE 1746636-R
  misc_feature: Encodes the peptide sequence at SEQ ID NO. 11553
ggcaacacctatgctttcggggtaattttactggagattatcagtggacggctcccatactgcaaggataaaggatatctggttgactgggctaccaagttcctccagcagcccgaggagatcgggaagctagtcgaccccgagctgagcaacgtgaggacggaggacctcgcggtcctgtgcagcgtggtgagccggtgcatcgaccctgacccttccaagagaccgtcgatgcagatcatcacgggcgtgctggagaacgggatcgacctgtcggcggccgccatcctcaaggagtcgtcgctggcgtgggccgagctcgcgctggcgttgtgacatgcctgccttcccgtcaccatgtaaatctatcgtcacgcacactgatatatgttagccgtggttgtctgcttgacgtatagagagagtgagagagaaggaaccttacctttggctgcagccaaggagcgggagctgctcaggttcgcgcacgacactgatttgtttcgactgatgtagtacgagttgttatagatgatggtgtgcgggggaggcattgcgagtgtacttatgtgcgatgctgtcgcctgtcatgtctgaatgaggaagttgtgtggc

SEQ ID NO: 11553 - protein, 111 aa, Panicum virgatum
  misc_feature: Ceres CLONE 1746636-R
  misc_feature: SWISSPROT Homolog: EC 2.7.11.1 Non-specific serine/threonine protein kinase
GNTYAFGVILLEIISGRLPYCKDKGYLVDWATKFLQQPEEIGKLVDPELSNVRTEDLAVLCSVVSRCIDPDPSKRPSMQIITGVLENGIDLSAAAILKESSLAWAELALAL

SEQ ID NO: 11554 - DNA, 2050 bp, Panicum virgatum
  misc_feature: Ceres CLONE 1746664
  misc_feature: Encodes the peptide sequence at SEQ ID NO. 11555
acaagggaagaaaggggaatagaaaggcgaggccagctttcccctcggctcaaaatctctctggattctctggaaagttcttgcttttcgagaccagcggcctgagcttctgaattctctggtcggagttggtcgttcgcgtgacgttgctgatccaatgggggagacgaaccagccgccgccgccgccggtggccgctccgccgtccatgatgccgatgcccatgatggcgccggccgtcggcgccggcgccatccacccacctcacgagcagttccaccatctcgcctactgcgtccactccaatccgtcttgggtccaggtggcagcactggcattccttcactatcttgtgatgttgggctctactgttatgcttgcatcaactattgttcctgcaatgggcggtaacgctggggataaggctcgagttattcaatcattcctatttatgagtggtatcaatacaatgctgcaaacacttattggaacgagacttccaacaattatgaatgcctcctttgcatttgttgtccccgtgctgtcaattgccagagacatagattcaaatgacttcacaaataatcaccagagatttctccacacgatgagaactacgcaaggagctctgattgttgcttccatcctcaacatgattcttgggttcagcacaatatggggggcatatgctaagaaattcagtcctgtaataatgacccctgttgtttgtgttgttggtcttggactatttgaacttggttttccccaggttggtaaatgtgtggaaattgggttgccaatgctaattcttgcggtgatcgtgcagcagtatgtgccacgttacttcagtcatatccatgagcggatcacatacttgtttgagaggtattcgttgcttctttgtattggcattgtgtgggcctttgcagctatccttactgctgcgggtgcatacaatcatgtttcacctaagacgcagcagcattgccgtactgataagtctttcctgatgtcatcggcaccgtggattaaaattccataccctttccaatggggtacaccaatcttcactgctggtcattcatttgggatgatgggtgctgtacttgttggagcctttgagtcaactggagcacactttgcaactgcacgtctagcgggtgctacaccacctccaggtcatgtccttagtcgaagtgttggcttgcagggtattgggatgttcctggaggggatctttggtgctccagcaggttcatctgtatcagttgaaaacattggcctccttgggctgaccaaaatcggaagtaggagagtgatccagatatcaactggatttatgatatttttctccatatttgggaagtttggggccttctttgcatcaattccactgccaatcttcgcagcaatttactgcatcttgtttggcatcgtagctgctgtgggagtctcattcatgcagtttgccaacaagaactcgatgaggaacatctacatcattggactctcattgttccttggtatctcagtccctcaatacttcaatgaatatacttctgctggccgtggacctgcccgaacaaatgctggatggttcaatgacattataaacaccgtgtttgcttctggcccaacggtggcgctgattgttgcctctgttctggataacacattggaggccagaggcaacgactctgaccgagggctcccatggttcacgccattcctgcgccgtcacaaaggttactcggacccaagaaacgatgagttctacagtttcccaatcagggttcacgacttcatcccgagtcggttcctctgactttctcatgagcgctgttactgtgcatgtaaatgtctttgttcttggtagtcttactcctatgacctgtagtgattggttcttacattctagtgggatatgggtacaagaatatttagggaatttgctttatttaccccttctgcgctaagaaatggttacatgacaatgtagggctgtgtgcccaggcaggttttgggaagaattacagaagaatagcacctt

SEQ ID NO: 11555 - protein, 538 aa, Panicum virgatum
  misc_feature: Ceres CLONE 1746664
  misc_feature (37)..(448): Pfam Name: Xan_ur_permease Pfam Description: Permease family
MMPMPMMAPAVGAGAIHPPHEQFHHLAYCVHSNPSWVQVAALAFLHYLVMLGSTVMLASTIVPAMGGNAGDKARVIQSFLFMSGINTMLQTLIGTRLPTIMNASFAFVVPVLSIARDIDSNDFTNNHQRFLHTMRTTQGALIVASILNMILGFSTIWGAYAKKFSPVIMTPVVCVVGLGLFELGFPQVGKCVEIGLPMLILAVIVQQYVPRYFSHIHERITYLFERYSLLLCIGIVWAFAAILTAAGAYNHVSPKTQQHCRTDKSFLMSSAPWIKIPYPFQWGTPIFTAGHSFGMMGAVLVGAFESTGAHFATARLAGATPPPGHVLSRSVGLQGIGMFLEGIFGAPAGSSVSVENIGLLGLTKIGSRRVIQISTGFMIFFSIFGKFGAFFASIPLPIFAAIYCILFGIVAAVGVSFMQFANKNSMRNIYIIGLSLFLGISVPQYFNEYTSAGRGPARTNAGWFNDIINTVFASGPTVALIVASVLDNTLEARGNDSDRGLPWFTPFLRRHKGYSDPRNDEFYSFPIRVHDFIPSRFL

SEQ ID NO: 11556 - DNA, 2022 bp, Panicum virgatum
  misc_feature: Ceres CLONE 1746679
  misc_feature: Encodes the peptide sequence at SEQ ID NO. 11557
attttgctgcctgcttcgtgccatgggggatttctgtcatttccagcgatactgcacacatgttgggagatgaatgatctagggactatagtcatttggttcttcaagtctccagtatctagttcccttgattaaaacacctcactttctattttaccatttttgttatcctctttgggtcaaatttatgtcaagtgtgtttgttgagcaagtttcgtgagggtagctggcatcctggaaaatttaaggcaatggtttatgcgttgttgtttgaattgtggatagctttatgtatcggcacaaacagcagtgcatggttgggcactgctgctcttgttaccaacatgaggaatttccctctcagcagaggcactgttgctggtcttatcaagggttatgttgctgttagtgctgctgtctacacagaaacttttaatggaatgctagggaattcagccacaaatcttttgctgttgcttgccttggggatcccaacagcatgtattgtggtgatgtattttgttaggccttgcactccatcactggaagaggacaactcaacagaacacagccatttcatgtacacacaaatctcaagtgtggttctcggcatataccttatggtagctacaatacttggggatactttaaaactaagtcaggctgtcacgtaccttttgtttggtataatgatacttttgctccttgctccacttgcaataccaataaagatgacactttatccaaacaaacaaactaaggaaaagcccagcacccttgctccatcttattcaactgatagtctgtctggcgcggatccagagaactcagaaccacttctgggcagtgcctcagcaacacttgctacaggtgcccatgaatctgatgatagtactgatttggatgttctattggcagagggtgagggagcagtgaatttgaaaaagaaaagagggccaaggaggggggatgatttcacattccttgaagctttagtaaaagcagacttctggctactttttattgtatacttttgtggagttggcacaggagtcactgttctaaacaaccttgctcaggttggaatgtctgttggtgctaatgacacaactattttgttgtgcctttttggcttctgcaactttgttggccgaatccttggtggatctctctctgagtattttgtaaggtcaaggatgctccctcgtcctttttggatgatgtgcacacaaataatcatggtagtaaccttcctgctgtttgcaactggtcttcatagcttgatctatgtttcaactacactcctggggatatgctatggcgtccaattcgccgtcatgattccaactgtctcggagcttttcgggctgaaggacttcggcctgatgtacaacttcatgctgttggtgaatccactcggtgcattctttttttcggctcttcttgctggctacatctatgacaaggaggcggcaaggcagcacccaggtgtgcttgagccttcaaactgctatgggcctgattgcttcagagtcaccttctatatctgtgctattgtgtgctgctgtggaaccctgttgagcgtgctcttcatagcgaggataaagccagtctatcagatgctctacgcaagcgggtcattcaggcatccgcggagccaacagcagctccactgatgatgcatgtacaatcatgtcaagaagaaacattgaggtttgggagttgggactgatagcacaatgttatagggttaaaatatccgctggatgctgtgttccggtgatgtatcacattatggacgcctggttcgctcctgtttgtatgggagagttgttttgctttcatctatccctgttctgtaaagagcgccactcgccaatctagtagatagcacacagggaatgatcagtatatagtggtaaatcaggctgcctataatttagtatttatatggcagctcttgtacatcagcaagtttgaggatgtcgtacagcgaatatatcttctttattatagtgttcc

SEQ ID NO: 11557 - protein, 474 aa, Panicum virgatum
  misc_feature: Ceres CLONE 1746679
  misc_feature (1)..(159): Pfam Name: Nodulin-like Pfam Description: Nodulin-like
MVYALLFELWIALCIGTNSSAWLGTAALVTNMRNFPLSRGTVAGLIKGYVAVSAAVYTETFNGMLGNSATNLLLLLALGIPTACIVVMYFVRPCTPSLEEDNSTEHSHFMYTQISSVVLGIYLMVATILGDTLKLSQAVTYLLFGIMILLLLAPLAIPIKMTLYPNKQTKEKPSTLAPSYSTDSLSGADPENSEPLLGSASATLATGAHESDDSTDLDVLLAEGEGAVNLKKKRGPRRGDDFTFLEALVKADFWLLFIVYFCGVGTGVTVLNNLAQVGMSVGANDTTILLCLFGFCNFVGRILGGSLSEYFVRSRMLPRPFWMMCTQIIMVVTFLLFATGLHSLIYVSTTLLGICYGVQFAVMIPTVSELFGLKDFGLMYNFMLLVNPLGAFFFSALLAGYIYDKEAARQHPGVLEPSNCYGPDCFRVTFYICAIVCCCGTLLSVLFIARIKPVYQMLYASGSFRHPRSQQQLH

SEQ ID NO: 11558 - DNA, 2322 bp, Panicum virgatum
  misc_feature: Ceres CLONE 1746701
  misc_feature: Encodes the peptide sequence at SEQ ID NO. 11559
tgatttttgagccctcgttctagtgcttggccttttggggagtgttgatgcggcgttatggggcgctggatctgttgtccagcgcgaggtcgtagcttgtgggggaacctgcaagatcaggagttggagggtgcgctgccacaccgctgaatgcttggagaaggtggagagctcggtgttgacctgcctgttcgattctacacttctgtgtttctgatcatctgctcctgcccggttcttgtctgctgaatctgtctccctaagcatggtcgggcaagcggcaaaggcaaaggagtcagggaaagacgacagacaagaacccggagctgaggtgatgaaagagaagctactgccatctcaccagcaggaagagtctccagcttctgtgatggataaggattcttcagttcctggtgatgtgtcgccggtcctagatggggattctggggagttgaaagtggaggagaacatggatagcaatgggaataaggaaaagaaaacatctcagaagagcagtacaagtgacggcttcgcttctgctaaagtgagtgatgggacaagcagtttgaggaagaccagtggtagtgcgacgatgagtacacgggctgatttcactgagagtgggaagagtagcatgtgccgtgtgagcactggcagtgacattagtgacgagagctcctgtagcagcatgagcagcaccactacgaaaccgcacaaggggaatgattcaaggtgggaggcgatccatgtggtgaagtccagggataacgttcttggtttgaatcattttaggctgcttaagaagctgggttctggtgatattggcagtgtgtatctctctgaattgagtggtgcacggagttactttgcaatgaaggtcatggataagacttctttggcaagtcggaagaagctgcttcgagctcagactgagcgggagatcctgcagtccctggatcatccatttctaccaaccctgtatactcacttcgagacggataagttttcatgcttggttatggagttctgccctggaggggatcttcacactcttcgccaaaggcaacctggaaaatatttttcggaacaagcagcaaagttctatgtagcagaggtgctccttgcattggaatacctgcatatgcttgggattatataccgtgaccttaaaccagaaaatgtccttgttcgggaagatggccacatcatgctgtccgactttgatctttcacttcgctgttcagtaagcccaacggtggtcaaatcttccaatccgggcctagatgcactgcagaggaacaatgcagcatactgtgcccagcctgcttgcattgaaccatcctgcattcagccctcgtgtgttgctccaaccacttgctttggcccccgattcttcaagtcgaaatccaagtccaagtccaagaagtcaaagcctgatgctccaaaccaagagaacctatttccggagcttattgctgagcctactgacgcccgctccatgtcctttgttggcacccatgagtacttggccccagaaataataaaaggggagggccatggaagcgcggtggattggtggacctttggtatattcttgtatgagctgctgttcggcaagacccctttcaagggttcaggcaaccggacaacgctcttcaatgtcgttggccagcccttgaggttcccagagtcgccgatagtgagtttctctgcgagggacatgataaggggattgctggtcaaggacccacagcaccggcttggatataagcgaggtgctactgagataaagcagcatcctttcttcgagggcgtgaactgggcactcattagatgtgcgagccctccagacattccaaagcctgtagagcttgactgccgcccgaagcaagtgccatcgacaaatggaaaggttgcaccagtcaccaaccaaaaggggccagataattacctagagtttgaattcttctagttttttttttcctttttgtgatatctgaactgaaagagtgcatctgggctgattgtggaagaaagcgaaagatgaggagctactctaggcatatgcttggctggaatttttctgctgttagactgtatgctcactccaggagccccccccaagttgttttacttgttgaactgcttgactctaggatgtactggattcatcatgtatgttgcaattttcgaaaccacctattggtatcgagctgtcgatgtaattgttgctgtactctgtaattgatgtttcctcctgggacatgtcttgctctaccaaatgctgatatctgaacctggaattgcaatgcaacttatgtc

SEQ ID NO: 11559 - protein, 568 aa, Panicum virgatum
  misc_feature: Ceres CLONE 1746701
  misc_feature (175)..(514): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated biomass
MVGQAAKAKESGKDDRQEPGAEVMKEKLLPSHQQEESPASVMDKDSSVPGDVSPVLDGDSGELKVEENMDSNGNKEKKTSQKSSTSDGFASAKVSDGTSSLRKTSGSATMSTRADFTESGKSSMCRVSTGSDISDESSCSSMSSTTTKPHKGNDSRWEAIHVVKSRDNVLGLNHFRLLKKLGSGDIGSVYLSELSGARSYFAMKVMDKTSLASRKKLLRAQTEREILQSLDHPFLPTLYTHFETDKFSCLVMEFCPGGDLHTLRQRQPGKYFSEQAAKFYVAEVLLALEYLHMLGIIYRDLKPENVLVREDGHIMLSDFDLSLRCSVSPTVVKSSNPGLDALQRNNAAYCAQPACIEPSCIQPSCVAPTTCFGPRFFKSKSKSKSKKSKPDAPNQENLFPELIAEPTDARSMSFVGTHEYLAPEIIKGEGHGSAVDWWTFGIFLYELLFGKTPFKGSGNRTTLFNVVGQPLRFPESPIVSFSARDMIRGLLVKDPQHRLGYKRGATEIKQHPFFEGVNWALIRCASPPDIPKPVELDCRPKQVPSTNGKVAPVTNQKGPDNYLEFEFF

SEQ ID NO: 11560 - DNA, 1744 bp, Panicum virgatum
  misc_feature: Ceres CLONE 1746781
  misc_feature: Encodes the peptide sequence at SEQ ID NO. 11561
acttcccactcctccgcattcccttcccaccccaccccaccccaccgacccaccgaaccctacttaccaacagaccgcaggagcagggaggaaaaaatcctgtcgaggcgacaacgccgccatggccggcgatcccccgacggccgcggagaaggaggccctggtctcctccttcctcgagatcgccgccggccagacccccgacactgccacccagttcctccagatgacgagctggcacctggaggaggcgctgcagctgttctacatcgacggggagtccgccctcacggcgcatccggcggccccacctgccgcggcggcggctgctgcttcggcggtggcggcggcggccggagtggaggaggcgttaaggttcgcgccacccccagcggctgcactgggcgatccgttgttgcatggacttggggttggggaggacgacgacgtccgcgcgccgctgcctgcgaagcgggagactctctacggcgagggccctgtgtctgtcctgcgtcctaatacaacggttgcttttcgtaactttgaacaagaggcaagacaatccgctgtttgggattctgatcggaatgctacatctagttctcatgataatctcgcttctttgtaccgtccacctttttctttgatgttcaatggaccatttgataaggcaaagttagaggctgcttctctggacaaatggctgttaatcaatttgcagtcgacggaggaattcagctctcacatgcttaatcgagacacttggggaaatgaagcagtggctcaattaattcggtcaaattttattttctggcaggtttatcatgacaccagtgaggggaggaaggtgtgcacctactacaatttggtatccattcctgctatactcctgattgaccccatcactgggcaaaaaatacgtggttggaatggaatggttcacccagaccgtctgcttgaggatctgctgccttacctggataaaggtccaaaggagtaccatgcagctcaaccacaaaagcgcccaaggaaagttgatcaggaaactcctatgggaaaacaaggtaaaacaactgtagaggatgaggatgaagaactagcaagggcagttgcagcttccctggaggacaataaacaagtcgttgaaggatcagatgctacagatgacatggctgaagctgaacccgaggaagaaaatgagaccagcttaaatatcaagttggattatcctcctctccctgaagaacctaccggaagcagggaccttctctgcagggttgcgattcggctaccgaacaatcggaggatacaaagaaattttcttcacacagatcctattaagctcctatggtcattctgtgctactcaggttgaggatggggagaagcgggctttccactttgtgcagcccattcctggagcatcaaagaacctggagtttgcaagtgatctcactttcaaagaagctggattggccaactcaatgatcaacctcacgtgggactgagcctgcttccatcttgtgctttgaagccgcggcgtatttcagcctgggcttgaagatggttttagttgttttctttccttgaggcttaactctttatcttgcgctctgctggagcttggagtcagggacaaatctgtggcctgggctgtgtgtggaaatgctcgttttgccgttggttcttgtgtctataaacacccatggtgggacttagctctatttaatgcacatatttgtcat

SEQ ID NO: 11561 - protein, 461 aa, Panicum virgatum
  misc_feature: Ceres CLONE 1746781
  misc_feature (379)..(460): Pfam Name: UBX Pfam Description: UBX domain
MAGDPPTAAEKEALVSSFLEIAAGQTPDTATQFLQMTSWHLEEALQLFYIDGESALTAHPAAPPAAAAAAASAVAAAAGVEEALRFAPPPAAALGDPLLHGLGVGEDDDVRAPLPAKRETLYGEGPVSVLRPNTTVAFRNFEQEARQSAVWDSDRNATSSSHDNLASLYRPPFSLMFNGPFDKAKLEAASLDKWLLINLQSTEEFSSHMLNRDTWGNEAVAQLIRSNFIFWQVYHDTSEGRKVCTYYNLVSIPAILLIDPITGQKIRGWNGMVHPDRLLEDLLPYLDKGPKEYHAAQPQKRPRKVDQETPMGKQGKTTVEDEDEELARAVAASLEDNKQVVEGSDATDDMAEAEPEEENETSLNIKLDYPPLPEEPTGSRDLLCRVAIRLPNNRRIQRNFLHTDPIKLLWSFCATQVEDGEKRAFHFVQPIPGASKNLEFASDLTFKEAGLANSMINLTWD

SEQ ID NO: 11562 - DNA, 1320 bp, Panicum virgatum
  misc_feature: Ceres CLONE 1746806
  misc_feature: Encodes the peptide sequence at SEQ ID NO. 11563
agcgccattgctgccatcgcattcacagcgctaccacctctgtcgctttcctctcctcctcgcccccttccctcgccgtaccaccaccacttccgcctcctcgctgccgcccaaaatccaaaccctaggcgccgccgctccgaggcgcgccagatcggcggcggcggcgggctgcggctgccccggatccaatgcagcggcgcccgtagcgcgggggtagctgatctgaggcgccggcggccgcaggcggcgcgggtggaacggggatgtcgtccgcgccggtggcgggggcggcgttcgagcggtaccagcagcgcggaggtggcggcgccgcggcggccaacggcagcacggttttcaagagtgggcctctcttcatatcatcaaaagggattggatggaaatcatggaagaagcgttggttcatcctcacacgaacatcattggttttcttcaagagtgatcctaataccttgccccagagaggtggtgaagtgaatgttactctaggaggaattgatttgaataattctgggagtgttgtagtcagagaagataagaaattgttaaccgttcttttcccagatggacgtgatggtcgtgcattcactcttaaggcagaaacttctgaagatttattcgagtggaaaacagcattggaagaagctcttgcacaagctccaaatgcagctcttgtgatgggacataatgggatatttcgtaatgagacagttgacacatatgaaggagctgttccaaactggagagagaagagaccaatcaaatcattggtgacaggcaggccaattctgcttgcacttgaggatattgatggcagtccttcttttttagaaaaggccctgcgctttcttgagaaacatggaataaaagtggaaggaattttgcggcaggctgcagatgtggaagaggtcgacaggaggttgcaggaatatgagcaaggaaggaccgagttttcagcagatgaggatgctcacattgttggtgactgtataaagcatgttctccgagagttaccatcatcccctgtgcctgcttcttgctgtacagcattattggaagcttttcgcctcgaagctaaggatgctaagataaatgctatgcgttcagctatatctgagacatttcctgagcccaatcggaggcttctgcagagaattttgaaaatgatgcacactattgcatctcacacttctgaaaatcgaatgactgcatcagcagttgctgcctgtatggcacctcttctgttgcgtccacttctggctggtgagtgtgagatggatgaggtatttgatatgggat

SEQ ID NO: 11563 - protein, 351 aa, Panicum virgatum
  misc_feature: Ceres CLONE 1746806
  misc_feature (192)..(339): Pfam Name: RhoGAP Pfam Description: RhoGAP domain
  misc_feature (30)..(136): Pfam Name: PH Pfam Description: PH domain
MSSAPVAGAAFERYQQRGGGGAAAANGSTVFKSGPLFISSKGIGWKSWKKRWFILTRTSLVFFKSDPNTLPQRGGEVNVTLGGIDLNNSGSVVVREDKKLLTVLFPDGRDGRAFTLKAETSEDLFEWKTALEEALAQAPNAALVMGHNGIFRNETVDTYEGAVPNWREKRPIKSLVTGRPILLALEDIDGSPSFLEKALRFLEKHGIKVEGILRQAADVEEVDRRLQEYEQGRTEFSADEDAHIVGDCIKHVLRELPSSPVPASCCTALLEAFRLEAKDAKINAMRSAISETFPEPNRRLLQRILKMMHTIASHTSENRMTASAVAACMAPLLLRPLLAGECEMDEVFDMG

SEQ ID NO: 11564 - DNA, 648 bp, Panicum virgatum
  misc_feature: Ceres CLONE 1746806-R
acctctgtggccatcaatgtcccaaagttagctgagggcattgaatatgggaggcaaccaatggtggcttcctccaccttggtagaactaacgactagattagatttcttcaaagagcggaggtcgcaactgatggaacaactccatagccttgatttaggacatgggtctgcttctcagggttttccattcaagccaccctctccttggaaccatccaaggtaggatgaccattcaattccatgattgtatattctttggtattgcttcttttccctgccaatcaattgtagaacactgcctatccgagtgtaaatctgtttgttcttcaatatggttttgctgtcgtgctgcgagtgggggatgtgatgtcttctgtatgtaatgttgtcatggaggcgcctcctagacaagtttttccagtgttgtggtgtatatgtattttgtgcgtcttctcatagaaactggataggctgacttttttttttttgagaaaaggataggctgactccttgtatggcccgtttgattcatacctagtgcaaaatgatgaggaaagcaggtatcacattgagggcatgttcccaccatgagtttataaataatacggtgaaggctcggaggttggagctgtgttttctcctcgcg

SEQ ID NO: 11565 - DNA, 766 bp, Panicum virgatum
  misc_feature: Ceres CLONE 1746844
  misc_feature: Encodes the peptide sequence at SEQ ID NO. 11566
aacatcgttgttagctagcgcaccgtgatcgacgatcaagaagaggaactgaccggcgatcgacggcggcggcccgccatggccgccggcgccgctcgcgtgctgccgtgtttgcgcgcatgcatgcagctcgggatggggagcgcggtggagacgctgtgcgggcaggcgtacggcgcgcacaagtacgacatgctgggcgtctacctgcagcgctccacggtgctgctcatggccacgggggtgccgctcgccgccctctacgccttctcccgccccatcctcgtcctcctcggcgagtccccggagatcgcgtccgccgccgccgtcttcgtctacggcctcgtcccgcagatcttcgcctacgccgccaacttccccatccagaagttcatgcaggcgcagagcatcatggcgcccagcgcctacatctccgccgccacgctcgccgcccacctcgtcctcagctacctcgtcgtctaccagctcgggctcggcctcctcggggcctcgctcacgctcagcttcagctggtgggtcatcgtcgccgcgcagttcgtctacatcgccaccagccgccgctgccgcctcacctggaccggcttctcctggcaggccttctccggcctccccatcttcttcaagctctccatcgcgtccgccgtcatgctctgcctcgagacctggtacttccagatactcgtgctcatcgccggcctgctcaaggaccccgagcttgcattgtcgtcactctctgtctgcatga

SEQ ID NO: 11566 - protein, 229 aa, Panicum virgatum
  misc_feature: Ceres CLONE 1746844
  misc_feature (2)..(132): Pfam Name: MatE Pfam Description: MatE
MAAGAARVLPCLRACMQLGMGSAVETLCGQAYGAHKYDMLGVYLQRSTVLLMATGVPLAALYAFSRPILVLLGESPEIASAAAVFVYGLVPQIFAYAANFPIQKFMQAQSIMAPSAYISAATLAAHLVLSYLVVYQLGLGLLGASLTLSFSWWVIVAAQFVYIATSRRCRLTWTGFSWQAFSGLPIFFKLSIASAVMLCLETWYFQILVLIAGLLKDPELALSSLSVCM

SEQ ID NO: 11567 - DNA, 644 bp, Panicum virgatum
  misc_feature: Ceres CLONE 1746844-R
gtcgcctacgtcaatgtcggctgctactacatcgtcggcatccccctcgggtgcctcctcgggttctacttcgacctcggagcggcgggtatttggggcggcatgatcgggggcacactgatgcagaccttgatcctggtgtgggtgacattcaggaccaactgggagaaagaggtggaagaagcgcagaaaagactgaacaaatgggaagacaaatctgctcctcagttgttggagtaagctagagtggaataaatcttcctcatcgatctactgccaaccgaagaatgggacatggatgcggtcctctacgtactactggaccaacggttgaacgaagccgggaaagaactgtaaggttgcgccattcatctgctcagcgaagaaggaattttgatgcgagctccaggcgtcgaggacctcgtggccagcgattctgctgcgtcgaatgttcaatggaagtacctgttcctctcaagaaagtcagtgttaagtaccagataattctgtagcgctcatttcgctttatttgtgttcccatctgttgtttagcgatgtgattgtgtatgaaccagtattagttttcttgtcgagctttcctcagacaaacttgttgagaaatggttatatgcgattgcttggcc

SEQ ID NO: 11568 - DNA, 1910 bp, Panicum virgatum
  misc_feature: Ceres CLONE 1746885
  misc_feature: Encodes the peptide sequence at SEQ ID NO. 11569
atgtctgcatcgatctgaccttgggtaggcgcacgcgatgggtcgataagtacacccttcgtgcatcaatactggccacagctagtagatcaagcaagcattgcgtggcctcgtctctgcagtgtgcagcaataatggaggtgccaccgccatggctgtcctccctcgcggtcctgctggtcaccgccctcttcctcgcggcggccgtcctccgccggcgaggagtgcgcaacaagcggcgctacaacctcccgccgggcccccggccgcggccggtgatcggaaacctgaacctgatcggcccgctgccgcaccagtccatccgcgagctctcggcgcggcacggcccgctcatgtcgctccggttcggctccttccccgtcgtcgtcggctcttccgtcgccgccgccgagttcttcctccggacccacgacctggcgttcctcgaccggccccgcatggcctgcggcaagcacaccgtctacaactactccggcatgctctggtcccactacggtgcctactggcgccagctccgcaagctgtggctgacggagctcctcagcgcccggcagctccggcggacggagcacgtccgcgccgaggaggtgcgcgccatgctgagcgacatccgccacgcggccggcggcggcggcgcggcggcggcgccggtggtggtcaaggagcacctgctcatggtgacgctcaacgtcgtgtcgcgcatggtgctgggcaagaagtacgtcggcgagcagcagggcgccggcgcggcggcggcgacgccggaggagttccggtggatgatcgaggagatcttcttcctcaacggcgtgctccacatcggggacatggtcccgtggctcggctggttcgaccccaacgggtacatcccccggatgaagcggctggccaagatgttcgaccggttcgtcgagcacgtcctgcgcgagcacgaggaccgccgccgccgcgagggcccggcgttcgtgcccgccgacatggtagaccagctgctgcagctcgccggcgaccccagcctcgacgtccccatcgaccgcgacggcgtcaaggcatccattctggagctcatcaccggcggcacggacacgtcgtcggtgacggtggagtgggccatgtcggaactcctgcggaggcccgaggtcctcgccaagctcaccgaggagttggaccgcgtggtcggccgcggccggctggtggccgaggaggacatgccccgcctcccctacctggacgccgtcgtgagggagacgatgcggctgcacccggtggtgccgctcctgatcccgcgggtgtcgcgcgaggacacggcggtgggcggctacgacatcccccggggcacgcgcgtgctcgtcaacgtctgggccatcggccgcgacccggcggtgtggggggacgcggcggaggagttccggccggagcggttcgtcgtcgccggcggcgaggcggcggacgtgaaggggcaggacctgcggctgctgccgttcggggccggccgtcggatgtgccccgcccacgggctcgggctcaggatggtgcagctggtgctcgcgaacctgatgcacggcttcaagtggaggctccccggcggcgtgccgccggaggagctgagcatggaggagaagttcgggatctccgtgtcgcgcatggaccagctcaaggccatccctgagcccaggctcccggagcacctctactagttcgatcgggtgcattgtccctctgcctggctcctgccaccgtgtcacaatgtggtgtagagtatgtacacgtattcggtatatcgtacatgggtgccatcgtgttacgtgtccgtatatggatgtatgtgccaatgttgtatttcgaaacaaaataagtgtgaccatatagaaatcttttgtagttgtgct

SEQ ID NO: 11569 - protein, 527 aa, Panicum virgatum
  misc_feature: Ceres CLONE 1746885
  misc_feature (40)..(516): Pfam Name: p450 Pfam Description: Cytochrome P450
  misc_feature: SWISSPROT Homolog: EC 1.14.13.21 Flavonoid 3'-monooxygenase
  misc_feature: Useful for making plants with altered carbohydrate content
MEVPPPWLSSLAVLLVTALFLAAAVLRRRGVRNKRRYNLPPGPRPRPVIGNLNLIGPLPHQSIRELSARHGPLMSLRFGSFPVVVGSSVAAAEFFLRTHDLAFLDRPRMACGKHTVYNYSGMLWSHYGAYWRQLRKLWLTELLSARQLRRTEHVRAEEVRAMLSDIRHAAGGGGAAAAPVVVKEHLLMVTLNVVSRMVLGKKYVGEQQGAGAAAATPEEFRWMIEEIFFLNGVLHIGDMVPWLGWFDPNGYIPRMKRLAKMFDRFVEHVLREHEDRRRREGPAFVPADMVDQLLQLAGDPSLDVPIDRDGVKASILELITGGTDTSSVTVEWAMSELLRRPEVLAKLTEELDRVVGRGRLVAEEDMPRLPYLDAVVRETMRLHPVVPLLIPRVSREDTAVGGYDIPRGTRVLVNVWAIGRDPAVWGDAAEEFRPERFVVAGGEAADVKGQDLRLLPFGAGRRMCPAHGLGLRMVQLVLANLMHGFKWRLPGGVPPEELSMEEKFGISVSRMDQLKAIPEPRLPEHLY

SEQ ID NO: 11570 - DNA, 2397 bp, Panicum virgatum
  misc_feature: Ceres CLONE 1746903
  misc_feature: Encodes the peptide sequence at SEQ ID NO. 11571
agtgatccccaacccccacccccatgcccagccgctctcgcccatactggagtgctcgctgagctcgtgatcctactctcgtcgccacaagttacgattcgggtcttggtctgtctcgagcagccatcgggatcccttccttcgtccttggttcagagttactgttgggacttgtgtgccggttcctcgggtggttcgacgagatgtgcacgggccatgtttgacgaagtgagtgtgagaagctctgctgcatgatagtggccatccttgggctggtcatggtggattgagaacccggtattggttcctgagcatgtccatgtcggagaagaccgtcgtttggttcaggagagacctcaggattgacgacaacccggccttggccaccgcggcgaaggagggcgctgtcctccctctcttcatatggtgcccggctgactacgagcagtattacccgggaaggtgctccaggtggtggctcaagcagtcgcttacccacctcgggaagtcactggagtcgctcggctgcccgctcgtcctgatccatgctaagaatagcgctcttgcagctcttttggagtgcatccattccaccggtgccactagagtggtttataattgtctttatgaccctatttcacttgtgcatgacaacaaaatcaagaatgagctttcagcccttggaatttctgtccaaagtttcaatggtgatctactctacaagccatgggaagtttatgatgagaatgggcaggcattcacaacctttaacatgtactgggagaaatgcatggatctgccaatagagatatcgcaatctcttgcacctgtgaggctagtgccagtgccaggtatagagaatatccgtggttgttccattgatgatctaggtcttgaatctagtaaggatgaggaatcaagcaatgctttgctaagcagggcgtggtctcctggttggcgcaatgcagagaatatgcttgaggaatttgtgtcttatggtctcctggaatattcaaaacatggcatgaaggttgggggaactacaacatcattgttatcaccatatctccattttggtgagttgagtgtaatgaagatttatcaactcgttaaaatgcatcaagtcaagtggcaaaatgaaggaaaatctgaagctgaggagagtgttcgattgttcctacgatcaattggttttcgggaatactcacgttacttgtgttttaacttccctttcacacacgaaagatcattgctgggtaacttgaagcattatccctggcgatcagacgaggacagcttcaaatcttggagacagggaatgacaggatacccattggtagatgctggcatgagggaactctgggctactggttggatacataataggataagagtgatagtctcaagttttgctgtaaaatttctacaaataccatggatttgagggatgaagtacttttgggatgtgcttttggatgcggacctagaaagtgatattcttggttggcagtacatatctgggagtttgcctgatggccatgagctcagccgtcttgataatccagaggttcagggtcaaaaatacgatccagatggtgaatatataagaacttggattcctgagcttgctagaatgccaacaaaatggatccattgcccatgggatgctcctagctctatattagaagttgctggagttgaattgggctttaactacccgaagcccatagtagaacttcatatggcacgggaaagcttagatgatgcgatctccacaatgtggcaattggacacagctgcaaaacttgctgaactagatggtgaaattgtggaagacaatatgaataatatcaggagttttgatatcccaaaagttgttttgaagaaagaattatctccaagtacttcgtccatcaatcgaaggatgccatatactagtggccagaagaaaaagttacagcctatggaagtgaaggtcccgtacaaacagattattcgagatggtgtgatgaatgcctcaaacatggaagacacaggctctatagctaactcgcaaatgtcaaggaaaagatctagcagtgatagtgcgtccaatggtccctcgtgttcatcttcattaatcatgcattcacagattcatgatcgtgacagttctttagttctgtattcagactacctccagcaaaaagcaggcagaaatggtgctggtaaggttgaagataatgacagtgaagatagtggtgcgagtatctctaggccatccaagagagctgcttagcagtaacgtgtgtgacaacggaattgtaaatctgtaataagaaatctttgctgtcacaagtttacaattagcatgacacttgatacctttatacagctgtagcacgcaactttttgttc

SEQ ID NO: 11571 - protein, 376 aa, Panicum virgatum
  misc_feature: Ceres CLONE 1746903
  misc_feature (5)..(176): Pfam Name: DNA_photolyase Pfam Description: DNA photolyase
  misc_feature (212)..(376): Pfam Name: FAD_binding_7 Pfam Description: FAD binding domain of DNA photolyase
  misc_feature: SWISSPROT Homolog: EC 4.1.99.3 Deoxyribodipyrimidine photo-lyase
  misc_feature: Useful for making plants with modulated light quality response
  misc_feature: Useful for making plants with modulated light quality sensitivity
  misc_feature: Useful for making plants with modulated low light sensitivity
  misc_feature: Useful for making plants with modulated nitrogen use efficiency
MSMSEKTVVWFRRDLRIDDNPALATAAKEGAVLPLFIWCPADYEQYYPGRCSRWWLKQSLTHLGKSLESLGCPLVLIHAKNSALAALLECIHSTGATRVVYNCLYDPISLVHDNKIKNELSALGISVQSFNGDLLYKPWEVYDENGQAFTTFNMYWEKCMDLPIEISQSLAPVRLVPVPGIENIRGCSIDDLGLESSKDEESSNALLSRAWSPGWRNAENMLEEFVSYGLLEYSKHGMKVGGTTTSLLSPYLHFGELSVMKIYQLVKMHQVKWQNEGKSEAEESVRLFLRSIGFREYSRYLCFNFPFTHERSLLGNLKHYPWRSDEDSFKSWRQGMTGYPLVDAGMRELWATGWIHNRIRVIVSSFAVKFLQIPWI

SEQ ID NO: 11572 - DNA, 771 bp, Panicum virgatum
  misc_feature: Ceres CLONE 1746947
  misc_feature: Encodes the peptide sequence at SEQ ID NO. 11573
atcttctccccgccgaagaacccccagtccgtgataatctcgcacttgccttcgccccggtcggccatggctctccaggcggcgacgtccttcctcccctcggccctctccgcgcgcaaggaggggtcggtgaaggactcggcgttcctgggtgttcgtctcgcggatggcctcaagctggagaccagcgctctgggccagcgcgccaagagggtgagcacgtcggtggccatccgcgcgcagacggcggcggtgtcctccccgtcggtgacccccgcgtcgccgtcgggcaagaagaccctccgcaagggcaccgcggtcatcaccggcgcgtcgtcgggcctcggcctggccacggcgaaggccctggcggagaccggcaagtggcacgtcatcatggcgtgccgcgacttcctcaaggcgtcgcgcgcggccacggcggcgggcatggacaagggcagctacaccatcgtgcacctggacctggcctccctggacagcatccgccagttcgtgaagaacgtgcggcagctggagatgcccatcgacgtggtggtgtgcaacgccgccgtgtaccagcccaccgccaaggagccgtcctacaccgccgacggcttcgagatgagcgtcggcgtcaaccacctcggccacttcctcctcgcccgcgagctcctcagcgaccttcagtcctccgactacccctccaagcgcctcatcatcgtcggctccatcaccgggaacacgaacacgctggccgggaacgtgccgccg

SEQ ID NO: 11573 - protein, 234 aa, Panicum virgatum
  misc_feature: Ceres CLONE 1746947
  misc_feature (82)..(230): Pfam Name: adh_short Pfam Description: short chain dehydrogenase
  misc_feature: SWISSPROT Homolog: EC 1.3.1.33 Protochlorophyllide reductase
MALQAATSFLPSALSARKEGSVKDSAFLGVRLADGLKLETSALGQRAKRVSTSVAIRAQTAAVSSPSVTPASPSGKKTLRKGTAVITGASSGLGLATAKALAETGKWHVIMACRDFLKASRAATAAGMDKGSYTIVHLDLASLDSIRQFVKNVRQLEMPIDVVVCNAAVYQPTAKEPSYTADGFEMSVGVNHLGHFLLARELLSDLQSSDYPSKRLIIVGSITGNTNTLAGNVP

SEQ ID NO: 11574 - DNA, 667 bp, Panicum virgatum
  misc_feature: Ceres CLONE 1746975
  misc_feature: Encodes the peptide sequence at SEQ ID NO. 11575
ccttgctccgttactggtgatcgagtgactggagccctccaaagcccagcactatttcttctccccctcctcgagcctctccccctctcatcacgccactcgcctctccccctcctccccctcactctctctcgccactgctactcccaaggctctagctgctagctcgtactagaacgagcactgtctcacttgctcgcctcaaggaactgcccagtgccgggttaagtaccacgccgtacggttagctctagtgcccgcgatggcgtcggagtgggaaatggccatgggggtggagctcggcatgggcatgggcacgtaccacgcccaccaccacaacgcctccagcatcaccgccgcgccgatgagcagccaccacagtggtgccgccagcttcgccgcgccgcaccaccaccattactacgggatgccgcccatgggcgatgccatgcgggtcgacgagctcctcgacctctccaccggcgccggcgcccacgacttcttcctcaccgccgccgccgcggcggccacggacaacgggcatcactcggcggccatgggtgagccgtcgcccaccgccaactcgtcggatcaccagacgtcgctcctctccttcgcagacgagttttacatacccagcgaggaagctgcggagctggagtggcta

SEQ ID NO: 11575 - protein, 134 aa, Panicum virgatum
  misc_feature: Ceres CLONE 1746975
  misc_feature: The sequence is a functional homolog of SEQ ID NO 607 in the 10/374,780 US patent application
MASEWEMAMGVELGMGMGTYHAHHHNASSITAAPMSSHHSGAASFAAPHHHHYYGMPPMGDAMRVDELLDLSTGAGAHDFFLTAAAAAATDNGHHSAAMGEPSPTANSSDHQTSLLSFADEFYIPSEEAAELEW

SEQ ID NO: 11576 - DNA, 634 bp, Panicum virgatum
  misc_feature: Ceres CLONE 1746975-R
  misc_feature: Encodes the peptide sequence at SEQ ID NO. 11577
cagcggcagccgcggcaagaagagcccgggccccggcgggcccgcgccggaggtgggcatggagggcggcgtgcggcggtgcacgcactgcgcgtcggagaagacgccgcagtggcggaccgggccgctgggccccaagaccctgtgcaacgcgtgcggcgtgcggttcaagtccgggcgtctgatgccggagtaccggccggcggccagccccacgttcgtgctgacgcaccactccaactcgcaccgcaaggtcatggagcttcgccgccagaaggagctgatcctgatccgcggcagccaccgcgacgcggccgcggcagcggcggcggcggcagggtccgccgggccgaggccggagctcatgttccgcgactacggcgtgtgttgatagctagccagccggccggagagaggcccgggccggggagctggccgtgcattgcatgcgcggagccctctagatccttttgcgaacgaaattctgccgccgtttcttcttttctttcttcgatcgccatgcgtattccagatttttttttcctttctccttttgttaattacaattaaattgttggtacctactactccctgcttccaagctctatgagagatcaatgaattctgttggtat

SEQ ID NO: 11577 - protein, 129 aa, Panicum virgatum
  misc_feature: Ceres CLONE 1746975-R
  misc_feature (27)..(62): Pfam Name: GATA Pfam Description: GATA zinc finger
  misc_feature: The sequence is a functional homolog of SEQ ID NO 607 in the 10/374,780 US patent application
  misc_feature: The sequence is a functional homolog of SEQ ID NO 1655 in the 10/374,780 US patent application
  misc_feature: The sequence is a functional homolog of SEQ ID NO 1657 in the 10/374,780 US patent application
  misc_feature: The sequence is a functional homolog of SEQ ID NO 608 in the 10/374,780 US patent application
SGSRGKKSPGPGGPAPEVGMEGGVRRCTHCASEKTPQWRTGPLGPKTLCNACGVRFKSGRLMPEYRPAASPTFVLTHHSNSHRKVMELRRQKELILIRGSHRDAAAAAAAAAGSAGPRPELMFRDYGVC

SEQ ID NO: 11578 - DNA, 771 bp, Panicum virgatum
  misc_feature: Ceres CLONE 1747128
  misc_feature: Encodes the peptide sequence at SEQ ID NO. 11579
tccacgtggtcgacctcgacatcatgcagggcctgcagtggccgggcctcttccacatcctcgcctcccgcccgcgcaagccgcgctcgctccggatcaccaggctcggcgcctcgctcgacgtcctcgaggccacgggccgccgcctcgccgacttcgcggcctcgctcggcctgcccttcgagttccaccccatcgaggggaagatcgggcacgtcgcggacgccgcggcgctgctcggcccgcgccaccaccaccaccaccaccaccacgaggccaccgtcgtgcactgtttgcaccactgcctctacgacgtgacggggtcggacctgggcacggtgcggctgctcaggagcctgcgcccgaagctcatcaccatcgtggagcaggacctgggccacagcggcgacttcctcggccggttcgtggaggcgctgcactactactcggcgctgttcgacgcgctgggcgacggcgccggcgccggcgcggcggcggaggagtccgccgagcgccacgccgtggagcggcagctgctgggcgcggagatacggaacatcgtggccgtgggcggacccaagcggaccggggaggtgcgcgtggagcggtggggcgacgagctgcggcgcgccgggttccggccggtgtccctggccgggagccccgccacgcaggccaggctgctcctcggcatgtactcgtggaaggggtacacgctggtggaggaggacgcgtgccctcagctcggctggaagacctctccctgctcac

SEQ ID NO: 11579 - protein, 256 aa, Panicum virgatum
  misc_feature: Ceres CLONE 1747128
  misc_feature (1)..(167): Pfam Name: GRAS Pfam Description: GRAS family transcription factor
  misc_feature: The sequence is a functional homolog of SEQ ID NO 438 in the 11/435,388 US patent application
  misc_feature: The sequence is a functional homolog of SEQ ID NO 431 in the 11/479,226 US patent application
HVVDLDIMQGLQWPGLFHILASRPRKPRSLRITRLGASLDVLEATGRRLADFAASLGLPFEFHPIEGKIGHVADAAALLGPRHHHHHHHHEATVVHCLHHCLYDVTGSDLGTVRLLRSLRPKLITIVEQDLGHSGDFLGRFVEALHYYSALFDALGDGAGAGAAAEESAERHAVERQLLGAEIRNIVAVGGPKRTGEVRVERWGDELRRAGFRPVSLAGSPATQARLLLGMYSWKGYTLVEEDACPQLGWKTSPCS

SEQ ID NO: 11580 - DNA, 2879 bp, Panicum virgatum
  misc_feature: Ceres CLONE 1747171
  misc_feature: Encodes the peptide sequence at SEQ ID NO. 11581
tcgcgtcgcgtgggaagccaccgctgaccgcccaggctgcgcagccagcgaagcagctcgctacgacgccacctacctctcccggtgtccgtcccccgccgcggatccggctgccctctccggcgggacccccgtcccgcgccgggccgggtgcggactgcggagggggggagcgcgatggcgacgcacgagcggaagacgatcgatctgaagcaggggtgggatttcatgcagaagggcgtcaccaagctcaagaacatcctcgagggcaagcccgagccccaattcagctccgaggactacatgatgctctacacgacgatttacaacatgtgcacgcagaagccgccgcacgactactcgcagcagctctacgagaagtaccgcgagtcgttcgaggagtacatcacgtccatggtcttaccttccctaagggagaagcatgatgaatttatgttgagagagctagtaaaaaggtggtcaaaccataaagtaatggttcggtggctgtcacgcttcttccattatcttgatcggtacttcatttcccgaagatcactaccgccgcttagagaagttgggcttagttgtttcagagacttggtatatcaagagatcaaaggaaaagtaaaaagtgcagtcatatctttgattgaccgagaacgtgaaggtgaacaaatagatagggccctgttgaagaatgttctggatatatttgttgaaattggtttgggtagtatggagtgctatgaaaatgattttgaagatttcctgcttaaagatactgccgattactactctatcaaggcccaaacctggatccttgaggattcttgtccggattatatgttaaaggctgaagaatgcctgaaaagggaaaaggaacgagttgcccattatttgcattctagcagtgagcagaagttattggagaaagtgcagcatgaactgctaactcagtatgcaagccaactcttggagaaggagcattctgggtgtcatgcactacttcgtgatgacaaggttgaggatttgtctaggatgtatagactcttttccagaataactcgtggcctagaacctgtttctcagatatttaagcagcatgttactaatgagggcacagctttagtcaagcaagcagaagatgctgctagcaataagaagacagagaagaaggacatggttggtttgcaagaacagatttttgtacggaaaatcattgagctgcatgacaagtatgtagcatatgttacggactgtttccagggccacacactctttcataaggcccttaaagaggcttttgaggttttctgcaacaaaggtgtttctggtagttcaagtgctgaattgctagccacattttgtgacaatattttaaagaaaggtggcagtgaaaagcttagcgatgaagcaattgaagatacccttgagaaggtggtaaggctgcttgcatacatcagcgataaggatttgtttgctgaattttacagaaagaaacttgcgaggagattactttttgacaagagtgctaatgatgagcatgaaagaagcatcctgaccaaactaaaacagcaatgcggagggcaattcacttcaaaaatggagggcatggttactgatttgactgttgcaagagaccatcaaacaaaatttgaagagttcataagcagccatccggagctgaatcctggaatagatttagctgttactgttctgacaacaggattctggccaagctacaaatcttttgatattaatctgccttctgaaatggtgaaatgcgtagaggttttcaaagagttttaccaaacaagaacaaagcaccggaagcttacctggatatattccctgggaacctgtaatatcagtgctaagtttgaggccaaaactattgagctcattgttacaacttatcaggctgcattgctgctgctatttaatggagctgacaggcttagctattctgagattgtgacacagctaaacctctcagatgatgatgttgttcgccttctccattctctttcttgtgcaaagtacaagattcttaacaaagaacctagtaataaatctatttcaccaaatgatgtctttgagtataattcaaaatttactgacaagatgcggagaataaaggtacctcttcctccagttgatgagaagaagaaagtagttgaagatgttgacaaagatcgtaggtatgcaattgacgcatccattgtgcgcattatgaagagcaggaaagttttgggtcatcaacaacttgtattggaatgtgtggaacagcttggtcgcatgttcaagccggacttcaaggcaataaagaagcggattgaggatcttatcacaagggattacttggagagggacaaagataacccgaatgtgtacagatacctggcttgatcaatccactgtctggtcctgcgacgcttgcctgagactgatttgtttgttgtgtggtgtttgccacaattatcggcaatgccagcatgggcatttctctgttgtacatccagctgggctagtgcttggcctgtcttcgatggagacgacagcgatgaagattggcagatgggccagtgcaaggcatgcggccattttgtaagttgtaacaccatctatttgatcttgtactatttgttgtattttctcccccaagctttattttatttcaatcggtagcctaggtaattgtttagattgtcatgcgatgcggtgcaccgttctgctcagagtgcagtaagatgccaatcttgtatatgttgtgaatcgtgtcttgtatagttgctggaaatgccggttgtaacagtcacaagtatggctctttccttgtatatcaaacttccttaatccttaccatacgagtagag

SEQ ID NO: 11581 - protein, 744 aa, Panicum virgatum
  misc_feature: Ceres CLONE 1747171
  misc_feature (15)..(648): Pfam Name: Cullin Pfam Description: Cullin family
MATHERKTIDLKQGWDFMQKGVTKLKNILEGKPEPQFSSEDYMMLYTTIYNMCTQKPPHDYSQQLYEKYRESFEEYITSMVLPSLREKHDEFMLRELVKRWSNHKVMVRWLSRFFHYLDRYFISRRSLPPLREVGLSCFRDLVYQEIKGKVKSAVISLIDREREGEQIDRALLKNVLDIFVEIGLGSMECYENDFEDFLLKDTADYYSIKAQTWILEDSCPDYMLKAEECLKREKERVAHYLHSSSEQKLLEKVQHELLTQYASQLLEKEHSGCHALLRDDKVEDLSRMYRLFSRITRGLEPVSQIFKQHVTNEGTALVKQAEDAASNKKTEKKDMVGLQEQIFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQTKFEEFISSHPELNPGIDLAVTVLTTGFWPSYKSFDINLPSEMVKCVEVFKEFYQTRTKHRKLTWIYSLGTCNISAKFEAKTIELIVTTYQAALLLLFNGADRLSYSEIVTQLNLSDDDVVRLLHSLSCAKYKILNKEPSNKSISPNDVFEYNSKFTDKMRRIKVPLPPVDEKKKVVEDVDKDRRYAIDASIVRIMKSRKVLGHQQLVLECVEQLGRMFKPDFKAIKKRIEDLITRDYLERDKDNPNVYRYLA

SEQ ID NO: 11582 - DNA, 2204 bp, Panicum virgatum
  misc_feature: Ceres CLONE 1747187
  misc_feature: Encodes the peptide sequence at SEQ ID NO. 11583
actcactgctcgctcactcttcccaccatactcgctagtgaccagaccagtgagctagtgactgtaccatgcagctctagcttagctagcgagtctggtggtggcagtgggttggtaggagtggcagccccaagtgtgtggccgggctacgggcggcagcagcagcagcagcgcgcgcggggacgcccgagcaggctgcgacggcgagcaggaggagccagctgccccgccgggcgccgccggcaatgtcgccgcctccctcgccgctgctgcgcgaccaactgtcgcgccggacggcggtgctggggctgcgcctgtgggtgctcctcggcatcgcggtcggggccgccttcctgctgctcctcgcgctcatctccctccacctggccgcggcgcgccggaggcggcccaggaagggcgtcgcgcgcgtgcccgcgcccacgcacgcgccggcgggggcgccgctgtccccgtccaccatcccgcccgtgtccaaggagatccaggaggtggccgtccacgtcggttcgctccgccactacctcgagatgggccacgcgttcctcaaggacggcggcgccgcgcagcaccacggcgacggcgacggggactccgtggggcccgccaccgcgcacgggtcgcagcgcgtgcacatcgaggccagcaagggccgccgcatggtcgcgtgcgccgacggggaggtcggccccgtggcgtccgacgtgtcggcggcggccgcgtgcggccccgaggtgtcgcacctcgggtgggggcactggtacacgctccgggagctggaggaggccaccgccgccttcgcgcccgagcacgtcgtcggcgagggcggctacggcatcgtctaccgcggcgtcctcgccgacggctaccaagtcgccgtcaagaacctcctcaacaacagggggcaagccgagagggagttccgggtggaggtggaggcgatcggccgcgtccggcacaagaatcttgtccggctgctgggctactgcgccgagggcgcgcaccggatactcgtctacgagtacgtcgacaatggcaacctcgagcagtggctgcacggcgacgtcgggcccgtgagcccgctcacctgggacatccggatgggcatcgtgctcggcatggcgaaagggatcacgtacttgcacgaggggctggagccgaaggtggtgcacagggacatcaagtcgagcaacattctgctggacaggaggtggaaccccaaggtctcggacttcggcctcgccaagctcctgggttcggacagcaactacgtcaccaccagggtgatgggaacttttggttatgtggcgccagagtacgcgagcaccggcatgctgaacgagaggagcgacgtgtacagcttcgggatcctcatcatggagatcatctccggccgaagcccggtcgactacgcgaggcccgccggagaggttaacctcgtggagtggctcaagaacaaggtgaccaacagggactacgaagcgatcctggacccgaagctgccggagaagccgtcctccaaggcgctgaagaaggccctcctggtggcgctgaggtgcgtggatcccgactcgcagaaacggccgaagatggggcatgtaatccacatgctcgaggtcgacgacttcccgtatcgagaggatcgccggagtctacggccgggcaacggcagccccctggagagggcgaggacgccggggaggccggcggtggcggggtcctgcgacagcagctgctacgagggcaacgcgaccaccgccagcacgccgtccaggctagtccaggacatgtaaagccagcgctgccccacgcacgcgtccgctgggctcctgatcgacctctgcttctgcctgccggccgcacggggatgctgcgggtctgttctatcggtgccgttttgatctgcttctccctccctctgcctcgtcgtcggcgcataatttttttttcctttcccggaggcatggctgcctcccttctctaggttttgaactcatctaccgtgattgacctagatttgctgggtgttgccgaactgtctgtatagtgaagcgctctcatctcaggccgcgagtccggctgttcgttcgttgattcattcccgtgatgaactgatggtgtacaaaagcgtgggaacgagtgactctctgtgtcttggtttgtccttgaagcttcggttcatgtgt

SEQ ID NO: 11583 - protein, 521 aa, Panicum virgatum
  misc_feature: Ceres CLONE 1747187
  misc_feature (191)..(462): Pfam Name: Pkinase Pfam Description: Protein kinase domain
  misc_feature: SWISSPROT Homolog: EC 2.7.11.1 Non-specific serine/threonine protein kinase
MSPPPSPLLRDQLSRRTAVLGLRLWVLLGIAVGAAFLLLLALISLHLAAARRRRPRKGVARVPAPTHAPAGAPLSPSTIPPVSKEIQEVAVHVGSLRHYLEMGHAFLKDGGAAQHHGDGDGDSVGPATAHGSQRVHIEASKGRRMVACADGEVGPVASDVSAAAACGPEVSHLGWGHWYTLRELEEATAAFAPEHVVGEGGYGIVYRGVLADGYQVAVKNLLNNRGQAEREFRVEVEAIGRVRHKNLVRLLGYCAEGAHRILVYEYVDNGNLEQWLHGDVGPVSPLTWDIRMGIVLGMAKGITYLHEGLEPKVVHRDIKSSNILLDRRWNPKVSDFGLAKLLGSDSNYVTTRVMGTFGYVAPEYASTGMLNERSDVYSFGILIMEIISGRSPVDYARPAGEVNLVEWLKNKVTNRDYEAILDPKLPEKPSSKALKKALLVALRCVDPDSQKRPKMGHVIHMLEVDDFPYREDRRSLRPGNGSPLERARTPGRPAVAGSCDSSCYEGNATTASTPSRLVQDM

SEQ ID NO: 11584 - DNA, 2426 bp, Panicum virgatum
  misc_feature: Ceres CLONE 1747205
  misc_feature: Encodes the peptide sequence at SEQ ID NO. 11585
gtcacgctcccctcgtccccgtctctgcctgccgccccttcccttgcatacttgcatctcgctctcctcgcagtcgcatcgcagtgccgcccgcgcgagcttttactcctactccatcccctccctttgctacttttggggacctctaggcctctccaatccagagaaccaaaaaggagagagagagagagaccgagaaaaagttccctcctcctcagccttgcgctcacccccgtcctcccacatccgattgttctctgcgcttcttggatcctagatttggtcgaccggcggcggcggttccgggagctgagaaagactggatttttctgcccatggaggcgtggcctgatccgttcaggcccgggcgctggagtggctccctgaccaggtccgattcgtattggttcaaatgatctgggcagcctgattggttggttggttggttggttccgccagggggatcggagctagggtgtgggttcttggctgtctgggcagtgggttcgtcagcttgggtctggtgagatcttggggttgttggttcagctcaggagccgcaggtctgcgtagatcccttctttgcttccgtggctgatttgtactgctagggttttggttgcctattgtggaagatgattaagcagatccttggccggctgccgaggaagccagggaaggctggggatagccgggatgctgctgctggggtggctgcggggaacggtacagagccgtcgaattcttacagtgttgccaggagcgtggactcggggaacaagagggctggaaatggggattactcagtgccacctggggtaactcctaacccggtgatgaatggggctgtgctgtatcactccaatgagccgctgccagccttcaaggatgtggcagcgtccgagaagcagaatttgtttgtcaagaaggtgaacctgtgctgcgccgtgtatgacttcatggatccgacaaagaacctgaaggaaaaggaggtgaagcgccagacgcttatggagctggtcgattacgtcacttcagcaaatggcaagttctcggaggttgtcatgcaggagatcaccaagatggtgtcgattaacttgttccggagctccagccccgcgccccgtgagaacaaggccattgagggagttgatctggaggaggacgagcccctcatggaccctgcatggtcgcacttgcagattgtgtatgaggttttcttgaggtttgttgcatcgcaggagacagatgcaaagctcgccaagagatacatagatcattccttcattcttaggctactagatctttttgactcagaggaccccagggaaagggactatctaaagacaatacttcacagaatatatggtaaattcatggttcatcgcccattcatcaggaaagcaattaacaacatattctacaggttcatatttgaaacagaaaagcataatggtattgcagagctgttggagatcctgggcagtattattaatggttttgcccttcctcttaaggaagaacacaagttgttccttgttcgtgcattgatccctcttcacaagccaaagtgtgtatctatgtaccatcaacagctatcttattgcatcacacagtttgttgaaaaggactgcaaactttctgacacagttattaggggcttactgaaatactggcctgtgacaaacagttcaaaggaggttatgttcttgggtgagttagaagaggttttagaggcaacacagcttgcggagtttcaaagatgcatggttccactcttctgccaaattgcccgtagcatgaacagctcccattttcaggtggcagagcgagctctgtttctctggaacaatgaccatattgaaaacctgattaagcaaaactacaaggtgctattacctatcatctatccagcactcgagagaaacaccagagatcactggaaccaagctgttcgtagcctgacattgaacgtacgcaagatcttctctgatcatgattctgcattcttcggggagtgcgctcagaggttcaacgatgaggaacttaagcagcaggaaactgattcaaagcgagaagccctgtggaagcgcctagaggaaatggccacctcgaaactcggtgaaaacaatccctcgggcacacccaatggcaaatccagtcaagctgctggctaggacacccacagtaacagctgtagtcttgcaactctttgactcatgtgccctggaactcaggtggttgtgattttagtgctggaattttttgttggtgcgttggtttgcccctgttgtaggtgggtaggacgtgtttggtttcgtcagaactgtatgatcaaaatgtacacatacagaaggatttccaagagatttggcatgtgtagtgacattacatatagtccaataaacagcgtcgattttgattgc

SEQ ID NO: 11585 - protein, 513 aa, Panicum virgatum
  misc_feature: Ceres CLONE 1747205
  misc_feature (79)..(492): Pfam Name: B56 Pfam Description: Protein phosphatase 2A regulatory B subunit (B56 family)
MIKQILGRLPRKPGKAGDSRDAAAGVAAGNGTEPSNSYSVARSVDSGNKRAGNGDYSVPPGVTPNPVMNGAVLYHSNEPLPAFKDVAASEKQNLFVKKVNLCCAVYDFMDPTKNLKEKEVKRQTLMELVDYVTSANGKFSEVVMQEITKMVSINLFRSSSPAPRENKAIEGVDLEEDEPLMDPAWSHLQIVYEVFLRFVASQETDAKLAKRYIDHSFILRLLDLFDSEDPRERDYLKTILHRIYGKFMVHRPFIRKAINNIFYRFIFETEKHNGIAELLEILGSIINGFALPLKEEHKLFLVRALIPLHKPKCVSMYHQQLSYCITQFVEKDCKLSDTVIRGLLKYWPVTNSSKEVMFLGELEEVLEATQLAEFQRCMVPLFCQIARSMNSSHFQVAERALFLWNNDHIENLIKQNYKVLLPIIYPALERNTRDHWNQAVRSLTLNVRKIFSDHDSAFFGECAQRFNDEELKQQETDSKREALWKRLEEMATSKLGENNPSGTPNGKSSQAAG

SEQ ID NO: 11586 - DNA, 1753 bp, Panicum virgatum
  misc_feature: Ceres CLONE 1747223
  misc_feature: Encodes the peptide sequence at SEQ ID NO. 11587
aatagataacgtctcggtccacttcacactccgcttccctccttcctgccctgccatggcaacccccacggcttccgctctcctccacccctcccctctccctcctccgtctcttcgcctcccgccccgccacgtcgctgccccgggcgtccggcgcctcgcgcagcctctgcgcgccggccgcccgcgcctgcaggcgccgccgccagcgcctcccgcggcggaggaggtcgccgagcagcaggacgtcacgcctccgctcaggctgctcgagccgccgcaggaggaggaccccttcccgcccgagatggagcccgcggaccctgatttctaccggataggatacgcgcggatgatgcgcgcgtacgggattgagttcctggaagggccggacgggatgggtgtgtatgcttcccgggacgtggagccgctccgcagagctagagtaattatggagattcccttagagctaatgctgactataactcaaaagaaaccttggatgtttttccctgacattattccactaggtcatcctatattcgacattattgaatcaacagatccagagatggattgggatctaagattggcttgccttcttctctatgcatttgatatacaagacaacttttggcagttatatggtgattttttgccagggcctgatgaatgcactagtttgctgctggcaccgaaggaggatctgatggaactagaagatgaagatcttgcctcagaaatgttaaaacaccagcaacgagcaattgacttctggcaaaagcattgggacaaagcagttcctctaaagctaaaacgccttgcccgtgaccatgagagatttctctgggcactgagtattgttcagtctcgctctgtcaacttgaagatgagaatgggagcctttatccaagatgcaaatatcctagctccttatgccgatatgttgaaccactcacccaatgctaattgcttcctgcattggcgctttaaagatcgtatgctcgaagttatgattaaggctggacatgcaatcaagaaaggagatgagatgacaatagattatatgagtggagtaaacagcaaatttatggaaagatatggtttctcatcaccaacgaatccttgggaacttataaatttctcgagccctgcgaagattcacatggattcctttttatcagtcttcaatattgccggtttgcatgacgagctgtaccacaactccgcattgccctcagtagaaactaacttcgtggatggagctgttgtagcagcagctagagcattgccaacatggtcggatggtgatgtacctgcaataccgagtgtggagagaaaatctgctcaagtgttacaagaggagtgccgccaaatgttggattcattctcaactactattgaacaagaccagcagatcttagattccgatgtgcatatcagcaaaacgcgggaaattgcagtcaagtaccgtctgcaccggaagatgctcctgcagaagatcatcgagtcactggacatctatcaggacagaattttgttttagctgtataggcgctgctactttcagtagaacgtagaactaatatcagtttgtgtgttagtagacttggaatcattagatattggagggtttcgaaaggcagttgccacctcttttgtagaggattttgtagggctgccttctttgtatttctaggttaacactagaggatccccacaaactaaacaaaaatacagataattgtctttc

SEQ ID NO: 11587 - protein, 496 aa, Panicum virgatum
  misc_feature: Ceres CLONE 1747223
  misc_feature (98)..(344): Pfam Name: SET Pfam Description: SET domain
  misc_feature: SWISSPROT Homolog: EC 2.1.1.127 [Ribulose-bisphosphate carboxylase]-lysine N-methyltransferase
MATPTASALLHPSPLPPPSLRLPPRHVAAPGVRRLAQPLRAGRPRLQAPPPAPPAAEEVAEQQDVTPPLRLLEPPQEEDPFPPEMEPADPDFYRIGYARMMRAYGIEFLEGPDGMGVYASRDVEPLRRARVIMEIPLELMLTITQKKPWMFFPDIIPLGHPIFDIIESTDPEMDWDLRLACLLLYAFDIQDNFWQLYGDFLPGPDECTSLLLAPKEDLMELEDEDLASEMLKHQQRAIDFWQKHWDKAVPLKLKRLARDHERFLWALSIVQSRSVNLKMRMGAFIQDANILAPYADMLNHSPNANCFLHWRFKDRMLEVMIKAGHAIKKGDEMTIDYMSGVNSKFMERYGFSSPTNPWELINFSSPAKIHMDSFLSVFNIAGLHDELYHNSALPSVETNFVDGAVVAAARALPTWSDGDVPAIPSVERKSAQVLQEECRQMLDSFSTTIEQDQQILDSDVHISKTREIAVKYRLHRKMLLQKIIESLDIYQDRILF

SEQ ID NO: 11588 - DNA, 803 bp, Panicum virgatum
  misc_feature: Ceres CLONE 1747273
  misc_feature: Encodes the peptide sequence at SEQ ID NO. 11589
aatcgggaccagccctagccgcgccagcgccccgtcgtcccgcgccgccgcggggagcgcgcgacccgcgcgcgcggtgctgagggtggcggcggcggcgtccgttggtccggggaggaggaggagggccgcggcggcaatgcagccggcgaaggcggtggccctggaggcggggagcggcgcggctgtcgcggggttgccgaggcccgacgcgatggggaggttcggcaagttcgggggcaagtacgtgcccgagacgctgatgcacgcgctcaccgagctcgaggccgcgttccacgcgctcgccaccgacgacgagttccagaaagagcttgacggcatcctcaaggactacgtcggccgtgagagccccctgtacttcgcggagcgcctgaccgagcactacaagcgcgccgatggcacaggcccgctcatctacctcaagagggaggatctgaaccacaccggcgcccacaagatcaacaatgctgtcgcgcaggccttgctcgccaagcggcttgggaagcagcgcatcattgccgagaccggggctggccagcacggtgttgccactgccacggtgtgcgcccgttttgggctgcagtgcatcatctacatgggtgcccaagatatggagaggcaggcgctcaatgttttcaggatgaggcttcttggtgcagaggtcagggcagtgcattctgggacagcaaccctgaaggatgcgacttcggaggctatccgtgactgggtcactaacgtggagaccacacactacatcttgggctcggttgctggtccgcacc

SEQ ID NO: 11589 - protein, 267 aa, Panicum virgatum
  misc_feature: Ceres CLONE 1747273
  misc_feature (116)..(267): Pfam Name: PALP Pfam Description: Pyridoxal-phosphate dependent enzyme
  misc_feature: SWISSPROT Homolog: EC 4.2.1.20 Tryptophan synthase
IGTSPSRASAPSSRAAAGSARPARAVLRVAAAASVGPGRRRRAAAAMQPAKAVALEAGSGAAVAGLPRPDAMGRFGKFGGKYVPETLMHALTELEAAFHALATDDEFQKELDGILKDYVGRESPLYFAERLTEHYKRADGTGPLIYLKREDLNHTGAHKINNAVAQALLAKRLGKQRIIAETGAGQHGVATATVCARFGLQCIIYMGAQDMERQALNVFRMRLLGAEVRAVHSGTATLKDATSEAIRDWVTNVETTHYILGSVAGPH

SEQ ID NO: 11590 - DNA, 2329 bp, Panicum virgatum
  misc_feature: Ceres CLONE 1747285
  misc_feature: Encodes the peptide sequence at SEQ ID NO. 11591
ctggacaaaatcagctcccgaaatccaaaattgaaacaggtggttttgagcttggggcttgctcggaggaccgattttggagccggcgaagggatgtcaggacccctcgatcgatttgctaggccatgttttgaagggcttgtacataacgatgaaaggaaagagagcagatctgatgcagacaactcagaaggagataagaagacaaaaattggctctttcaagaaaaaagcaattaatgcagggaataaattcaggcattccttgagaaggagaagcaaaaagaaaaatgaacctagggattccatcaaggacataagggatattaaagagctccaagatgtcgagacatttcgacaatgcttaattgatgaggatttactgccacaacagcatgatgattatcacatgatgttgaggttcctaaaagcgcggaaatttgatgttgagaaagcaaagaatatgtggtcagacatgcttagatggaggaaggaattcgggaccgacaaaatagaggaatttgactacaccgagttagatgaagttacaaagtattacccacaattttatcatggggtggataaagagggtagacctatctacatagagttaataggaaaagttgatgcaaacaagctagttcaagtaacaaccatcgatcggtatgtgagataccatgtcaaggagtttgagagatgtttccagatgagatttccagcttgctcaattgctgcaaaaaaacacatagactcatctactactattttggatgtgcaaggagtgggtttcaagaacttctcaaaatctgcgagggaattagtcgcacgactgcagaagatcgatggtgataactacccagagacattgtgccgaatgtatataattaatgctggccaaggcttcaagatgttatggaacacaataaaatcgttccttgatccaaaaactgcttccaagatccatgttctcgggaataagtaccaacataagttgcttgaaattattgatgagtgtgaattgccggaatttcttggtggtaaatgcaagtgtgatgaatatggaggttgtcaaaaatctgacaaaggtccctggaaggatcccgaaataataaagagagttctcaatggcgaggcaaactacggaaggcaaattgtgactatatccagcactgatggaaagataattagttatgctaggccagagtacccagccagaaaaggcagtgatgcatctgctgagtctgggtctgaagtggaagacgtaacatctcctactgcatcaaggaatctgatcacacaccctattttgacccctgttcacgaggagttaaaattgccagcacatgctttggcatctgttgctcatgcttcaattgaaagcattcctgttgtggacaaggttgttgatgatggatggggtagtcccagagctagtctacacgtttcttcctcaggttcattttccttgagaaatttgcctggcacatttgaaggactccgagctcaaataatcacgtggctgacggtcttggtcatgaccctttttgccatgctctgttctgttccaagcaagatggctagaagaatctctaaccaatctgttaagcatgacgactatcatgttgagtatcctcaagaacaggagtacaaggaggagttccgacctccgtctcctgccccatcctataccgagaaggatgtgctttcatctatgctgagacggctaggtgagcttgaggacaaggtgcagatactggagacaaagccgtctgagatgccatttgaaaaggaagaattgctcaatgcagccgtccgccgtgtggatgcattggaggctgagttaatttccacaaagaaggccctctatgatgccttgatgcgacaggacgagctgctcgcgtacattgacaagcaagagctgatcaaatttcgtaagaagaagttctgcttctaagagctgggcgcggagcagctagctgttcttcacacgcagagccgttcgtgtatattggattgcggctaatgtgttgtatgtatgtatcaatgtatgtatattttgttggtccatagaagtttcaagtgtgtagttggtagtaaaagataggcgtgccgttgggtgcctgggtatctgatgtttcgggctcttcatgtctgttacacattcgacgagctaggacccgaaaggccaaggtgttttgtactgtatgctctaccccgtgaagaggtacctagcacttgctagcctaagctctgtaaccatggttgcatgtcgacgcaaagccgatcgcgtgctgacaataatgaatacactgtttgtgtgctgctgtttc

SEQ ID NO: 11591 - protein, 619 aa, Panicum virgatum
  misc_feature: Ceres CLONE 1747285
  misc_feature (156)..(342): Pfam Name: CRAL_TRIO Pfam Description: CRAL/TRIO domain
  misc_feature (78)..(140): Pfam Name: CRAL_TRIO_N Pfam Description: CRAL/TRIO, N-terminus
MSGPLDRFARPCFEGLVHNDERKESRSDADNSEGDKKTKIGSFKKKAINAGNKFRHSLRRRSKKKNEPRDSIKDIRDIKELQDVETFRQCLIDEDLLPQQHDDYHMMLRFLKARKFDVEKAKNMWSDMLRWRKEFGTDKIEEFDYTELDEVTKYYPQFYHGVDKEGRPIYIELIGKVDANKLVQVTTIDRYVRYHVKEFERCFQMRFPACSIAAKKHIDSSTTILDVQGVGFKNFSKSARELVARLQKIDGDNYPETLCRMYIINAGQGFKMLWNTIKSFLDPKTASKIHVLGNKYQHKLLEIIDECELPEFLGGKCKCDEYGGCQKSDKGPWKDPEIIKRVLNGEANYGRQIVTISSTDGKIISYARPEYPARKGSDASAESGSEVEDVTSPTASRNLITHPILTPVHEELKLPAHALASVAHASIESIPVVDKVVDDGWGSPRASLHVSSSGSFSLRNLPGTFEGLRAQIITWLTVLVMTLFAMLCSVPSKMARRISNQSVKHDDYHVEYPQEQEYKEEFRPPSPAPSYTEKDVLSSMLRRLGELEDKVQILETKPSEMPFEKEELLNAAVRRVDALEAELISTKKALYDALMRQDELLAYIDKQELIKFRKKKFCF

SEQ ID NO: 11592 - DNA, 1833 bp, Panicum virgatum
  misc_feature: Ceres CLONE 1747287
  misc_feature: Encodes the peptide sequence at SEQ ID NO. 11593
attcccctctccgactgaccggatctctccgagccccacccacgcagcctccatgctcgcctgatcttctcggccaccgtttcccgtccgccatggcctcctcctccaaggtcttaagccgcaccctgagctcctccttcctccgctcctgccgtctcacttctgcctccctccttccgaccgcttcccgccgccacccggtaccattcctctccctccgcttctgctccgccgcccccgcggctgtcgatgtcgccgctgaccctgccgtggcttctgtatcggccggccacccgtggccagagtggggcgagttcctcgacaagctgcgggccaaggggtacttcaaacaagttgtgcccgcctccggcgtgagcgctggcgagggcgccgccggaggtggggaggcgactaacgtggccacttatccttcaatggagcagaacagggtgaagaacgcgtgcctcatattcgcgcgcgaacgctacgatctcctaagttcccttcccaagcaggatattcaagctatcgtcgagtgcggctgtcccaataccaatagaaagtctgtcaatgctgcaaaaaagctgagacagtttctccaggtcgaagaaaaagatgcatgcggagtttgcaaatttcgtgaatcttgtaatagagctgatctagttccaatggccgaggaagcagttaggaccgttaatgttgttcgcatactgctagagtatgcaatagatacaaacaacctttcaggagaaaactctgttagtgaaagcgtgcaagaatctgcaagaaagcttctctccaagcttattatactgagtgacacaacaattgatccatctgttcctaaacctgtatttcaaacctctagtaagcagcagtcatcaaccaaactgtctgacaagagcaaaggggctcagggatcagttcggaaggggagagagacaaccgcagctgaaatgaagatgggtgattggctgtgcacgaattgcaatttcttaaattttgctcgaaatcggcactgccttgaatgcaaagcagatggaccgaagaaggtagcagcagccacaactgaaatgaaaatgggtgactggatctgtacacagtgtcactttatgaactttgctcgcaacaagatatgctttaaatatgaagaacctcgtccaaagaggcagctcaatcctggagagtgggaatgcccctcatgcgactatgttaacttccgacacaacaggatctgcaagaagtgcagccaggaccgccctgaggatgatacccagggtaaccagatggcactgaggaacacaagaggtgctggcaagagtaaaagttttgacttcagtgatcaggacagtgacaatgatggtgatgcctcaccctacaaagggttccgcaagcatgtggcaggcatgaggccgaaaccagaccagagaacctctgctaagaggagaggcgctgttgatctggatgatggtctccgcactgccaagcctagaagcctctaatgaagacgaggacaaggacatttcttcatatgaagcaccagcatgtgtgagcagaagggcaacgctgtcccggaagaggttcacagctgcctgaaaccagtgagaatacccggcctgcttggagctttgatgtctccgtgttcactttataacatttcgcagggcgcatactggttggtagaggactctgaaataatagggtgcctggaatctagagacagttttgataacgtcgttcttcgctctgcccagtcgcagacgagggacgctgcgaacatgttctatttgtaccgttattatacatattgttaaggaagacagttttgac

SEQ ID NO: 11593 - protein, 470 aa, Panicum virgatum
  misc_feature: Ceres CLONE 1747287
  misc_feature (291)..(320): Pfam Name: zf-RanBP Pfam Description: Zn-finger in Ran binding protein and others
MASSSKVLSRTLSSSFLRSCRLTSASLLPTASRRHPVPFLSLRFCSAAPAAVDVAADPAVASVSAGHPWPEWGEFLDKLRAKGYFKQVVPASGVSAGEGAAGGGEATNVATYPSMEQNRVKNACLIFARERYDLLSSLPKQDIQAIVECGCPNTNRKSVNAAKKLRQFLQVEEKDACGVCKFRESCNRADLVPMAEEAVRTVNVVRILLEYAIDTNNLSGENSVSESVQESARKLLSKLIILSDTTIDPSVPKPVFQTSSKQQSSTKLSDKSKGAQGSVRKGRETTAAEMKMGDWLCTNCNFLNFARNRHCLECKADGPKKVAAATTEMKMGDWICTQCHFMNFARNKICFKYEEPRPKRQLNPGEWECPSCDYVNFRHNRICKKCSQDRPEDDTQGNQMALRNTRGAGKSKSFDFSDQDSDNDGDASPYKGFRKHVAGMRPKPDQRTSAKRRGAVDLDDGLRTAKPRSL

SEQ ID NO: 11594 - DNA, 2392 bp, Panicum virgatum
  misc_feature: Ceres CLONE 1747492
  misc_feature: Encodes the peptide sequence at SEQ ID NO. 11595
gctcaatgcatcccctggctcccgaccgtagtgcatgctcatatccctagctagctcgcttcgttcctcactgctaccaattcaattccaacctcatcctcttccagagcttcatcgtctcatcagttggtggcttcaaaccatgtgcatccaaggccatgccgtggccctagtggttcctgcaggtctgctgctgaccctcacgctgcttgtggctggtataccgtgggaggcgtgcaacagcaccatcacggggaactacacggccaacagcacctacggcggcaacctccgcctggtcgccgccgccctgccaggcaacgtctccacgtcccccaccctcttcgccaaggctgtgatcgggacggcgccggacatcgtgtacgccctcgggcaatgcagcggcgaccagagcgccgccgcctgccatgactgcatcaacgccagcttcgcggccgcgcagaagctgtgccccttcaacaagggcgccgccgtgttctacgacacgtgcttcgtcggcttctccggccgggacttcctcgcctccaccaccaactcggacgatcaggaggtgcagctctacaacggccagaacatcacctccgacggcgccgaccggttcaacgcgaccgcctacgagctcctcaacgccatggccgagcacatggcgaccacgaactcggagaagttcctgaccggaaccattggcttcgacgacacgacctaccccaacatctacggcatggcgtcgtgcacctctgacttgacgcccgggcagtgccgcgggtgccttgatgcggcaattgccgagatgccacgggtgttcatcccgaacaccaagggtgccaggattgccgggctgcggtgcatcgtgcgctatgaggtgtaccgtttctacaacggttccaccatgcttcagctgccaggcacccatgctgggagaatcggaagcaagaagagtaatgatactggtaaaattcttgcaatcgtgctacctatagtggtggctatagctgcaagcttggcgatgtgcgttttctgcaggaggagaacaaaaagtaaaagtaaaaggtcgctatcatttacatctcatatggaggacattgaatgtattgagtcacttgttattgatctaccaacattacgtttggctaccaataacttcgctgaagataaaaagctcggtgaaggaggatttggtgcagtttacaagggatcccttcctaacggtcaagaaatagcggtgaaaaggctatctcagaattctcgacagggaataggggaactaagaaatgagctagttttaattgccaagctccagcacaaaaatctcgtgaggcttgttggagtttgtttggaagaggaagagaagcttcttgtgtatgaatacatgcctaacacaagtttggacacctttcttttcgactcagagaagcggaaagagcttgattggggcaagaggtttacaataataaatggaattacccggggattgcaatatctgcatgaagattctcagctgaagatagttcaccgcgatctaaaagcaagcaatattctgttagatactgcaatgaaccctaagatttcagactttggcttggcaaggctatttggagaggatcaatcgcaagataccactagaagagttgttggtacatatggatacatggcaccagaatatgctctgcgtgggcagtattccattaagtcagacatatatagcttcggtgtgttgattttggagatcatcacgggaaggagaaacagtgactcctacaattctgaccaatctgttgatctaccaagtcttgtatgggaacactggacaacaagatcgatcacggacatggttgacccttattttaggagtgattcatcttgggacgagattttgaggtgcattcatattggactatcctgtgtccaggaagaccctgtggataggccaactatatcagctatcagcatcatgctcgatagcggaacggtcccctcccaacctccatccagaccagcattctacgtagaaatgagtggcaacgttgattcaggcatgtactcatcccaatcatacccaggatttgttaataagtctacagcaaagtcgacggtagtatcaccgaatgagctatcggttacagatcctgaaccaaggtaaggttggaaatagttgaccaaaacaagcataaatgtacgtggtttttgtaaggaaaaaagtcaagcatcttatttgtatctaaagaaggcaagggtgtataaatgtgtgtacgacgactaggatttagcctactagatacatgcttgtatttcattagaatgttgtgtggtcactatttactcctctccgggcattgtattgaaataaaagaagtcatggtggtgttgctgt

SEQ ID NO: 11595 - protein, 672 aa, Panicum virgatum
  misc_feature: Ceres CLONE 1747492
  misc_feature (341)..(612): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with altered carbohydrate content
MCIQGHAVALVVPAGLLLTLTLLVAGIPWEACNSTITGNYTANSTYGGNLRLVAAALPGNVSTSPTLFAKAVIGTAPDIVYALGQCSGDQSAAACHDCINASFAAAQKLCPFNKGAAVFYDTCFVGFSGRDFLASTTNSDDQEVQLYNGQNITSDGADRFNATAYELLNAMAEHMATTNSEKFLTGTIGFDDTTYPNIYGMASCTSDLTPGQCRGCLDAAIAEMPRVFIPNTKGARIAGLRCIVRYEVYRFYNGSTMLQLPGTHAGRIGSKKSNDTGKILAIVLPIVVAIAASLAMCVFCRRRTKSKSKRSLSFTSHMEDIECIESLVIDLPTLRLATNNFAEDKKLGEGGFGAVYKGSLPNGQEIAVKRLSQNSRQGIGELRNELVLIAKLQHKNLVRLVGVCLEEEEKLLVYEYMPNTSLDTFLFDSEKRKELDWGKRFTIINGITRGLQYLHEDSQLKIVHRDLKASNILLDTAMNPKISDFGLARLFGEDQSQDTTRRVVGTYGYMAPEYALRGQYSIKSDIYSFGVLILEIITGRRNSDSYNSDQSVDLPSLVWEHWTTRSITDMVDPYFRSDSSWDEILRCIHIGLSCVQEDPVDRPTISAISIMLDSGTVPSQPPSRPAFYVEMSGNVDSGMYSSQSYPGFVNKSTAKSTVVSPNELSVTDPEPR

SEQ ID NO: 11596 - DNA, 1968 bp, Panicum virgatum
  misc_feature: Ceres CLONE 1747526
  misc_feature: Encodes the peptide sequence at SEQ ID NO. 11597
cggctcccctccccattcccgtcctccgcccccctagattccaatccctacctgagcagcgagcgaatctcgccccgtcccattcgcaggtgccgccgccgccgtgccggaggagtcccagttgcgctgccgagaaattttccctggtgtacggatgatgggctgcttcactgttctcagatccaagaagaagaaatgccctcttgataatccttttgttccgagcaagaaatcgattgatgcaagggaaagtacgtcctctagacttccggagccagaagttcatgtaccatccttgcaatcagctcctcctagttttagggacagggctaaaatctctcagtcggcaaataaggtttataacagcagagctcgtgtcttgtctgctccatcaacccttatcgtggttgatcagtttggctttccatacactgaatatagagatcaagatgactccagggataaggaaggttccacaaagggtcaccgcttttcaaatcctttgccccttcctcttccttcaccggaaggacattctttgaggaactttggtagcttcaaagccaacaacgtaagtgggccactggagatgtctggccctctcccactgcctccaaagaaatgtgatggacttagaatcttctcttatgatgaagtttcatctgcttgccagtggttttctagtgatcagtgtgtttcagaaacacttggttcaacatcatataaggcaaccttcagggatgactttagtgatacaaagaccactgaagcaacagtagctcgattactaccctccactcagagtttgaaggagtttaaagcacaagtgaacacattagcatcgcttcagcatcccaatttatgtaaattaattggctattatgcaagagaagattccaatggaaggatgttggtctatgagcggcttcatcatggcagcttagataagctactctttggaagaccggatggtcgtttcatggactggtctaaacgtttgaaggttgctctgggtgctgccagaggtctagctttcttacatgacgaaggaccctttcaggccatgtacagtgagttctcaacttcgaacatccaaatagataaagatttcactgctaagctttcaggctatggttgtgttggcttcagtactgaggaggagatatctaatgcacctgcgtctgcagcaaacctttcagtggagaccttggagaaaggtttactcactcccaagagtaatgtgtggagcttcggagttgtattactggagctaataacaggaagaaagaaccttgatgccagttcggccaaagaagaacgcaatattgtcaagtggagtaggcctttccttaccgatgacagtcgcctatccctgatcatggactcccgtataaaagggcgctttcctactaaggctgctcggatagtagcagacataattctgaaatgtttgcataaagatccatcagagaggccaacgatgagggatgttgtggaggctctagcaggagtccaggaaataaaagttccatgccgatatcctctgcaagagccgtctgccgcaccaagaaaaataatgttgaaatctacatccctcaatggaattgtgcctcagcatcctattataaccttctctccatcgccaccttcacataaccaacacttgatctcaccaaggtcatcgacatctgctttgcttcatccaaggatgtgctcccctactctggatgatcccagggtaaggtctacgaagaaaacgcctccccctatcatgcggaggtctagcgtagaaggcttttgaatgtccatattgttcttttatttccttttctttgatttatttgtttctttgttagcctagtgatttttagtgctatgtgctgtactgtaagacaagtggccttatgtaatgcccttgagtaataactaagcagagcaaggtgaattgtaaataggaccaggttgtgg

SEQ ID NO: 11597 - protein, 548 aa, Panicum virgatum
  misc_feature: Ceres CLONE 1747526
  misc_feature (179)..(450): Pfam Name: Pkinase_Tyr Pfam Description: Protein tyrosine kinase
  misc_feature: SWISSPROT Homolog: EC 2.7.11.1 Non-specific serine/threonine protein kinase
MMGCFTVLRSKKKKCPLDNPFVPSKKSIDARESTSSRLPEPEVHVPSLQSAPPSFRDRAKISQSANKVYNSRARVLSAPSTLIVVDQFGFPYTEYRDQDDSRDKEGSTKGHRFSNPLPLPLPSPEGHSLRNFGSFKANNVSGPLEMSGPLPLPPKKCDGLRIFSYDEVSSACQWFSSDQCVSETLGSTSYKATFRDDFSDTKTTEATVARLLPSTQSLKEFKAQVNTLASLQHPNLCKLIGYYAREDSNGRMLVYERLHHGSLDKLLFGRPDGRFMDWSKRLKVALGAARGLAFLHDEGPFQAMYSEFSTSNIQIDKDFTAKLSGYGCVGFSTEEEISNAPASAANLSVETLEKGLLTPKSNVWSFGVVLLELITGRKNLDASSAKEERNIVKWSRPFLTDDSRLSLIMDSRIKGRFPTKAARIVADIILKCLHKDPSERPTMRDVVEALAGVQEIKVPCRYPLQEPSAAPRKIMLKSTSLNGIVPQHPIITFSPSPPSHNQHLISPRSSTSALLHPRMCSPTLDDPRVRSTKKTPPPIMRRSSVEGF

SEQ ID NO: 11598 - DNA, 1482 bp, Panicum virgatum
  misc_feature: Ceres CLONE 1747596
  misc_feature: Encodes the peptide sequence at SEQ ID NO. 11599
atcatcaatcgccctcgccccccaaacaacggaacacggacgacgcagcgcaggaatcaatcaccctccctccctgcgtcccggagggacagagagaagcagaaaaagtctcctccctccctcgcttcccatggatctccgcctcgcccactagtccactggggagtggtggaggggggatggggctccccgggcggctgctgctgccgctgcttctcggcctcgcttcggcggccgtcgccgtcgccgcggaagcttccgagggcgacgccgatccgctctacaaaacttgtgttgaagaatgccaaaaaacaggctccctcaaagatacttcaattaagcactgtgtcgagccaaccgacggcaaacctgcagccaaatcatggtacacgcacgaaccattgtacctgcaatggaaagagtggaactgcaagagtgaatgcagataccactgcatgatggaaagggaaaatgaaaggacagagcttggcttaccgcctgttaagtaccacggcaagtggccgttgaagcgtgcttctgtgtttcaggaacctttatctgccgctctctctgctctcactcttattgtgcagttcaatgggtggttatcgtttttcctattgctgtactataagctacctctacggccagaaactcataagacctactatgagtatactgccttgtggcacatttatgggcttctagccatgaattcatggttctggagtgccatatatcacagttgtgatactatttggacagagaagctgcatttttcatccgctgctgcctttctggggtactctctcattttggcgatattgcggactttgaatttaagagatgaagcttctagagttatggttgctgctccaattctggcttttgtgacaacccacattttatacctcaacttctaccaacttgacaaaggcctgaacatgaaggtttgtactgtgataagtattgttcaatttctcctgtgggcaatgtgggctgtcatgactcggcattcctcacgtcttaagatcatatttgttgccattggaggcgtggtttcagtatttctggaagcttgtgacatccctccacgatggggatatgtagatggtcgtgctatctgccttgctgtggctatccccctatcatacctttggtggagcttcgccatggaagatgctgagatgcgcacatcagaaatcacaaagaagacacgataatcaccgcgttcggcaggctggagctggaatgctgtgagagaaaaatactgttgggctggctggagctggtggctggagtggtatgagaggaaattactgtagcgctagaggagagtagaccagccgaacacagtgaatgagcaaatacaatctgccatctgtgtgattattttatgtcggcacccagcctttgtaaagataaacgtttcacgtgtaatgttaggtaacttagtatgtgaattatcatctgttgtttttt

SEQ ID NO: 11599 - protein, 347 aa, Panicum virgatum
  misc_feature: Ceres CLONE 1747596
  misc_feature (71)..(343): Pfam Name: Per1 Pfam Description: Per1-like
MGLPGRLLLPLLLGLASAAVAVAAEASEGDADPLYKTCVEECQKTGSLKDTSIKHCVEPTDGKPAAKSWYTHEPLYLQWKEWNCKSECRYHCMMERENERTELGLPPVKYHGKWPLKRASVFQEPLSAALSALTLIVQFNGWLSFFLLLYYKLPLRPETHKTYYEYTALWHIYGLLAMNSWFWSAIYHSCDTIWTEKLHFSSAAAFLGYSLILAILRTLNLRDEASRVMVAAPILAFVTTHILYLNFYQLDKGLNMKVCTVISIVQFLLWAMWAVMTRHSSRLKIIFVAIGGVVSVFLEACDIPPRWGYVDGRAICLAVAIPLSYLWWSFAMEDAEMRTSEITKKTR

SEQ ID NO: 11600 - DNA, 1752 bp, Panicum virgatum
  misc_feature: Ceres CLONE 1747608
  misc_feature: Encodes the peptide sequence at SEQ ID NO. 11601
ctagcttccagactcctctgtctctcccggccgcgtcctcccctccgactgagatcactgcgggtgccgcccgcgccatggccccgacaccgccgccgccagctgcaatacactagcaacgcgtctccaggcagctttggccgatctagggaagaagaatttcttcacgccttctctcctcaccttgtgttgaggagtacgggcttggattctcagagggattgggaggagagggataatagagtggaggaggcaaggggagaagatggcgtcggtaatggtgaaggcggcgacgagcgacaagctcaaggagatggattgggcgaagaacatcgaaatctgcgagttcgtggcgcaggatcctggaaaagcgaaagatgtgatcaagtctataaagaagtgtatagggggaaggaacaagaacactcaactctatgctgttatgctattggagatgctcatgaataactgcggagagcctatccacaggcaggtcattgataatggccttcttccgatacttgtgaagatagtgaagaaaaagacagaattgccagttcgagaaaatatatttcttttgctagacgctacccaaacatcccttggtggagctaaagcaagattccctcagtactatgatgcatactatgagctggtgtctgcaggtgtgcaattttcaaatcgtccaaatgttgttgtcacacgagcagaagtgccagtcccagaaacgagaacagaaccaaataaggaaagtttatcgacccgattgaatgaagctcagcaggaagtgcacactcaacctgttcctgacacaagtatagtacggaaagcctctagtgtgatggaagttttaagggatgtgctaaattctatggatcctagacaccctgagggcgcaactgatgaatttgtgttggatcttgtcgagcaatgtacatttcagaagcaaagaataatgcaccttgttatgacatcaagggacgaagcagtggtatcacaagctatagagctaaatgaagagctacataaggtccttgtgcggcacgatgcattgctttcagttcagccgactacaacagtagcttctaatctggaggaagaggaggaagaagatgctgaaagtctatatcggagactgaggaaggggaaagctctatctcaagattacacagatgattctgtgccgtcattccgattcataccagatgacaagatgcggcgcccgctgaccatccagccacctcaccccgacaagaaacttggcgcgctcaacatccgctctccagaccaggtggagccgagacccgagcttggtcctctgatcccgccgccccccgcgaagcatgccgagagggagcgtttcttccgggagaagagcatagacagcttggctagcctgccgggccacctgaggggcatgtcgcagcacagccgggatggcagcagctcgtgtagcggcagcactgattatggcgactgagtggggagcggcagtagtacatataggtttccctccttggggttgtaggtctcccccatgtcaaggcgatacattgatgttcggcgaggccgtctcggcctcagcatcggcctcatcatcttcttgtttctgctgacctgtgtacacttggtttggtagctgatccttttctcctcttcttgtcctttcgctgatgacattattgggagaccgttgggttggtgtggtgttgtgggctacttttctgagatccatagagatgattgtgatct

SEQ ID NO: 11601 - protein, 404 aa, Panicum virgatum
  misc_feature: Ceres CLONE 1747608
  misc_feature (1)..(134): Pfam Name: VHS Pfam Description: VHS domain
  misc_feature (179)..(274): Pfam Name: GAT Pfam Description: GAT domain
MASVMVKAATSDKLKEMDWAKNIEICEFVAQDPGKAKDVIKSIKKCIGGRNKNTQLYAVMLLEMLMNNCGEPIHRQVIDNGLLPILVKIVKKKTELPVRENIFLLLDATQTSLGGAKARFPQYYDAYYELVSAGVQFSNRPNVVVTRAEVPVPETRTEPNKESLSTRLNEAQQEVHTQPVPDTSIVRKASSVMEVLRDVLNSMDPRHPEGATDEFVLDLVEQCTFQKQRIMHLVMTSRDEAVVSQAIELNEELHKVLVRHDALLSVQPTTTVASNLEEEEEEDAESLYRRLRKGKALSQDYTDDSVPSFRFIPDDKMRRPLTIQPPHPDKKLGALNIRSPDQVEPRPELGPLIPPPPAKHAERERFFREKSIDSLASLPGHLRGMSQHSRDGSSSCSGSTDYGD

SEQ ID NO: 11602 - DNA, 696 bp, Panicum virgatum
  misc_feature: Ceres CLONE 1747624
  misc_feature: Encodes the peptide sequence at SEQ ID NO. 11603
atcgcctacggcctcgacaagaagtcgagcagcgacggcgagaagaacgtgctcatcttcgacctcggcggcggcaccttcgacgtctcgctcctcaccatcgaggagggcatcttcgaggtcaaggccacggccggcgacacccacctgggcggcgaggacttcgacaaccgcctcgtcaaccacttcgtgcaggagttcaagaggaagaacaagaaggacatcagcggcaaccccagggcgctccggcgcctgcgcacggcctgcgagcgggccaagaggacgctctcctccaccgcccagaccaccatcgagatcgactccctctacgaaggcatcgacttctacaccaccatcacccgcgcccgcttcgaggagctcaacatggacctcttccgcaagtgcatggagcccgtggagaagtgcctccgcgacgccaagatggacaagagcagcgtgcacgacgtcgtgctcgtgggcggctccacccgcatcccccgcgtgcagcagctgctccaagacttcttcaacggcaaggagctctgcaagagcatcaaccccgacgaggccgtcgcgtacggcgccgccgtccaggccgccatcctcaccggcgaaggcaacgagaaggtgcaggacctgctcctgctcgacgtctcgccgctctcgctcggcctggagacggccggtggcgtcatg

SEQ ID NO: 11603 - protein, 231 aa, Panicum virgatum
  misc_feature: Ceres CLONE 1747624
  misc_feature (1)..(231): Pfam Name: HSP70 Pfam Description: Hsp70 protein
  misc_feature: Useful for making plants with modulated drought sensitivity
  misc_feature: Useful for making plants with modulated heat sensitivity
IAYGLDKKSSSDGEKNVLIFDLGGGTFDVSLLTIEEGIFEVKATAGDTHLGGEDFDNRLVNHFVQEFKRKNKKDISGNPRALRRLRTACERAKRTLSSTAQTTIEIDSLYEGIDFYTTITRARFEELNMDLFRKCMEPVEKCLRDAKMDKSSVHDVVLVGGSTRIPRVQQLLQDFFNGKELCKSINPDEAVAYGAAVQAAILTGEGNEKVQDLLLLDVSPLSLGLETAGGV

SEQ ID NO: 11604 - DNA, 661 bp, Panicum virgatum
  misc_feature: Ceres CLONE 1747624-R
  misc_feature: Encodes the peptide sequence at SEQ ID NO. 11605
catggacgccaacggcatcctcaacgtgtcggcggaggacaagaccaccggccagaagaacaagatcaccatcaccaacgacaagggccggctgagcaaggaggagatcgagaagatggtgcaggaggccgagaagtacaaggccgaggacgaggagcacaagaagaaggtggacgccaagaactcgctcgagaactacgcctacaacatgcgcaacaccatcagggacgacaagatcgcgtccaagctcccggaggccgacaagaagaagatcgacgacgccatcgagggggccatcacctggctggacaacaaccagctcgccgaggttgacgagtttgaggacaagatgaaggaactggagggcatctgcaaccccatcatcgccaagatgtaccagggcgccgctggtcctgacatggccgctggcatggccgaggatgctccgccggccggcggcagcggtgctggacccaagatcgaggaagtcgactaaatgaggagattttgatcgctggtcttgctctaaaataatctgccgctgatttgcacagtggatcttgtactcttcctgcagtttttggttttcggcttttcgccatactagtttatgttaagttgatttggaaccatggttatagatagtgattagtatcatgcc

SEQ ID NO: 11605 - protein, 164 aa, Panicum virgatum
  misc_feature: Ceres CLONE 1747624-R
  misc_feature: SWISSPROT Homolog: EC 3.6.3.14 H(+)-transporting two-sector ATPase
  misc_feature: Useful for making plants with modulated drought sensitivity
  misc_feature: Useful for making plants with modulated heat sensitivity
MDANGILNVSAEDKTTGQKNKITITNDKGRLSKEEIEKMVQEAEKYKAEDEEHKKKVDAKNSLENYAYNMRNTIRDDKIASKLPEADKKKIDDAIEGAITWLDNNQLAEVDEFEDKMKELEGICNPIIAKMYQGAAGPDMAAGMAEDAPPAGGSGAGPKIEEVD

SEQ ID NO: 11606 - DNA, 708 bp, Panicum virgatum
  misc_feature: Ceres CLONE 1747657
  misc_feature: Encodes the peptide sequence at SEQ ID NO. 11607
ttcctgccaccaaccactctcctccacgagctgccatagcataccccgcggagctcatgcgctggccccataaatcaagcttcggattcgttgccttgtgcttcacagctgctagttcggagcaccagctgctgcatcgtcttcgccggcggtcgggagctcaccggcggggctcacgggccggcgatggctccggtcaccgaggcgcgttggttagcgcttcctcctcgcctccggctgacgccaccggccggcgccgacggagtcgccgccgcctccagctgcagatattttttgcgcctcctcgccctcgtccgccccccgatggccgccgccgacccgccgccgcgcgggggtgccgcggcccccgcgcccgtgctgcggcggagccccagcatcgagcgcatcccggaggacgcgcgccgcatcctgctccgcctggccggcgagctctggggcggcgacgtggacccgggcgcgctcgccgtgtcccagctcaagggcgccatgaccaacgaggtcttccggatcacctggcccggcggcgagggcgacccgcgcaaggtgctcgtgcgcatctacggccagggcgtcgaggtcttcttcgaccgcgccgacgaggtccgcaccttcgagtgcatgtcgcgccacggccaggagccccgcctccttggccgattcgccaacggccgcctcgaggagttcatc

SEQ ID NO: 11607 - protein, 127 aa, Panicum virgatum
  misc_feature: Ceres CLONE 1747657
  misc_feature: SWISSPROT Homolog: EC 2.7.1.82 Ethanolamine kinase
MAAADPPPRGGAAAPAPVLRRSPSIERIPEDARRILLRLAGELWGGDVDPGALAVSQLKGAMTNEVFRITWPGGEGDPRKVLVRIYGQGVEVFFDRADEVRTFECMSRHGQEPRLLGRFANGRLEEF

SEQ ID NO: 11608 - DNA, 790 bp, Panicum virgatum
  misc_feature: Ceres CLONE 1747710
  misc_feature: Encodes the peptide sequence at SEQ ID NO. 11609
gttttctggaggcatccctgaggacttgggcaatggccagcctctcagctatgtcaatcttgcaaacaacagcctcaccggtggcatccctcccgggttggccagaagctcatcctcctcactcagcaagctcatcctctcacgcaacaaccttgctggtcagatccctgctactctgtttgccaacacatctgcacttaccagggttgatctccggatgaattctctgactggtgccatcccgcctttcgatagggtcacatccctcaggtacctttgcgttactgacaacttcctttctggaagcatacctgcttctttaggaaatgtttcttctctccgcttcatgttgctaggccaaaacagacttacaggaccaattccagaaagtttgcggcacatttctaaacttcttgacctggatctgagtttcaatatcttatcagggcatgtccccttgcctctttagaacatctcttcactcagaaacttgagcttaggcagcaatggccttgttgggcagataccatctgacattggttactcactaccaaatctcccagtcttccccctgcagaacaataacctggtgggcctgatccctacttcactagaaaatgcgtcgaacctccaagttcttgacctttccaacaactccctgcatggccgtgttccatctcttgagtcgttggcaaaattgctccaagtgcttttagcaaggaatcagctagaagcgtatgattggcaattccttgcctccctaacaaattgctcccagctgactaaattg

SEQ ID NO: 11609 - protein, 155 aa, Panicum virgatum
  misc_feature: Ceres CLONE 1747710
  misc_feature: SWISSPROT Homolog: EC 2.7.11.1 Non-specific serine/threonine protein kinase
FSGGIPEDLGNGQPLSYVNLANNSLTGGIPPGLARSSSSSLSKLILSRNNLAGQIPATLFANTSALTRVDLRMNSLTGAIPPFDRVTSLRYLCVTDNFLSGSIPASLGNVSSLRFMLLGQNRLTGPIPESLRHISKLLDLDLSFNILSGHVPLPL

SEQ ID NO: 11610 - DNA, 1147 bp, Panicum virgatum
  misc_feature: Ceres CLONE 1747784
  misc_feature: Encodes the peptide sequence at SEQ ID NO. 11611
atctccccatccgcctccgccactgattgccttcctccgcctcttcccatccgcctccgccgcgtgctctctcttctcttctcttctccccacaaagctccctcgctgcggaagggttccatccgcgttaccacgattaggacatggccgaggcgctgtgcaacggcgtcgtcgcgtcgccgtgcgccggggacgtcggcgtggccgcccggctcaggggcgccgcggcggcgctcgcggagtccgtgccgatcggcggatacagcaccaagagctccttctccgccgggaggatggccatgacggaccggaaggcgaggcccctgcctctgaccgtcgaagcggcgcctggacagatgaacctgtcgtttcccaaggccacgcggtggtggcacaaggggctgcagcccaacatgagggagatcgagtccgcgcaggacctcgccgactccctcctcaacgccggcgacaagctcgtcgtcgtcgacttcttctccccaggttgcggcggctgccgcgccctccatcccaagattgcccagtttgccgagaggaacccagatgtcatgttcctgcaagtgaactacgagacgcacaagtccatgtgctacagcctccacgtccatgttctccctttcttcaggttctacaggggagctgagggacgggtcagcagcttcagctgcacgaatgcaactatcaacaagttcaaggacgccctcgcgaagcacgggcctgaaaggtgcagcctcggccctgcacgggggctggaggagtcggagctcttggccttggctgcaaacaaggacctgcaattcacctacgagaagccggaccttgtcccactagcagaagccattgccaaggaggctgctgcaccaggaggtccctggtttccattgcctgtgtcagcgacgcagttgctcactcagggaccagagaattctttgctgtcatctggaagatagaccgtagtttcatcaagatggctcctttctgtacagatttattcgttcttagtctgatgtttgagtgacatattgagacgcagatgcggcaggcttaggcttttagtttataagcccgctgactattgtatctgtgttgtagcatctagccattgctcaagcaggaaatcctttacttg

SEQ ID NO: 11611 - protein, 274 aa, Panicum virgatum
  misc_feature: Ceres CLONE 1747784
  misc_feature (93)..(196): Pfam Name: Thioredoxin Pfam Description: Thioredoxin
  misc_feature: SWISSPROT Homolog: EC 1.8.1.8 Protein-disulfide reductase
MAEALCNGVVASPCAGDVGVAARLRGAAAALAESVPIGGYSTKSSFSAGRMAMTDRKARPLPLTVEAAPGQMNLSFPKATRWWHKGLQPNMREIESAQDLADSLLNAGDKLVVVDFFSPGCGGCRALHPKIAQFAERNPDVMFLQVNYETHKSMCYSLHVHVLPFFRFYRGAEGRVSSFSCTNATINKFKDALAKHGPERCSLGPARGLEESELLALAANKDLQFTYEKPDLVPLAEAIAKEAAAPGGPWFPLPVSATQLLTQGPENSLLSSGR

SEQ ID NO: 11612 - DNA, 415 bp, Panicum virgatum
  misc_feature: Ceres CLONE 1747831
  misc_feature: Encodes the peptide sequence at SEQ ID NO. 11613
gacagcgcccgcattttttcctatgggcagatcttccgccctgacaactttgtgtttgggcaatctggagctggtaacaactgggctaagggccattacactgaaggtgctgagctcatcgactctgttctggatgttgtgaggaaggaagctgagaactgtgactgcttgcaaggattccaagtatgccactctcttggtggtggtactggatctggtatgggtacactgttgatctcaaagatcagggaggagtaccctgaccgcatgatgctgacgttctcagttttcccctcaccgaaagtatctgataccgtggttgagccatacaatgccactctttcagtccaccagttggttgagaatgccgacgagtgcatggttcttgacaatgaggccctctatgacatttgct

SEQ ID NO: 11613 - protein, 138 aa, Panicum virgatum
  misc_feature: Ceres CLONE 1747831
  misc_feature (3)..(138): Pfam Name: Tubulin Pfam Description: Tubulin/FtsZ family, GTPase domain
  misc_feature: Useful for making plants with modulated flowering time
  misc_feature: Useful for making plants with altered cell wall content and/or composition
DSARIFSYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDIC

SEQ ID NO: 11614 - DNA, 2309 bp, Panicum virgatum
  misc_feature: Ceres CLONE 1747851
  misc_feature: Encodes the peptide sequence at SEQ ID NO. 11615
aacccttcgccatttcatcgagaagaaaaaccgccccgtgttcgtctcctccccctccggccctcccctcccctcccccgattccaaacgggtaaaaatccggtcgaaaatgcagcccccgcagacccccattccgccgtgggggtcgaagtctcgccgggtgctgcagccgtcgctgctcagcccttcctactcccggaagccgttccaagccgccgccgccgccgcctccgagcacccctgcgtcacgctattcgagtggtggctggagagagtggaaggggatgaccagaagatcgccgtcgctgggaaatttgaaaggaatgagacagtccagcaattcgatgctgcaaccatttcaaagcgccacgaggcttgcgttcttgaaactgaagatggaattatacttcgcatctatggctcgctcagcctttccaagatgcgtgccaacggatattcgagtgaggtctgtgaaaagttcataatcggatttccctactggtgggaaaattggaaccagctttatcccaagatggcacaaacaagatcggatacaaaacaattttacttgcagcaatttcagcgggggcaaaaatttgattcatgtggaacatctttcctcagcgaacttcgtaatagtgttaaaaaatcctcacacaatgctgctgccttccaaaactcttcgcatttgccaaatggggcaccgagatttgaggaatgcaatgatagtgctataaatgaaaatgctgctgtctcaaatgattccggagaaagacatgaagctgcacgtaatgaggcaccaagatttgaggaatgcaatgatagtgctataaatgaaaatgctgctgtctcaaatgattccggagaaagacatgaagctgcacgtaatgaggcgtataatgtggaaacagacttgattgcatgcagagctttaagagaaagagatgatggtgacatagatactaatgcatccttagtgcatatagtggagtgtgctaatgatgctagcaatgaagaggctgataatgctacacccacaagtacatgccatcagcgaaaagctcatcatattgcattgcataagaaggcagaagtaaatgaaaatgtgccaacttttgtttgtttagacgtgcaaaactcctccaatcttcctagtggaacaccaagatttcaggaatacacagatccagtggttcaattgaaggctcaaggttgttgtgaaaaaactctgcacatagcattgagtaagaaggcagcaggagatgaagaaatgctaacttcagtttgtttagatgtgcaaaactcttctgatctgtcaaatgggacaccaagatttgagaaaaacacgtgcattagtgatattccaacaaatgtagatgctgctgcttcgaatggtaacaatgaaagatgtacagctgtatccgaggaggtgaatagcattgaaacaggcttgactgtgggcagcactataacagaaagtggtcatgatgacattgctactaatggtttttcagctcctacagtggaatgtgctaatgatgcagtcaatgaaggggtagacaatacttcactcttaggttgtacaaaaactccagtggcttcttcgaagagtcaaggctgccaggaaaaacatcaacacataccttcaaatgacaagcattcaggcccaccaaagaagcaaaggtctgcacttgagaagttgcagggtgctacaagatctccattcgcccgcccagttccatatgcccatgagtctccgcttactcgtggtagggccacatcattgtcaatttcaacacctgaagctctcaaactgagaaaaaccagatcgggtcgtctagttgtacccactttggatataggatgccaaaggattgtccatgactgggacggcacgattgctggtgtcattggtctggattcaccatcgcccaaagggagcaagctgaaagcatatgcaaggaggaaaagagaggccgagccgagcaagcggaagaagagaagggctcactgagcaattctcccagatgcgattcgtaggatttaggacttaaggcttcaggtgcaggagttggttggctttcggtagatctgtgcgaaagcctgtctcgccgctgatcctaggcgttggcacggattggtgtatgaaggctttttttaagcatgggacggtgtaaccagtgacagtgccaccttttgctgcaattcttgacctaagacagcatctagtattactcccttggctgcttggcaaccttaattgcctgcctgactactagtgagtggtgatctggacatgctttggttgc

SEQ ID NO: 11615 - protein, 634 aa, Panicum virgatum
  misc_feature: Ceres CLONE 1747851
  misc_feature (46)..(140): Pfam Name: SANTA Pfam Description: SANTA (SANT Associated)
MQPPQTPIPPWGSKSRRVLQPSLLSPSYSRKPFQAAAAAASEHPCVTLFEWWLERVEGDDQKIAVAGKFERNETVQQFDAATISKRHEACVLETEDGIILRIYGSLSLSKMRANGYSSEVCEKFIIGFPYWWENWNQLYPKMAQTRSDTKQFYLQQFQRGQKFDSCGTSFLSELRNSVKKSSHNAAAFQNSSHLPNGAPRFEECNDSAINENAAVSNDSGERHEAARNEAPRFEECNDSAINENAAVSNDSGERHEAARNEAYNVETDLIACRALRERDDGDIDTNASLVHIVECANDASNEEADNATPTSTCHQRKAHHIALHKKAEVNENVPTFVCLDVQNSSNLPSGTPRFQEYTDPVVQLKAQGCCEKTLHIALSKKAAGDEEMLTSVCLDVQNSSDLSNGTPRFEKNTCISDIPTNVDAAASNGNNERCTAVSEEVNSIETGLTVGSTITESGHDDIATNGFSAPTVECANDAVNEGVDNTSLLGCTKTPVASSKSQGCQEKHQHIPSNDKHSGPPKKQRSALEKLQGATRSPFARPVPYAHESPLTRGRATSLSISTPEALKLRKTRSGRLVVPTLDIGCQRIVHDWDGTIAGVIGLDSPSPKGSKLKAYARRKREAEPSKRKKRRAH

SEQ ID NO: 11616 - DNA, 695 bp, Panicum virgatum
  misc_feature: Ceres CLONE 1747894
  misc_feature: Encodes the peptide sequence at SEQ ID NO. 11617
ctcggcagccaccaccacgaccacgaccttgtcctcggccagtcacacgagcacgaccacgaacttgtcctcggccagtcgcacgaccacgacctggggctggggcaccacgacgacgatcaccagctcgtcctcgggcatgaccatcaccaccatgtccacggtggggagctggctctgaggcagggccatgagggagactcgggggcactggatgtgcagggccaccaccaccacgagcttgagttgtctgagagccacgagttgactcttgctgagacgcaccacctcggtgtcgatcagaatctggatgaccagctctcgctcgagcaggctcatgagctcgcgctgcatccacacgacctctcccaggctcctctcgcagttgctccagttgtccagtcacggaccatggttgtgagcccagagtttcagctggctgtgggccaggagtttccggatgttatgagctgccgcagggccatccgcaacactgccatcgcctgccactttgagatacagacggtgaagtctgacaagacaaggtttactgcaaagtgtgctgctgagggctgcccatggcgcatacatgctgcaaagctccctggtgtgcctacattctccatcagaaccatacatgacaaccacagctgtgtggggatcagtcatcttggccatcagcaggcatcagttca

SEQ ID NO: 11617 - protein, 231 aa, Panicum virgatum
  misc_feature: Ceres CLONE 1747894
  misc_feature (114)..(230): Pfam Name: MuDR Pfam Description: MuDR family transposase
LGSHHHDHDLVLGQSHEHDHELVLGQSHDHDLGLGHHDDDHQLVLGHDHHHHVHGGELALRQGHEGDSGALDVQGHHHHELELSESHELTLAETHHLGVDQNLDDQLSLEQAHELALHPHDLSQAPLAVAPVVQSRTMVVSPEFQLAVGQEFPDVMSCRRAIRNTAIACHFEIQTVKSDKTRFTAKCAAEGCPWRIHAAKLPGVPTFSIRTIHDNHSCVGISHLGHQQASV

SEQ ID NO: 11618 - DNA, 646 bp, Panicum virgatum
  misc_feature: Ceres CLONE 1747894-R
  misc_feature: Encodes the peptide sequence at SEQ ID NO. 11619
cgtgcacggggctaccaggtggcccgagccaacgaggcggaattcgaggtcatctcagctcatgagggaacgaacattgtggacatccgcaataggtgctgcttgtgccggggttggcagctctacggagccccctgtgctcatggcgtggcggcgctcctctcctgcagacagaatgttcatcgctacactgagagctgcttcactgtggcaacataccgcaagacgtactcgcagaccatacacccgatcccagacaagaccctctggcatgaaacagcaggccaaggccaggctgaagagaacaagattgagattatcatcaacccaccgaagtcgttgaggcccccagggaggccacggaagaagaggatccgcgcggaggaccgtgggcgagtcaagcgagttgttcactgcagccgctgcaaccagacaggacacttcagaactacatgtgctgctccaatatgaacaacggcatcgtacaggcagtgttgaaaattctgaatagctgcagtattactgagacaagttagtagaacttagtgtctaccgtgcaaacttcttgcttgcagacgggcgtctttggttttacttgatcctgctgtcgttctagcattggcttaataatgttaatttcagctac

SEQ ID NO: 11619 - protein, 156 aa, Panicum virgatum
  misc_feature: Ceres CLONE 1747894-R
  misc_feature (25)..(57): Pfam Name: SWIM Pfam Description: SWIM zinc finger
RARGYQVARANEAEFEVISAHEGTNIVDIRNRCCLCRGWQLYGAPCAHGVAALLSCRQNVHRYTESCFTVATYRKTYSQTIHPIPDKTLWHETAGQGQAEENKIEIIINPPKSLRPPGRPRKKRIRAEDRGRVKRVVHCSRCNQTGHFRTTCAAPI

SEQ ID NO: 11620 - DNA, 514 bp, Panicum virgatum
  misc_feature: Ceres CLONE 1747900
  misc_feature: Encodes the peptide sequence at SEQ ID NO. 11621
gagcggcgacttcgcgctcgacacgctctactacggcgagtacatgaacacgggcgccggcgccggcacgtccgggagggtgaagtggaaggggtaccgcgtcatcaccagcgcggcggaggccagcgccttcaccgtcgggtccttcatcgacggcgacgtctggctcgccggcacgtccatccccttcaacaccggcttgtgagcgctagcgattcatcgtcattattcagtgatgcatgctgattcacatgcagtgggccggggaagatccgaagatgtgtggcaaacaataaatgggtggtggcgtgatcaagttgcattgtgaggtggaaaggcaccgatggttcggtcggtcgtcctgttgcgtagctgccgttgattctttttgtgtcgttccgtctgtatacatacgtggcattgcatgaatgaaactcggatcggtacactcgtcaatgaatgtacctaatactactccgtataagctacgtttaaatctggtgtacttttctct

SEQ ID NO: 11621 - protein, 67 aa, Panicum virgatum
  misc_feature: Ceres CLONE 1747900
  misc_feature (1)..(53): Pfam Name: Pectinesterase Pfam Description: Pectinesterase
  misc_feature: SWISSPROT Homolog: EC 3.1.1.11 Pectinesterase
  misc_feature: Useful for making plants with altered carbohydrate content
  misc_feature: Useful for making plants with altered cell wall content and/or composition
  misc_feature: Useful for making plants with modulated time to senescence
SGDFALDTLYYGEYMNTGAGAGTSGRVKWKGYRVITSAAEASAFTVGSFIDGDVWLAGTSIPFNTGL

SEQ ID NO: 11622 - DNA, 1083 bp, Panicum virgatum
  misc_feature: Ceres CLONE 1747903
  misc_feature: Encodes the peptide sequence at SEQ ID NO. 11623
ctccccagctccgcctccctctcccacccgcaccctccgtctcctctcccggctcgcgcaggcaggcgacacagcgaggctaaaaccctagcgcgaggaggcgtagagcggcttcgcgatgacggcgccggcggacaaggggaagaaggctaagaccgaggccggcggcggcgaggagaacgagcagatcgacggcgccctcgtcctctccatcgagaagctccaggagatccaggacgagctcgagaaggtaaatgaggaagcaagtgacaaggttatggaggtggagcagaagtacagtgagattcgcagaccagtctacctcaaaagaggtgacattatcaagacaataccggacttctggctgacagcgtttatgagccatcctctactcagcgagcttctgactgaagatgatcagaagatattcaagtacttggattctgttgatgtggatgattctgatgtcaaggcaggatactccattcatcttaacttctctgagaatccatactttgaagacacaaagcttacaaagacctattcctttgctgatgatggaacaaccacaataaaagcttctcagattaagtggaaggaaggaatgggacctgcaaacggaaatggtattaacaagaaaggggccaagcgaccattggtagaggaaagttttttcacctggtttggcgatacagagctcaagagtcttgctgatggtgtgcaagatgaggtggctgagatcatcaaggaagacctgtggcctaatcctttgaaatacttcaacaatgaggttgatgatgagtttgaaggagaggatgaagatgatgaagatttggatggtgaggatggcgaggatgacgacgaggagaactgaaccctcaggcttcgatttcagctgttggtgaggactctggctctgaagggtggaattatgtgacccttttgcgagatttttttttgtttgtttgacttagctggaactcaccgtagggaacatgccaatgccttatgaagttcaaccaacttgaaaggagaccgctatatcataatctggggtatatctatgaaggcaatttgacctgc

SEQ ID NO: 11623 - protein, 251 aa, Panicum virgatum
  misc_feature: Ceres CLONE 1747903
  misc_feature (32)..(227): Pfam Name: NAP Pfam Description: Nucleosome assembly protein (NAP)
MTAPADKGKKAKTEAGGGEENEQIDGALVLSIEKLQEIQDELEKVNEEASDKVMEVEQKYSEIRRPVYLKRGDIIKTIPDFWLTAFMSHPLLSELLTEDDQKIFKYLDSVDVDDSDVKAGYSIHLNFSENPYFEDTKLTKTYSFADDGTTTIKASQIKWKEGMGPANGNGINKKGAKRPLVEESFFTWFGDTELKSLADGVQDEVAEIIKEDLWPNPLKYFNNEVDDEFEGEDEDDEDLDGEDGEDDDEEN

SEQ ID NO: 11624 - DNA, 620 bp, Panicum virgatum
  misc_feature: Ceres CLONE 1747930
  misc_feature: Encodes the peptide sequence at SEQ ID NO. 11625
agaaacagaagcaagcgagcggaaatttgaggcgagagtggagccaaaaagcgggcggcaccgcccgccaccaccgcaggaggagccgagcctttcggtgtgggggtgggggtgggggtggtggagcctggtcgcggtccagcggctagccggctaggggtggggttcctccgcgcctgctcgctactacttcattccatggcggccgggccggctgaaccctgacagcggcggcgggcggtgtggaggcgcgagaacaagccacggcgaggcggagatggtggtgtgctccatgcgcaagtcgtcgttcaaggactttttcaaggtgctcgaggccgacatccaccacgccaacaccctggcagctgatttctccagggactacgatggggcctgcctccagatgcggatgtcctacagccccgccgcgcacttcttcctcttcctcgtgcagtggaccgattgcagcctcgccggcgcgctcgggctgctcaggatcctaatctacaaggtttatgtggatgggagtaccactatgtccacacatgagaggaaagcaagcatcagagaattttatgctgttatatttccatccctcatgcaactgcccaaggggatca

SEQ ID NO: 11625 - protein, 114 aa, Panicum virgatum
  misc_feature: Ceres CLONE 1747930
  misc_feature: Useful for making plants with altered lignin content
MVVCSMRKSSFKDFFKVLEADIHHANTLAADFSRDYDGACLQMRMSYSPAAHFFLFLVQWTDCSLAGALGLLRILIYKVYVDGSTTMSTHERKASIREFYAVIFPSLMQLPKGI

SEQ ID NO: 11626 - DNA, 669 bp, Panicum virgatum
  misc_feature: Ceres CLONE 1747930-R
  misc_feature: Encodes the peptide sequence at SEQ ID NO. 11627
agagcaagaggccagtttctgagattgatgtcgagagggaggaggaatgtggcatttgcatggagatgaacagcaaggtggtgctgcccacctgcagccatgctatgtgcatcaagtgctaccgccaatggcgctccagatcccagtcctgccccttctgtcgtgacagcctcaagcgagtaaattccggtgacctgtggatgttcactgactgccgagacgtagttgacatggctacggtgagcagagagaacatcaggcgcctgtttatgtacatcgagaagctgcctctggtcatgccggaaaacatcttctacgcctatgattctcatgtaaaatagctcgagctgcacatgatgacttgctcaccattgttttctgagagtgatgacgcatggcttattgattcatgcagaggatgttcctcgtcctaggatgtggctaatcttggagcagcctgtggactctgacaagagaccttgagagctctgactgggtgtagagtcttgttcaggtttttgtaaatgtgctgtacatatttatggtgcaatgaaaaatctttagggaaaaagcgttgtgttccaagtagggaagctctggctgagatacacttggtgcatgtattgcggttcgattttaagcttgcaaatgctctgtagtttaaaccgg

SEQ ID NO: 11627 - protein, 112 aa, Panicum virgatum
  misc_feature: Ceres CLONE 1747930-R
  misc_feature (16)..(53): Pfam Name: zf-C3HC4 Pfam Description: Zinc finger, C3HC4 type (RING finger)
  misc_feature: Useful for making plants with altered lignin content
SKRPVSEIDVEREEECGICMEMNSKVVLPTCSHAMCIKCYRQWRSRSQSCPFCRDSLKRVNSGDLWMFTDCRDVVDMATVSRENIRRLFMYIEKLPLVMPENIFYAYDSHVK

SEQ ID NO: 11628 - DNA, 678 bp, Panicum virgatum
  misc_feature: Ceres CLONE 1748009
  misc_feature: Encodes the peptide sequence at SEQ ID NO. 11629
attcccccacacagcaccactgcaacacacacagcatttgcttaattagctaataagcacgaccctatcggtactaatggcggctttgatgatgaagaacaagaagcagatgccggcggtggtggcgttggccgttgtggtggcggcggcggcgctggtggcgtcggcgtcggcggccatcacgtgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagctcggaccggcaggcggcatgccggtgcctcaagagcctggccagcaccgtcaagtcggtgaacatgggcaccgtcgccaccatccccggcaagtgcggcgtctccgtgccattccccatcagcatgtccactgactgcaacaaattttcgctcgattgctctagagtcattcccttggaaacaacagagagagatgagatgcagtgagataggagggccagctgcgcgatgaccttaccgggccgggccgggccgggccgagcggtgaccacacggcccgtctctggcctgcttcttctgtttacctgcctgcagcgggggctgagggagctcatcgacctcctccgacagcgtcgagggcgaggcgacgcgac

SEQ ID NO: 11629 - protein, 144 aa, Panicum virgatum
  misc_feature: Ceres CLONE 1748009
  misc_feature (37)..(122): Pfam Name: Tryp_alpha_amyl Pfam Description: Protease inhibitor/seed storage/LTP family
MAALMMKNKKQMPAVVALAVVVAAAALVASASAAITCGQVGSALAPCIPYATGKASALPSSCCGGVRSLNSAARTSSDRQAACRCLKSLASTVKSVNMGTVATIPGKCGVSVPFPISMSTDCNKFSLDCSRVIPLETTERDEMQ

SEQ ID NO: 11630 - DNA, 666 bp, Panicum virgatum
  misc_feature: Ceres CLONE 1748009-R
ctgcctcctttttaatgcctacactggtaccaaggtgaagaccccaaaactcccatgcaacaattaccttggttggttttctggcataggcgtccttacggctccattcagctcactcgactctcgcgtcctccttttctcgaaggcttcaatgtttgagtggcaggttggaacaaaatcctggtcagttcatcctcttgctcttgatcatgaacgcatccatcagattgtgttcttcaaaggtcatatccttgtcatagatgctcttatgagacttcacactgtgcaactgacacctcagttcagcatgaaagaagtagcaattatgtggcaggccctgcagaccttgcctgttaacccatgtttggtggcctgtggtgacatgcttctcatggttgacttcacgtttgtctcacttgcctctgacgagcttagtaactattctagaacctttgaggaggttgagttttctagaatctttgaggtctttcgccttgacttctcggtcaaaccagctaagtggggtgaagatggaaaagttggaaaatcaagctctgtttgttagccttgataagaggaatcctgcattttgttacatgaaccctgaaagatggggaggaaagagtaactgcatttatgttgctagactaattgaggatcttgatg

SEQ ID NO: 11631 - DNA, 1729 bp, Panicum virgatum
  misc_feature: Ceres CLONE 1748018
  misc_feature: Encodes the peptide sequence at SEQ ID NO. 11632
accccgtcatcccctcctccaccctcgccctcgtcctctcatcgccgtcgccactcccgtctcgcctcccgcagccgccatggacccagtcgcctcgtggggtctgaccccgctcgccggcgccgacccggaggtgtacgacctcctggagcgcgagaagcggcgccagcggcgcggcatcgagctcatcgcctccgagaacttcacctccttcgccgtcatggaggcgctcagctccccgctcaccaacaagtactccgagggcatgcccggcgcccgctactacggcggcaacgacgtcatcgacgagatcgagaacctctgccgttcccgcgcgctcgccgccttccgcctcgacccggccgcctggggcgtcaacgtgcagccctactcgggctcccccgccaacttcgccgcctacaccgcgctgctcaacccgcacgaccggatcatgggcctcgacctcccctccggcggccacctcacccacgggtactacaccgccggcggaaagaagatctccaccacctcgatctatttcgagaacctgccgtacaaggtgagcgccaccacagggtacatcgactacgagaagctcgaggagaaggccctcgacttccgccccaagctcatcatctgcggtggcagcgcgtaccccagggattaggactacgccaggctcagggccgtcgccgacaaggtcggggcgctgctcctctgcgacatggcgcacatcagcgggctcgtcgccgcgcaggaagctgcaaatccttttgagtattgtgatgtggttactactaccacacacaagtctcttcgtgggccaagggctggaatgattttctacaagaaaggccctaagcccccaaagaagggccagcctgagggtgctgtgtatgactatgaagacaagatcaactttgcagtgttcccatctctgcaaggtgggcctcacaaccaccagattgcggcacttgctgttgctctgcagcagactatgacacctggcttcaaggcctatgcaaagcaagtgaaggcgaatgctgtttccattggaaactatctcatgagcaagggctacaagatggtgactgatggaactgagaaccaccttgttctctgggatctccgtcctcttggcttgaccggaaacaaggttgaaaagctctgtgacctttgtcacatcacattgaacaagaatactgtcttcggtgacagcagtgcattggctccgggtggtgtccgcattggtgcccccgcgatgacctcgaggggtctggtggagaaagactttgagcagattggtgagttcctccaccaggcggtgaccatctgcctgaacatccagaaggagtatggcaagctcctcaaggacttcaacaagggccttgtgaacaacaaggacattgagaacctcagggctgaggtggagaagtttgctgactccttcgacatgcctgggttcacgctcgagagcatgaagtacaaggagtagacacctcctctgtgcgcctaggcaagactctcctgtactgatgtcattcttcgccgcactgccatgctcatgatgatgatgatgccttatggattttgtctaccccatcaacaggataggctcataagcgccccctgcgcctctggtttggtcgccttcctcagtgtttcagttttttctatgtaggagttgttttgctcagaatcatatgggaatgtcaatcaggtgtttgcc

SEQ ID NO: 11632 - protein, 256 aa, Panicum virgatum
  misc_feature: Ceres CLONE 1748018
  misc_feature (1)..(197): Pfam Name: SHMT Pfam Description: Serine hydroxymethyltransferase
  misc_feature: SWISSPROT Homolog: EC 2.1.2.1 Glycine hydroxymethyltransferase
  misc_feature: Useful for making plants with modulated nitrogen use efficiency
MAHISGLVAAQEAANPFEYCDVVTTTTHKSLRGPRAGMIFYKKGPKPPKKGQPEGAVYDYEDKINFAVFPSLQGGPHNHQIAALAVALQQTMTPGFKAYAKQVKANAVSIGNYLMSKGYKMVTDGTENHLVLWDLRPLGLTGNKVEKLCDLCHITLNKNTVFGDSSALAPGGVRIGAPAMTSRGLVEKDFEQIGEFLHQAVTICLNIQKEYGKLLKDFNKGLVNNKDIENLRAEVEKFADSFDMPGFTLESMKYKE

SEQ ID NO: 11633 - DNA, 1600 bp, Panicum virgatum
  misc_feature: Ceres CLONE 1748021
  misc_feature: Encodes the peptide sequence at SEQ ID NO. 11634
atctcctccctcctgtttctcttctcgaacctttccttctctggaagagaaactctctcctgatctccctggcggcggcgactgggcgagcggcggcccagccctttgccggcgactagcgcatcctccagggaacagttgcatctctcccctgagaggatcaatgtgcaactatcacgactaccacgctgaagagatggaggatgattatgattacgacatggatgatcctgttgatgacatggtcgatgagcatcaagagcgagagtttagggactccgattcggatgatgacgattatgtccgctcgaatgctgatatcccagatacttcatcagcagacgcaagaaaaggaaaagacatgcaaggaattgtctgggagaggctagctgtaactcgtgaaaaatacaggcagactagattagaacagtacaaaaattatgagaatgtgcccaattctggtgaagaagcaatgaaggattgcaaaccaacagagaaaggtggcatgtattatgagttcaggcaaaatattagatcagtaaaatcaactattctacattttcagctgagaaatttggtgtgggctacatctaagcatgacgtctactttacgtcacattactcaattcgtcactggtcagcattgagtggtgccaatactgaactgatgaatgtcgaaggacatgtggcaccaagggagaaacgctcggggagtttatcagagggtttttctcagactcaagttagtaccttggcggtcaaggataatttgctggtagctggtggtttacaaggagagctaatctgcaaacaccttgatcgggaaggaattagtttttgctgccgaacaacttatgatgacaacgctattaccaatgcggttgagatattcaatacctctagcggcgccgttcacttcatagcatcaaataacgactctggtgtgcgagactatgacatggagagattccaactctgcaaatattttcagttcgaatggccagtgaatcatacttcattgagtcctgacagaaaggtggttgttattgtgggggatgaccctgatggtttacttatcgatgccagctccggaaagactcttcattgtataaaaggtcatcgggactactcgtttgcatcggcttggagcccagatgggcgaacatttgctactggtaaccaagataagacatgccggatctgggacacgaggaacctctcaaaagccgtccatgttctgaggggtaacctaggagccgtccggtcgatccgcttcacctcggatgggcagttcatgtcgatggcggaaccagccgactttgtgcacatctacgacgtgaagagcgactacaacagaaggcaagagctggacttctttggcgagatatccggcatgtccttcagccccgacaccgacatgcttttcgtcggggtctgggacagggtgtacggcagcctgcttcagttcggccgcaaaatgtagtgcttgtatcttatcttagtagatactattgttgtgtccctccgcaaaatgtagtgcttgtatcttagtagatactattgttgccatctcgtcaaaaaatgactacaggtttctcag

SEQ ID NO: 11634 - protein, 439 aa, Panicum virgatum
  misc_feature: Ceres CLONE 1748021
  misc_feature (310)..(348): Pfam Name: WD40 Pfam Description: WD domain, G-beta repeat
  misc_feature: SWISSPROT Homolog: EC 2.3.1.48 Histone acetyltransferase
MCNYHDYHAEEMEDDYDYDMDDPVDDMVDEHQEREFRDSDSDDDDYVRSNADIPDTSSADARKGKDMQGIVWERLAVTREKYRQTRLEQYKNYENVPNSGEEAMKDCKPTEKGGMYYEFRQNIRSVKSTILHFQLRNLVWATSKHDVYFTSHYSIRHWSALSGANTELMNVEGHVAPREKRSGSLSEGFSQTQVSTLAVKDNLLVAGGLQGELICKHLDREGISFCCRTTYDDNAITNAVEIFNTSSGAVHFIASNNDSGVRDYDMERFQLCKYFQFEWPVNHTSLSPDRKVVVIVGDDPDGLLIDASSGKTLHCIKGHRDYSFASAWSPDGRTFATGNQDKTCRIWDTRNLSKAVHVLRGNLGAVRSIRFTSDGQFMSMAEPADFVHIYDVKSDYNRRQELDFFGEISGMSFSPDTDMLFVGVWDRVYGSLLQFGRKM

SEQ ID NO: 11635 - DNA, 1849 bp, Panicum virgatum
  misc_feature: Ceres CLONE 1748072
  misc_feature: Encodes the peptide sequence at SEQ ID NO. 11636
atccgcacggttgctgcgacacttgtcatgcgggccccgcacgcgtgttgcacggcccctcggccccgctccgtcctctgcggccaccaaactctgcgcgcctcgctgtggtcggtcggtcggtccctgtgctccggaggttgagcctgaatgaacagtagtatgcgatagaatctgaggagcaagaggctggctcaccagcttcttccccaccaaacgacgccttttcgccttccctaatcgccctggcgtcaactaaggcttgaccattccggctaatagttgtaaggaggaccaaattgggggaaatgatagatcagggaaagttcagggcgtgatcttcatctatttttctgagctgttgttgtcagtattcgttatgtagacgaacatccggcactgcagggcaatttgcgctgcccattcaggccataactgctgaaaatatcagaaattcagaatccggtccacggggggttacacttaagaacaatagtaatgattctgccatctgtgtggaactggaaggaacgttgaagggtctgtggctgatgttgggatgcaccgttttctgcaggttgctgctagcaaaacgaagatttacatggtgcttgagttcgtcgacggcggcgagctctttgacaagattgctgtaaagaggaaactgtctgaacatgagggaaggaggcttttccagcagctaattgacggcgcgagctactgccacgataaaggtgtctaccacagggaccttaagccagagaacgttcttgttgatcggaagggcaacatcaagatctccgacttcggccttagtgctctacctcaacatctcgggaatgatggacttctgcacacaacatgtggcagccccaattacatcgctcctgaggttttgcaaaatagaggttatgatggctccttgtcggatatctggtcttgtggggtaatcctatatgtaatgcttgttggttaccttccgttcgatgacaggaatcttgttgttctttatcagaagattttcaagggagactgtcagatcccaaagtggctttcacctgctgcacaggaccttcttaggaagattcttgaaccaaatccaatgaaaaggatcaacatcatgggcatcaaagagcatgagtggtttcagaaggactacgttcctgccgttccatacgatgacgatgaagatttacttcctagttcagttctcccaatcaaagagcaaattgatgaatcagcacaagaaaagcctactcatatcaacgcttttcagttgatcggaatggcttcgtcccttgatctttctggtttcttcgaggaagaggacgtggctcaaagaaagattcggttcacatcaacacattcacccaaggatttatttgacaagatggagaatgccgtgaccgagatgggattcaaagtccataggggaccaagaaagctcaaagtattgaaaaattgcaaaacttccaagaactccaggagtcccgcatcatttttggtgtgcattgaggtgtttgagctagggccgtctttgtatgtcgtagaactgaaaaaatcccatggagattctatattgtatagacagttgtgtgagaggctctcagatgagctggcggtgtgcaagacagaggagattatgaggacagaatcgctgggtgactcagacatgtcgagccttgatggcgaagcactacctttgtctggtttctgatcattgcttccctgtgtggttttgggcacaggggacgagggacatactcgttcctgatgcagttctagattaggaaatcttgtacaaagcgtgtggcgcaaattagccaccatgttgaatattgttgtagcc

SEQ ID NO: 11636 - protein, 385 aa, Panicum virgatum
  misc_feature: Ceres CLONE 1748072
  misc_feature (3)..(196): Pfam Name: Pkinase Pfam Description: Protein kinase domain
  misc_feature (231)..(291): Pfam Name: NAF Pfam Description: NAF domain
  misc_feature: SWISSPROT Homolog: EC 2.7.11.1 Non-specific serine/threonine protein kinase
MHRFLQVAASKTKIYMVLEFVDGGELFDKIAVKRKLSEHEGRRLFQQLIDGASYCHDKGVYHRDLKPENVLVDRKGNIKISDFGLSALPQHLGNDGLLHTTCGSPNYIAPEVLQNRGYDGSLSDIWSCGVILYVMLVGYLPFDDRNLVVLYQKIFKGDCQIPKWLSPAAQDLLRKILEPNPMKRINIMGIKEHEWFQKDYVPAVPYDDDEDLLPSSVLPIKEQIDESAQEKPTHINAFQLIGMASSLDLSGFFEEEDVAQRKIRFTSTHSPKDLFDKMENAVTEMGFKVHRGPRKLKVLKNCKTSKNSRSPASFLVCIEVFELGPSLYVVELKKSHGDSILYRQLCERLSDELAVCKTEEIMRTESLGDSDMSSLDGEALPLSGF

SEQ ID NO: 11637 - DNA, 1702 bp, Panicum virgatum
  misc_feature: Ceres CLONE 1748087
  misc_feature: Encodes the peptide sequence at SEQ ID NO. 11638
ctggaacgcgagcacacaagtcatctcctccctcttgtctggctcgggtagttggcgcgcgacctgagagcacaggggagcgagaagatgaccggagcagcggcggtcgacgtgccggcgccggcggcggccaacggcggggcgtgctgccacgccgcgaaggggcccgggtacgcgacgccgctggaggccatggagaagggccccagggagaagctcatctacgtcacctgcgtctacaacggcactggcattaacaagccagattaccttgcgacggtggatttggaccccagctctcctacatactcccaagtgatccacaggctcccagtgacccacatcggcgacgagttgcatcactctggctggaactcttgcagctcctgccatggcgatccatcagcgaagcgccgtttcttgatcctgccttcattgctgtcaggtcgtgtgtatgttgtggacactgcaacagacccgagggcgccatccttgcataaggtggtccagaccgaggacattgctgagaagaccgggcttgggtttcctcacacatcgcattgccttgcatctggtgacattatgatttcttgccttggggacaaggaggggaatgcagccggcaatggctttctcctgttggattcagagtttaatgtcaaagggcgttgggaaaagccaggtcacagccccttgtttggctatgacttctggtaccagcctcgtcacaagacgatgatcagttcatcatggggagcccctgcagccttcaggacaggtttcaatcttcaacatgtccaggatggtctctacggaaggcatcttcatgtgtatgattggcctggtggtgagctcaagcagacccttgatctaggagacacgggacttcttccccttgaggtgaggtttttacatgacccatcaaaggacaccggttacgttggatgtgctttgacaagcaacatggttatatttttcaaaaccgcagatggatcatggagccacgaggttgctatcgatgtaaaaccactgaaggttcgcaactggattctgccagaaatgccaggattgataactgattttgttatctctcttgatgaccgctatctctacttggtcaattggcttcatggggatatcaggcagtacaacattgaggaccctgccaagcctgtcttggcaggacaagtatgggttggtgggcttcttcagaagggcagcgatgtcgtctatgttactgatgatggccatgaagaacagtataatgtgccccaggtcaaggggcatcgacttagaggtggacctcagatgattcagctgagcttggatggcaagaggatatacgtaaccaactcacttttcagccgttgggatgagcagttcttcggtgatgatcttgtcaagaagggctcccacatgctgcagatcgatgttgacactgagaaaggaggattggctatcaaccccaacttcttcgtagattttagcaaggagcctgatggtcctgccttggcccatgagatgagatatcccggtggggactgcacgtctgatatatggatctaaggtcatggattggcatatagcctgcaggaggtccttgttgtatgcactgtaattaagatggtattatgcagcgtttcatcttgtactgtgactactgccactggaataatccatagtttcataagagcttgagctt

SEQ ID NO: 11638 - protein, 492 aa, Panicum virgatum
  misc_feature: Ceres CLONE 1748087
  misc_feature (23)..(492): Pfam Name: SBP56 Pfam Description: 56kDa selenium binding protein (SBP56)
MTGAAAVDVPAPAAANGGACCHAAKGPGYATPLEAMEKGPREKLIYVTCVYNGTGINKPDYLATVDLDPSSPTYSQVIHRLPVTHIGDELHHSGWNSCSSCHGDPSAKRRFLILPSLLSGRVYVVDTATDPRAPSLHKVVQTEDIAEKTGLGFPHTSHCLASGDIMISCLGDKEGNAAGNGFLLLDSEFNVKGRWEKPGHSPLFGYDFWYQPRHKTMISSSWGAPAAFRTGFNLQHVQDGLYGRHLHVYDWPGGELKQTLDLGDTGLLPLEVRFLHDPSKDTGYVGCALTSNMVIFFKTADGSWSHEVAIDVKPLKVRNWILPEMPGLITDFVISLDDRYLYLVNWLHGDIRQYNIEDPAKPVLAGQVWVGGLLQKGSDVVYVTDDGHEEQYNVPQVKGHRLRGGPQMIQLSLDGKRIYVTNSLFSRWDEQFFGDDLVKKGSHMLQIDVDTEKGGLAINPNFFVDFSKEPDGPALAHEMRYPGGDCTSDIWI

SEQ ID NO: 11639 - DNA, 1894 bp, Panicum virgatum
  misc_feature: Ceres CLONE 1748116
  misc_feature: Encodes the peptide sequence at SEQ ID NO. 11640
cacgactctcttcccatttccccccctcaccttccccacacggctgcgctagctccctcatcgtcttccccagcacacacacctcctcagccatggcggcgccgagctggatccggctccggccgccgcgagccgccctcctcatcctgctgctcctcgccatcaacctcaccttctccatcgccgccaccttcgagggcttcgactccgacgacctcccctccgcggccggcggcctcgatgctgacgatgacgaggaggggctcgacggcgtcgacctcccgccccctccgcccatctccctctccacctccgcgccttcccctcccgtgacgacgacttcggcgccgaaccctaaccccgccacgcccacgcctccgaagccgaccccggcgctcgatctctgagacgaggacgaggacgagttcgagggcatccccgtgccggaaccgatctcctccgaagactccgccgcaccggccgaggccgccccttcagatccctccgcggaggcggaggccgaggctgcgccggccccgaagaggaccccggcggagctcctccgcgccttctccgttgagatcgcctgcgtcagcttcctgatctgcttcgtgctcaactacttcacggggaagaagcagaacgagaacatcgcgctggcctgggccaccaagttcgccacgagggactccatcttcgacaagaacttcagcctcctcggcaccggggatgacaaggacacgcccctcctgctcaaggagggccaggacgtgttcaagttctacgccagcgggaggcgcttctgccagggcatgctcgctaccatggagatgcgcgcgcggcacgacctgctgtccaagttcgtggagctggtgttccccaggaaggacaccatcacgttcgaggtggtgatgaacgaggacgccatggaccatgtggttctggccgttgccaggaagaaggcagccaagacgatgcagaaagaggagagggatttgcaaaggtttgccaacgttctcacttcggcacccgctgggaggaagtgggtgtcggatgagcttgctgtggtggctgagtcaaaggaggttgctggggatatgatcactgaggctgtgcttgaccaggtccttggtgagaaggcatttgagaaatttggaaagtggttcatctcgcttcatttttcagatcaattggcaggatcctacaagaaggtcctcacgttcaagtttgtactgccagatgcaagcaacatgtctgagatgacaagattggttgctcttgtgccatactacattgatctggttggacgttataagctcagctcgtatgctcgctcgaaaactgatggagctagaacaaaggctgctcaggaggcctccagggaacttcagagtgccaggcaggaggccctgcaaaggaagaaggccgaaaagaagaaacttatggaggaggcagaagccaagttgagcgccgaggcactccgaaagaaagaagaaaaagaaagggctcggcagatgaagaagtctggacccaaagtgaaaatgctccgttcttaataacgtcaagaatctatcatagctcgagcttctgctattcactcagttgattagcctatagttcagtgcctgctagactctcatttatgttccaattttgggccatcgtgttgccctgttgtgagaatgagcaaaaaggattgaggagaaaagaatcctcacaggtgtttcggctttatggatgcgtgccagagagatcttagcccaatttgcccacgatagttcagtcaccttaaaaattggcaatgcagcagccctgttgtaagaaaactagaacttacatgatccgctgtgtagaatgttgatagaattatgatatgaagttcaatgcttgggtt

SEQ ID NO: 11640 - protein, 243 aa, Panicum virgatum
  misc_feature: Ceres CLONE 1748116
  misc_feature: Useful for making plants with modulated biomass
MEMRARHDLLSKFVELVFPRKDTITFEVVMNEDAMDHVVLAVARKKAAKTMQKEERDLQRFANVLTSAPAGRKWVSDELAVVAESKEVAGDMITEAVLDQVLGEKAFEKFGKWFISLHFSDQLAGSYKKVLTFKFVLPDASNMSEMTRLVALVPYYIDLVGRYKLSSYARSKTDGARTKAAQEASRELQSARQEALQRKKAEKKKLMEEAEAKLSAEALRKKEEKERARQMKKSGPKVKMLRS

SEQ ID NO: 11641 - DNA, 1801 bp, Panicum virgatum
  misc_feature: Ceres CLONE 1748128
  misc_feature: Encodes the peptide sequence at SEQ ID NO. 11642
agccgcattcattgggcagtccgcagcgcagcaaagccgtcgtctccgactcgtctccgtgttctctccgtcgcacgcagcgcagccgtcgggcttctctcctctcttcctcgcagtggagtccaggcctccaccaccagatagatctaatcgatcgatccggatccttcccttccatctcacgccgccgccttcgccttcgccgccgccgcagatctcccgcgaaccctaacgactcggcagcttcccttgctcggctcggggaaccggagttggcgttgcgatggcgctgcagtacgtggaggcgcagcggcaggcgcgcccggacctcgccgactggtacgcctccctcgccgacctctaccagcggaagctgtggcaccagctcaccctcaagctcgaccaattcctacagctccaggcagcacagactggagacactatcattcagctctacaacaacttcatcactgacttcgagaccaagattaatctgctaaagcttgcccattttgcggtgatagcttctcgccaatatcctgacaaggatgctgcaattactttcttagagggggtgatcacaaagttgcgtgagacaagggagtcgcggattaatgagccaattctctacgtgaagatgcaaattgcagcaattaatcttgagaaaggaaaccaaaaggagtgcaagaatttgttggaggaagggaaaaccactctggatagtatgaccgatgttgatcccacagttcatgctaacttttactggatatcatctcaataccacaaggcccgccaagaatttgctgagttctacaagaacgctcttctctatctggcctacacaactgtggaatctctctctgagtcattcaagctggacttggcatttgatctttctctctcggccttgcttggtgataacatttacaactttggggaattgttatcacacccaattatcaatagtcttattggaaccaaggtggagtgggtctaccatatgttacaagcgttcaacaccggtaaccttgctctctaccaagaactttgcagggttcacaaagccgcacttactgcacagccagctttggtgcagaatgaacggaagctgcttgagaagatcaacattctttgtctgatggagataatctttagccgtccatcagaagatagaactatcccattgagtgttattgctgagcggactaagctttctatcagtgatgtcgagtatcttcttatgaagagcctctcggttcatcttattgagggaataattgatgaagtagacagtacagttcacgtctcgtgggtccagcctagagtacttggaattccacaggtcaaggctttgcgcgagaggctggatgcctgggttggaaaagtgcataccacattgctttcagttgaggcggagacccctgatcttgttgctgcataattttgcgtctgttccacttctgcgagaggcttggtcagcgatgtcttgatgtgaagtgtgagatgctctgtgtgtgacgcttgtagtcaccgtcttctggataatgaaacttgctgccctgagcattctgcctgcctgtgactgcgtcctactgatcgaggcctgtaatttcctttttgttatcctttggacatggatggttagaacttcacggagtgtcattgagacgaggccaatggattggaaatttcatactagcagggtgttactgtagtttccaagttgaatttgatttgtaactgagtttatactcgtccgttggacatggatgcaggaaaatcttgctgaatctttcaagtc

SEQ ID NO: 11642 - protein, 385 aa, Panicum virgatum
  misc_feature: Ceres CLONE 1748128
  misc_feature (235)..(343): Pfam Name: PCI Pfam Description: PCI domain
MALQYVEAQRQARPDLADWYASLADLYQRKLWHQLTLKLDQFLQLQAAQTGDTIIQLYNNFITDFETKINLLKLAHFAVIASRQYPDKDAAITFLEGVITKLRETRESRINEPILYVKMQIAAINLEKGNQKECKNLLEEGKTTLDSMTDVDPTVHANFYWISSQYHKARQEFAEFYKNALLYLAYTTVESLSESFKLDLAFDLSLSALLGDNIYNFGELLSHPIINSLIGTKVEWVYHMLQAFNTGNLALYQELCRVHKAALTAQPALVQNERKLLEKINILCLMEIIFSRPSEDRTIPLSVIAERTKLSISDVEYLLMKSLSVHLIEGIIDEVDSTVHVSWVQPRVLGIPQVKALRERLDAWVGKVHTTLLSVEAETPDLVAA

SEQ ID NO: 11643 - DNA, 1773 bp, Panicum virgatum
  misc_feature: Ceres CLONE 1748159
  misc_feature: Encodes the peptide sequence at SEQ ID NO. 11644
acctgtgcgcttcgcttgcctctcctctcctctagcgcgcttgcgagctttgcttcccctcctgccgcctcccccaactcctccctgtctctcctctgattctccctgcgctctgcgcgaggagaggggtgacgtgccgcgcaaggctccacagcggcgagaggtccgcggcgcgagctcgcttccgtgcctggtgtgctgtactgctgaattatcagggaagaacacagaaatcatggaaatcggcttattgcaggatgaatctgatgcagcaaccaccagtttgctaccactgccactgttgtcatgcggccctcgatctatggttccaatatcagtaccatcatcatctgaccttgagagtatcctctcgccagatccaatcttcagtgatcttcagttgaaagagataaactacaatgctccagcaatggacgaaagcactgagctccttcacctgattcttagtggcaatgatgaagtatacaataatacagtggacttccaagtctgggatgctctggacttctatgtcacagaaaacttttctactttccagtttgatagcttaatgggtttttcaaacgaagttagtacttcctacaatgactgtatgaacttagttgacatggtagagcggcctgtggctctcttgtctctagatgactcaccggagccaaataacactagcactgaggttccggtagatcacactacactggaccctgatgacacatccttgtaccttcagacgaaaccaacagattcagaaactgaaagtagttctgccgctggggatgtggttgaaactgaatatcttgatcaaaagctactttctagagatctgcctgatttaatggatgttgactcgcccagtggcttaacaaaaacaccagtgagaacaaaacatgtgactcttgtgctggatttggatgagactcttgtacattcaacattggatcactgcgacaatgctgattttactctagaagttttctttaatatgaaaaatcatacagtctatgtgagaaaaaggccttacttgaagatgtttcttgagaaggttgcccagatgtttgagcttgtcattttcacagctagtcagagaatctatgctgagcagcttatagatagacttgatcctgatgggaaatatatttcacgacgaatttaccgtgaatcatgtttattctctgatggttgctatacaaaggacttgacaattctaggggttgacttggcaaaagttgcaataattgataatactccacaggttttccagttgcaagtggataacggcataccaatcaagagctggtttgatgacccctcagatcaggaattggttgagttactcccgttcctagagagcctcgtggatgcagaggatgttaggccaatgatctcaaagaccttccacgacaaactggagcagaattagttttagaggcatacatatcaatcattttatctggtgatcgaaccttaggttcgcttcacttggggcaggccattcttgggaaattaggtataggataattcgccatttatgttatattagctgttacgaatagcaagcataaactgcagttgtcgatgaaagtggcttgtatatgtatgtttcttctgttacagatcattgtacagaaaacgaacaatagtgctgaataagtgatctgagtgcaatttttgttgtgagagtttagaaagtgagtttgagttggttgtattccttatcccgcttttaaagcagagtccaatattgtgatttgt

SEQ ID NO: 11644 - protein, 401 aa, Panicum virgatum
  misc_feature: Ceres CLONE 1748159
  misc_feature (217)..(392): Pfam Name: NIF Pfam Description: NLI interacting factor-like phosphatase
  misc_feature: SWISSPROT Homolog: EC 3.1.3.16 Phosphoprotein phosphatase
MEIGLLQDESDAATTSLLPLPLLSCGPRSMVPISVPSSSDLESILSPDPIFSDLQLKEINYNAPAMDESTELLHLILSGNDEVYNNTVDFQVWDALDFYVTENFSTFQFDSLMGFSNEVSTSYNDCMNLVDMVERPVALLSLDDSPEPNNTSTEVPVDHTTLDPDDTSLYLQTKPTDSETESSSAAGDVVETEYLDQKLLSRDLPDLMDVDSPSGLTKTPVRTKHVTLVLDLDETLVHSTLDHCDNADFTLEVFFNMKNHTVYVRKRPYLKMFLEKVAQMFELVIFTASQRIYAEQLIDRLDPDGKYISRRIYRESCLFSDGCYTKDLTILGVDLAKVAIIDNTPQVFQLQVDNGIPIKSWFDDPSDQELVELLPFLESLVDAEDVRPMISKTFHDKLEQN

SEQ ID NO: 11645 - DNA, 769 bp, Panicum virgatum
  misc_feature: Ceres CLONE 1748160
  misc_feature: Encodes the peptide sequence at SEQ ID NO. 11646
gtgcagcggcaatccggctccagcagtaggccggagccagccgttccggtgccgcccaggtcctggggattgggtgtagggatcggggaccggaatggcgaagcggctcctcgccgccgtgctcctcgtcgcggctctcgcctgcggcggcgcccacgccaagttcaacaggcacagcttccccaagggcttcgtcttcggcaccggctccgcggcgtaccagtacgagggcgcctacaaggaaggaggcaaagggctcagtatatgggacaacttcactcacatcccaggaaaaatcatgaacaacgataatggcgacgtggcagaggacatgtaccatcgatacaaggaggatgtgcaactcctcaaggacatgaacttggacgccttccgcttctccatcgcctggaccaggatcctgccaaatggttccctgagtggaggagtgaacaaagaaggtgtggccttctacaacaacctcatcaacgaggtcctagccaaagggctgaggccatttgtcaccatcttccactgggacacgcccctggccctggaggagaagtacggaggcttcctcagtgaaaacatcatcaaggactacgtggacttcgccgacgtgtgcttccgcgagttcggcgaccgcgtcaaggactggacgacgttcaacgagccctggacgtacgcccagcgcgggtacgtcgtcggccagttcgcgccggggcggtgctcgccgcacgtctccaagtcgtgcttccccggcgactcggcg

SEQ ID NO: 11646 - protein, 224 aa, Panicum virgatum
  misc_feature: Ceres CLONE 1748160
  misc_feature (25)..(223): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered carbohydrate content
  misc_feature: Useful for making plants with altered cell wall content and/or composition
  misc_feature: Useful for making plants with modulated biomass
  misc_feature: Useful for making plants with modulated flowering time
MAKRLLAAVLLVAALACGGAHAKFNRHSFPKGFVFGTGSAAYQYEGAYKEGGKGLSIWDNFTHIPGKIMNNDNGDVAEDMYHRYKEDVQLLKDMNLDAFRFSIAWTRILPNGSLSGGVNKEGVAFYNNLINEVLAKGLRPFVTIFHWDTPLALEEKYGGFLSENIIKDYVDFADVCFREFGDRVKDWTTFNEPWTYAQRGYVVGQFAPGRCSPHVSKSCFPGDS

SEQ ID NO: 11647 - DNA, 753 bp, Panicum virgatum
  misc_feature: Ceres CLONE 1748191
  misc_feature: Encodes the peptide sequence at SEQ ID NO. 11648
agtggtagtggcagccgccctcgaagccgcgcgcgagtgatggcgtcgtggtcgtcgccctccgccgccgccgcggcctcggcctcctcgggcgcccgattcggccttctccccggccgggcgcagcggcagcccgtcccctccccgtcgctgccccggggagcccccaacccccggctcgtcctcagccgcggccctggcttcctcacgcccactgggtccgcttccccgtcctcctcctcgagatgccgcgccgtcgccgccgaggtcgagggcctcaacatcgccaacgacgtcacccagctcatcggcaagacgccaatggtatatctcaacaacatcgtcaagggcgctgtctccaatgttgctgctaagcttgagattatggagccctgttgcagtgtcaaggacaggataggatacagtatgataaatgatgccgaagagaagggcctgattactcctggaaagagtgtgttggtggaagcaacaagtggaaatacaggcattggtcttgcctttatcgctgcttccaagggatataagttgatattgacaatgccttcatcaatgagtatggagagaagagtcctactgagagcttttggtgctgaacttgtccttactgatgctgcaaaagggatgaaaggggccttagacaaggccacggagattttaaataagacccccaattcatacatgctccagcaatttgataaccctgcccacccaaaggtacattatgagactact

SEQ ID NO: 11648 - protein, 237 aa, Panicum virgatum
  misc_feature: Ceres CLONE 1748191
  misc_feature (86)..(237): Pfam Name: PALP Pfam Description: Pyridoxal-phosphate dependent enzyme
  misc_feature: SWISSPROT Homolog: EC 2.5.1.47 Cysteine synthase
MASWSSPSAAAAASASSGARFGLLPGRAQRQPVPSPSLPRGAPNPRLVLSRGPGFLTPTGSASPSSSSRCRAVAAEVEGLNIANDVTQLIGKTPMVYLNNIVKGAVSNVAAKLEIMEPCCSVKDRIGYSMINDAEEKGLITPGKSVLVEATSGNTGIGLAFIAASKGYKLILTMPSSMSMERRVLLRAFGAELVLTDAAKGMKGALDKATEILNKTPNSYMLQQFDNPAHPKVHYET

SEQ ID NO: 11649 - DNA, 1702 bp, Panicum virgatum
  misc_feature: Ceres CLONE 1748209
  misc_feature: Encodes the peptide sequence at SEQ ID NO. 11650
ctcctcctccctgcctcgccctccccctttcccctccgcgtccagggcccgggccacccacccagccgcggatccgaggcgcagatccgatccggcgatggcgtccacggcggcgaggcggctgcgggagctgcaggcgcagacggggaacaagacctgcgtggactgcgcgcagcggaacccgcagtgggcgagcgtctcctacggggtgttcatgtgcctcgagtgctcgggcaagcaccgcggcctcggcgtgcacatcagcttcgtgcgctccgtcaccatggactcctggaccgaggcgcagctccgcaagatggaggccggcggcaacgaccgcctcaacgccttcctcgccgcgcggggcgtgcccaaggagacgccccacgtcgccaagtacaactccaacgccgcggccgcctaccgcaaccgcatcgtcgcgctcgccgagggcaggccgtggaccgacccgcccgttgtcaaggagacgcccggatctggggcgcccgcccccgccaggaagccgcccgtgcacgcctccgccgcgtccggaggcggcggtggcggcgacggcggctgggacgagtgggacgacgacttccggccggacatgaggcggaaccaatcggttggatcattcgccgccgcggggacgcagtcggggaggcagccgcctaggtccaaatcgacgcaggacatgtacactaggcagcagctggaggcgtcggcggcaaataaggaggatttcttcgccaggaggatggcggagaacgagtccaagcctgaggggatcccgccatctcagggcggcaagtacgttgggttcggatccagcccggcgccgtcggcgaataggaatggcggtgctgcccagggcgatgtcatgcaggtcgtctcccagggatttggacgtctttcgctagttgcagcatctgctgcccagtctgctgccagtgttgtccaagtcagcacaaaagaaatccaatcaaagatgagggaagggggctatgaccagaaggtgaatgaaactgtcagtgttgttgccaataaaactgcagagattggaagcaggacctgggggatcatgagaggagttgtggcgttggctacgcaaaaggtcgaggaatatgccaaggaaggaggagtaggtggctggggagatgattggcaacgcagtgagcagagcaatgagccttaccaaaggttccagcatgagaccaacggcaatggttggaactcttcccaaaattcttcatccaagaactacaattccaattcctgggacgattgggatgaccaaggcaagaaggacgagcctgcgaaaccgcaccagagcagtgactcatgggccggctgggatgacgggaaggatgacagtcctagttttagcaatcacagcacctccaacaagggtagcaaccagaacgggacctccggcggctcgtattggacggagggcggattccgctgaagtttctctctttcgacatagagctatactttcagggttgttattatatgccaggaaacttgagcgtccagtggttggtattattggggatactgaaacacttgggtaaaagggtttgtgtttttgtacgatgtctgcaactgttatatctagtggtatatttttgtggtaaaggcctgtccgaaaccgccgtccaaattactaaggaatgccgaattgaagctgtaattc

SEQ ID NO: 11650 - protein, 457 aa, Panicum virgatum
  misc_feature: Ceres CLONE 1748209
  misc_feature (6)..(122): Pfam Name: ArfGap Pfam Description: Putative GTPase activating protein for Arf
MASTAARRLRELQAQTGNKTCVDCAQRNPQWASVSYGVFMCLECSGKHRGLGVHISFVRSVTMDSWTEAQLRKMEAGGNDRLNAFLAARGVPKETPHVAKYNSNAAAAYRNRIVALAEGRPWTDPPVVKETPGSGAPAPARKPPVHASAASGGGGGGDGGWDEWDDDFRPDMRRNQSVGSFAAAGTQSGRQPPRSKSTQDMYTRQQLEASAANKEDFFARRMAENESKPEGIPPSQGGKYVGFGSSPAPSANRNGGAAQGDVMQVVSQGFGRLSLVAASAAQSAASVVQVSTKEIQSKMREGGYDQKVNETVSVVANKTAEIGSRTWGIMRGVVALATQKVEEYAKEGGVGGWGDDWQRSEQSNEPYQRFQHETNGNGWNSSQNSSSKNYNSNSWDDWDDQGKKDEPAKPHQSSDSWAGWDDGKDDSPSFSNHSTSNKGSNQNGTSGGSYWTEGGFR

SEQ ID NO: 11651 - DNA, 2050 bp, Panicum virgatum
  misc_feature: Ceres CLONE 1748233
  misc_feature: Encodes the peptide sequence at SEQ ID NO. 11652
agcgaaacaaaacggagcaagaacagcgccacatcgacatctcccaccttccttgggttccattcgatttggggagctcgggccgccggccgccgatgatctccgaaccgagcaccaatccgcggcgaggaggctccaccgggtaactgggaaagcggagcgaggcgatggcggatgccggcgcggcggccaatggcggcaggaacgggtacgcggtccttgatcggagcgaggatcaggagccggagctggacgcgcggaggaggccgccggtgcccgagagcgagaggaggaggagggagcggttcgtgttcgcctgcgcggtcttcgcctcgctcaacgccatcctcctcggctacgatgttggtgtcatgagtggctgcatcatctacatgcagaaagatctccacataaccgagtttcagcaagaaatactagtaggctgtctgagcgtggtctcactcttgggaagcctgtcagggggacgaacatctgatgtaattggcaggaaatggacaatgggcctcggtgcaattgtgttccagttaggcgccgtcatcatgacgtttgctccatcattcactgtgcttatgatcgggaggctcctagctggagtaggcattggctttggtgccatggtatctggagtgtacattgctgaaatctcccctgctggtgcccgtgggactctcacgtccctccctgagatatgcatcaattttgggatcctcctcggctatgtttccaattatgccttttccggcctttctgagcacatcaattggagagttatgcttggtgtcggtatccttccatctgtcttcattggctttgcacttttcgtgattccagagtcccctaggtggttggtgatggagaagagagtttcagaagccagggcagtgctgctacagataagtgagtctgaagctgaagtagaagaacggctggctgagattgaggaagccgcaggtcttatgaaatcaatgaaatctgaggagaaggaagtgtggaaagagcttctaaacccttctcctgctgttcgtcggatgctctatgctggctgtggtattcaattattccaacagattactggaattgatgctactgtctattacagcccaacaattttcaaggatgctgggatcaagtctgatcaggagcttcttgctgcgaccgtcgctgtgggtctcaccaagacagtgttcatcttggttgcaattttcctcattgataaagttggccggaagccacttctttatgtcagcacaattggcatgactgtatgcttgtttctcctaggagtggcacttacattgcaaaagcatgctgcggggatcatgtctccacgtattgggatcgatctagcaatttttgcagtttgtgggaatgtggcgttcttttcaatcggcataggaccaatatgttgggtcttgtcatcagaggtatttccattgagattacgagctcaaggatcagcgcttggtcaagtaggtggtagagtgagcagtggtttggtttccatgtcattcctttctatggcccgtgctatatcagtggcaggaacgttcttcgtcttcgctgcaatatcaattgtctctgtcctgtttgtgtacttttgtgtgccagaaacaaaagggaaaactctggagcagattgaaatgatgtttgaaagtgaggacgaatggagaggaggtgaaattgagcttgaggatacacaacatctaatacctagtaacaagaagtctttacctcttggctgatatccatattaacaagaacgtctgtagctccatgtttcaatgacaggccaacctcatcctgctttcatcatctgctggattcgaacttcatcttcaaaaatgatactttgaggacacagaaggacattggtattttagtaggcataggtgacagtagattgattattctgttagtctaaaagtttcctcatattgttatgtccaaaatggaagatggtcgacgtgtatgatgtttatgactggtgcatcttgcacaaaagaatatacttgctaaatagtctttctgc

SEQ ID NO: 11652 - protein, 531 aa, Panicum virgatum
  misc_feature: Ceres CLONE 1748233
  misc_feature (51)..(501): Pfam Name: Sugar_tr Pfam Description: Sugar (and other) transporter
MADAGAAANGGRNGYAVLDRSEDQEPELDARRRPPVPESERRRRERFVFACAVFASLNAILLGYDVGVMSGCIIYMQKDLHITEFQQEILVGCLSVVSLLGSLSGGRTSDVIGRKWTMGLGAIVFQLGAVIMTFAPSFTVLMIGRLLAGVGIGFGAMVSGVYIAEISPAGARGTLTSLPEICINFGILLGYVSNYAFSGLSEHINWRVMLGVGILPSVFIGFALFVIPESPRWLVMEKRVSEARAVLLQISESEAEVEERLAEIEEAAGLMKSMKSEEKEVWKELLNPSPAVRRMLYAGCGIQLFQQITGIDATVYYSPTIFKDAGIKSDQELLAATVAVGLTKTVFILVAIFLIDKVGRKPLLYVSTIGMTVCLFLLGVALTLQKHAAGIMSPRIGIDLAIFAVCGNVAFFSIGIGPICWVLSSEVFPLRLRAQGSALGQVGGRVSSGLVSMSFLSMARAISVAGTFFVFAAISIVSVLFVYFCVPETKGKTLEQIEMMFESEDEWRGGEIELEDTQHLIPSNKKSLPLG

SEQ ID NO: 11653 - DNA, 2101 bp, Panicum virgatum
  misc_feature: Ceres CLONE 1748244
  misc_feature: Encodes the peptide sequence at SEQ ID NO. 11654
aacaagttcttcttcttcttcttcttcttcttccaggagaatctgacagcaacaatatctctcagtcgccccctgtccctatcacaaatcaatttcacttcctctctagttccttccgctcgccgtccgccagctgccgtggccggttgccttccagattcacaccacgccccgccacgccaccggtcagcatctttttcatcttcctcgcccagttcggcagctcgcgagaaccccgctggcaccgaccggaggacgcgaatggacgccgccgagcttcctctcgtctaccacatcggcctcgtgctggccgcgctctgggccgccggcgccctcggcatccgccactctctcctcttcctcctggccttcctctacctctacatggtaaatgctcggtgtgcgatgagactgcgaaagaggatacaacatgaggagatgaaatccgcctaccaaagaagaagtcagtacggtggttaaaccatgcaatcaacaagatgtggcctatctgtatgcagaagatcgtttcacaacttctatggcccatcataccgtggttcttggacaagttcaaaccttggacagttagcaaagcaagtgttcaggagctttacatgggtaggaatccaccaatgtttacctccatgagagttctacctgagacatcagatgatgaccatttggttcttgagctgggaatgaatttcctttccgctgaagatatgagtgttgtacttgctatgcagctgcataagagtgtgggacttggaatgactgcaaacatgcatttaactagcatgcatgtcgagggaaagattttagttggtgtgaagtttgttcggagctggccatttcttggccgcgtaagactttgctttgtggagtcaccttattttcagatgactgtgaaaccactcattaatcatggtcttgatgtcactgaatttccaggaatttcaggatggctggataagttgatggatactgcatttgggcagacattagttgagcccaatatggttgtcatcaatgttgaaaaatttgcatctactccttcagaaaataactggttcagcattgaggagaggcctcctattgcgtatgtgaagcttgagattttagaaggaactgacatgaagccatctgatataaatggactagcggacccttatgtgaaaggtcgtcttggtcctttcaaattccaaacacagatacagaggaaaacactatcccctaagtggtttgaagaattcaaaataccaattacatcgtgggaggcatcaaatgaacttctcatggaagttcgtgataaggaccccatgtttgatgacttgcttggagaatgtaccattgatttacatgagctgagaggtggacaaagacatgacaagtggatatcattgaataatgtcaagaaaggaaggattcacttggcagtaacagttgaagatgtatctgaggacaaaaatgtatcatatttggacgaatcattgaggaaagctgatgctgaactaccagtatcaaccaaagttgacagcgcattggatgctggtgaactgcctgaagaaaagaaagtcttaatggatgaagtggagcacataaacattgatggacaagaacaacctggagggttatatgttcatcgccctggcactggggttccaaagacatgggaatcccggaaaggacgagcacgtagcccggacactcagatttaccaagaagttgacaagtcaaaggaaatccccacaccaaaaagcagtgggcaagggggtctgtttaacctaggctcctttttccggaagaactcaaagaagggaagtctaaatcccagccttcctactactacaggttctgtgacagagcttgatccaaagctccccaaaacaccacgtcccaacctgaaggagattggtgagaagcggacatcaataaagctcgtagtgaacgaagaagcaagcccagcaagcaaggtgggagacgcggataactcaacagaagatgtagcaaaggttatcgaaaaaaatgcaggcgaaccaggcagatcactaacaagcacattgagcaggaatgtttccaggaagagagcggaggataacct

SEQ ID NO: 11654 - protein, 534 aa, Panicum virgatum
  misc_feature: Ceres CLONE 1748244
  misc_feature (203)..(284): Pfam Name: C2 Pfam Description: C2 domain
  misc_feature: SWISSPROT Homolog: EC 2.7.11.13 Protein kinase C
MWPICMQKIVSQLLWPIIPWFLDKFKPWTVSKASVQELYMGRNPPMFTSMRVLPETSDDDHLVLELGMNFLSAEDMSVVLAMQLHKSVGLGMTANMHLTSMHVEGKILVGVKFVRSWPFLGRVRLCFVESPYFQMTVKPLINHGLDVTEFPGISGWLDKLMDTAFGQTLVEPNMVVINVEKFASTPSENNWFSIEERPPIAYVKLEILEGTDMKPSDINGLADPYVKGRLGPFKFQTQIQRKTLSPKWFEEFKIPITSWEASNELLMEVRDKDPMFDDLLGECTIDLHELRGGQRHDKWISLNNVKKGRIHLAVTVEDVSEDKNVSYLDESLRKADAELPVSTKVDSALDAGELPEEKKVLMDEVEHINIDGQEQPGGLYVHRPGTGVPKTWESRKGRARSPDTQIYQEVDKSKEIPTPKSSGQGGLFNLGSFFRKNSKKGSLNPSLPTTTGSVTELDPKLPKTPRPNLKEIGEKRTSIKLVVNEEASPASKVGDADNSTEDVAKVIEKNAGEPGRSLTSTLSRNVSRKRAEDN

SEQ ID NO: 11655 - DNA, 413 bp, Panicum virgatum
  misc_feature: Ceres CLONE 1748244-R
ttttcggcacgtgagaggagagatatcgatttagaaatcctggtcaggggggaggagcatgggtaagagtcacagctagaaggccttttgcccgttcaaggcgttccggtggcaattcgggccccatctgtctccggagttatggccagggtgtcggcgatgacgaagatgccgtcgtaagaaaaggttgatactctgccctgcaacggatcgcaagtgtgcaggatgttcgtttgtgttgtagtaatagagcgggcgatttggttccggcatgtgctctcttggtggttgattcacccagggagtggggatgtcaggtatcctggttggattgtggacagtgggggagaataaattaatgctcctcagttcaataattaggcgccccgggctgtgcgcgatgttcgtgtgga

SEQ ID NO: 11656 - DNA, 1407 bp, Panicum virgatum
  misc_feature: Ceres CLONE 1748275
  misc_feature: Encodes the peptide sequence at SEQ ID NO. 11657
acacataaacacgaatcagttgtggaagaaagcaagaaaccaacattccattgtccttaccgttgcatgcaggaaagcgcggcccggccatgacgaggatgagctcgacggtggcggcggcgttcttggtggtcgcggtcgcctggccgctgctggcctcggcccagccggcaccgagcatgcctccgccgtccccgcctgcggcggccacgaacaactcccggctggagaaggcgtacgtcgcgctgcaggcgctgaagcgcgccatcacggacgaccccaagaagctgaccaagaactggtgcgggcccgacgtgtgcaactacttcggcgtgtactgcgcaccggcgcccgacgactcgtgccagcgcacggtggccggcgtggacctcaaccacggcgacctcgccggcacgctccccgaagagctggggctcctgtccgacctcgccgtcttccacctcaactccaaccgcttctccggctccctccccgagtccctccgctccctccacctcctccacgagatcgacgtcagcaacaaccagctctccggccccttcccgtcgcagctcctctgcctccccaacgtccagtacgtcgacatcaggtttaacaacttctgcggcgaggtgccggcggcgatcttcgagaagaagatcgacgcgctttttatcaataacaaccacttcgagttcacactgccggagagcttcaccaactcgacggcgtcagtcatcgtgctggcgaacctcccgcggttgggtggctgcctgccgagcagcatcggcgacatggccgggacgctcaacgagctcatcctcctcaacagcggcatctcctcctgcatcccgcctgagatcggcaagctggacaagctcaccgtgctcgacctcagcttcaacagcatcgccggcacgctgccggacaccatcggcaacatgcgcgcgctggagcagctcgacgtcgcgcacaaccagctcgccggcgagataccggagagcatctgcgagctgccgcacctcaagaacttcacctactcccacaacttcttctgcggcgagccgcaccggtgcctcgaggtgccgcacatcgacgacagccagaactgcatcgctgggcgccccgaccagcggcccggcgaggagtgcatctcgttcctgcaccggccgaaggtgcactgcgacgcccaggggtgcatcgcgccaccatctccgccaccgccaccccctccagtgtatgcccatccgccgccggtatactgatctgtggtaatactgtaacatgtaatttattgctggctttgtggagtgggaactaaagggtaaatgcatacacatggtatatactgtaatcctcatttttcatcaaacgaataataatggattcttaaatctgttcttgcgg

SEQ ID NO: 11657 - protein, 391 aa, Panicum virgatum
  misc_feature: Ceres CLONE 1748275
  misc_feature: SWISSPROT Homolog: EC 2.7.11.1 Non-specific serine/threonine protein kinase
MTRMSSTVAAAFLVVAVAWPLLASAQPAPSMPPPSPPAAATNNSRLEKAYVALQALKRAITDDPKKLTKNWCGPDVCNYFGVYCAPAPDDSCQRTVAGVDLNHGDLAGTLPEELGLLSDLAVFHLNSNRFSGSLPESLRSLHLLHEIDVSNNQLSGPFPSQLLCLPNVQYVDIRFNNFCGEVPAAIFEKKIDALFINNNHFEFTLPESFTNSTASVIVLANLPRLGGCLPSSIGDMAGTLNELILLNSGISSCIPPEIGKLDKLTVLDLSFNSIAGTLPDTIGNMRALEQLDVAHNQLAGEIPESICELPHLKNFTYSHNFFCGEPHRCLEVPHIDDSQNCIAGRPDQRPGEECISFLHRPKVHCDAQGCIAPPSPPPPPPPVYAHPPPVY

SEQ ID NO: 11658 - DNA, 2066 bp, Panicum virgatum
  misc_feature: Ceres CLONE 1748277
  misc_feature: Encodes the peptide sequence at SEQ ID NO. 11659
ggcaaagagtggaacgcccgccacacgctccccgagctcggcgtcgcccgggccaaatggcggcaccctccgcccccttgctccgctcccacccccaccgccgagcgctcttcccctcatcgcagcgccaccgttccgcggcagcggccgcctccctgcttgggttccctccccgcaaaccggcctccacccgcaggctcccttacaccgcggtgcggtcctcctccaccgcctcaccctcggcaccggtcgaagaggcggcagcggccccgaccggcgatgcggaggagcaggaacgggtggtgctccccaccaacgagtcctctgaccgcctgctgcgcatccggcacacatgcgcccatgtgatggccatggctgtccagaagctgttccccaactccaaggtgaccataggtccctggatagacaatggattctactatgactttgacatggagccattgacggataaggacctaaagaagatcaagaaagagatggatcggatcatccgacaaaatctcccattggtgagggaggagttgtctcgggaagaagctcagaagaggatcgaagcactcaacgagccctacaagttggagattttggagagcattaaggaagagcctattacaatatatcacattggagaagagtggtgggatctctgtgccgggcctcatgtggagtctactggaaaaatagacagaaaggctattgagcttgagtctgttgctggtgcttactggagaggtgatgagaaaaatcaaatgctacaaagaatatatgggactgcatgggagaatgaagatcaattgaaggcttacatccactttaaggaggaggccaagcgccgagatcaccggcgactgggtcaggaccttgatctgttctctatacaggaagatgctggtggtggtttagtattttggcatccgaaaggcgctatcatcagacacattttagaagactcatggaaacagattcacttgcaatatggttatgatctgctatacactcctcatgttgcaaaggccgatctttggaaaatcagtggacatatagatttctataaagagaatatgtacaatcaaatggatgttgaagatgagatgtatcaactgcggccaatgaattgtccttaccacattttggtatacaagagaaaactacattcatacagggattttcccatcagagtggcagagctaggaactgtctatagatatgagctatctggtagtctgcacgggctattccgtgtaagagggtttacacaggatgatgcccacatattttgtctggaggaccagatacaagatgaaatcagaggtgttcttgatctaactgagcaaatactaggacaatttggctttaggtattatgagataaatctttcaaccaggccagagaaatctgttggcagtgatgacatatgggaaaaagcaacggttgctctgaagaacgcgttaaatgataaaggttgggaatacaaagttgatgaaggtggaggtgctttctatggtccaaaaattgatctaaaaattgaggatgctcttggaaggaaatggcagtgttccactgtgcaggttgatttcaatttgcctggacggtttgacattacttatgtcgattcaaatagtgagaaaaagcgacctatcatgattcatagagctgtccttggatctttggaacgcttctttggtgtcctgattgaacactacgctggtgattttccactttggcttgcaccaactcaagcacgtattctacctgtgacagacaatgagttgcaatactgtaatgaggtggcctcagaactgaaatcaagagggttccgtgttgaagtttgtcatggagagcgcctaccgaagctaataaggaatgccgaaacacagaaggtgccactcatggcagttgttggtcctaaagaagttcaggccaggaccctaactattaggtccaggcacaatggggagatcggtgtgatgcctgtcgatgaattcatcaccaaacttcatcttgctgtcgcgaacaaatcttcgttataaatcctttgatccgcc

SEQ ID NO: 11659 - protein, 664 aa, Panicum virgatum
  misc_feature: Ceres CLONE 1748277
  misc_feature (299)..(465): Pfam Name: tRNA-synt_2b Pfam Description: tRNA synthetase class II core domain (G, H, P, S and T)
  misc_feature (192)..(244): Pfam Name: tRNA_SAD Pfam Description: Threonyl and Alanyl tRNA synthetase second additional domain
  misc_feature (568)..(657): Pfam Name: HGTP_anticodon Pfam Description: Anticodon binding domain
  misc_feature: SWISSPROT Homolog: EC 6.1.1.3 Threonine--tRNA ligase
MAAPSAPLLRSHPHRRALFPSSQRHRSAAAAASLLGFPPRKPASTRRLPYTAVRSSSTASPSAPVEEAAAAPTGDAEEQERVVLPTNESSDRLLRIRHTCAHVMAMAVQKLFPNSKVTIGPWIDNGFYYDFDMEPLTDKDLKKIKKEMDRIIRQNLPLVREELSREEAQKRIEALNEPYKLEILESIKEEPITIYHIGEEWWDLCAGPHVESTGKIDRKAIELESVAGAYWRGDEKNQMLQRIYGTAWENEDQLKAYIHFKEEAKRRDHRRLGQDLDLFSIQEDAGGGLVFWHPKGAIIRHILEDSWKQIHLQYGYDLLYTPHVAKADLWKISGHIDFYKENMYNQMDVEDEMYQLRPMNCPYHILVYKRKLHSYRDFPIRVAELGTVYRYELSGSLHGLFRVRGFTQDDAHIFCLEDQIQDEIRGVLDLTEQILGQFGFRYYEINLSTRPEKSVGSDDIWEKATVALKNALNDKGWEYKVDEGGGAFYGPKIDLKIEDALGRKWQCSTVQVDFNLPGRFDITYVDSNSEKKRPIMIHRAVLGSLERFFGVLIEHYAGDFPLWLAPTQARILPVTDNELQYCNEVASELKSRGFRVEVCHGERLPKLIRNAETQKVPLMAVVGPKEVQARTLTIRSRHNGEIGVMPVDEFITKLHLAVANKSSL

SEQ ID NO: 11660 - DNA, 1743 bp, Panicum virgatum
  misc_feature: Ceres CLONE 1748289
  misc_feature: Encodes the peptide sequence at SEQ ID NO. 11661
agaacactgggcccagggtacggtgccggagggaggcgggatggcggatggcggcggggaatcggcggagtcgacggcgctggagttcacgccgacgtggatcgtggcggcggtctgctccctcatcgtcgtcatctccctcgccgccgagagttgcctgcattacctcggcaagacgttcaaggggaagaaccagaaggcgctcttcgaggctctcctcaaggtcaaagaagaactgatgcttctggggttcatctccctgctcctgacggtgtcccaagggatgatccagaggacctgcattcctccagagtgggccatctacatgctcccatgccataacgctaaggaacaggccgagctgagcccctcggaggcacatggtcttgctgctggaattttaggcctcacccgtcggcgtctgcttgccgagggtgggacaacggtccagcattgcagaaagaagggagaagttcctttgctgtcagttgaagcgctacatcagttgcatatcttcatattcattctggccattgcacatgtgattttctgtgttttgactatgcttttaggaagcgcgaggattcgtcaatgaaaacactgggaggatgaatttcagaaagattctacagaaaatgggcaaaggagggtgacctatgtgcatcaatgtgaattcatcagggaacatttcaagagtattgtcagagattcggtaatattgagctggctgcattcttttattaagcagttttatggatcagttactaaatcagactacactacaatgcgacttggcttcatcatgacacattgccgtgcaaacccaaaatttgatttccacagatacatgttacgagctttggaggctgattttaagaagatggttggcattagctggtacttgtggatattcgttgtggtattcatgttgctgaatgtcaatggttggcatacatacttttggatatctttcattccccttcttcttctgctggccgttggcaccaagctagagcatgtcataactcagctggcaattgaggttgctgagaagcactccgctatcgagggcgacttagttgtcaatccatcagatgaacacttttggtttggacggccaaaaatcgtcttgtacctgatccacttcatccttttccagaatgcgtttgagatcgccttcttcttctggattcttaccacctacggtttcaactcctgcatcatggaccacgtcccattcatcgtgccgaggctcgtcgtcggggccatcatccaactcctctgcagctacagcaccttgcctctgtatgcaattgtaacccagatggggaccttcttcaagaaggagatcttcgacgagcacgtgcagcagagcctcgtgggctggagccgctgggcgcagaaggccaggaagaggaaagcgctcaggaacaacaacggcagcgtcggcgcggccgggtcggcacacccgtccgcgaggctcgagctgatgaggcgggctgccgctctcgaaggaggcagcaccggcggaaatggcagcgaagtctcaaagctgtagtagcaaaggcttgggagaccgtcagaagatgcaagcgtcctcgtgcgcgcggcttacgtgtgccgtccgtgtttgctagataactagtgtctgatggccagagcgggtgctctggtatggtgtttgtatgctttggatttgtgactcgtggcatgctatattgttatggagtggagagctttctg

SEQ ID NO: 11661 - protein, 184 aa, Panicum virgatum
  misc_feature: Ceres CLONE 1748289
  misc_feature (9)..(184): Pfam Name: Mlo Pfam Description: Mlo family
  misc_feature: Useful for making plants with modulated biotic stress sensitivity
MADGGGESAESTALEFTPTWIVAAVCSLIVVISLAAESCLHYLGKTFKGKNQKALFEALLKVKEELMLLGFISLLLTVSQGMIQRTCIPPEWAIYMLPCHNAKEQAELSPSEAHGLAAGILGLTRRRLLAEGGTTVQHCRKKGEVPLLSVEALHQLHIFIFILAIAHVIFCVLTMLLGSARIRQ

SEQ ID NO: 11662 - DNA, 1632 bp, Panicum virgatum
  misc_feature: Ceres CLONE 1748407
  misc_feature: Encodes the peptide sequence at SEQ ID NO. 11663
gggcgcgcctcccctcccgcctcgtacccgccggccgggcctcgctatataaaccccaccgcgccgcggccgcgcacaccggtcccgagcacgggtcgtcgccgtctgcccgcgtccgcacgcacgcacgctcgctcgctcgctcacctccagagcagagcgctccggctccgcttgccccgctcccagaaggggtccggccgcggcggcgggcgatggcgcggaagaagatccgggagtacgactccaagcgcctcctccgggagcacctcaagcgcctcgtcggcatcgacctccagatcctctccgcgcaggtcacacaatcaacggatttcactgagcttgcaaaccaggagccatggctctcatctatgaagttggtcgtgaagccagacatgctgtttggtaaacgtgggaagagtggacttgtggtcctcaacctagaccttgcccaagttcgccaatttgttaaggagcggctgggagttgaggttgagatgggtggctgcaaagctccaattacaaccttcatagttgagccatttgtgccccatgatcaagagtactacctttcgattgtatcagaaaggcttggctgcacaattagtttctccgagtgtggaggtattgagattgaggagaactgggacaaggttaagacaatctttcttcccacagagaagcaaatgacacctgatgcatgtgctcccttgattgccaccttgccattggaggtccgcacaaaaataggtgatttcattagaggtgtattttctgttttccaagacttggatttctcatttcttgagatgaacccattcaccttggtaaatggtgaaccatatcctctggatatgagaggagaactagatgacacagccgctttcaagaacttcaataagtggggtaacattgagttccctctacctttcggaagagttctcagtccctcagaaagctttatccatgaactggacgagaagacaagtgcttctctgaaattcacagtattgaacccaaaaggacgcatttggacgatggttgcaggtggtggtgccagtgtcatatatgctgatacggttggagatttgggatatgcttcggagctaggaaattatgcagagtacagtggagctcccaatgaggaggaggttctgcagtatgctagagtggttctggattgtgttactgctgatcctgacgggcgcaagagagcccttctcattggaggaggcatcgctaacttcaccgacgtcgctgccacatttagtggcatcattcgggctttaagagagaaggaatccaaattgaaggccgcaagggtgaacatttacgtccggagaggtggtccaaactaccaaaccggactcgcgaaaatgcgcactcttggtgcagaacttggtgttccaattgaggtgtatggaccagaggcgaccatgactgggatctgcaagcaagccattgattgcatcatggctgcgtaggctgccatatagttgcaccttctgcggttgcatccgttttgtactttgaatgcaagcgattgttcaagtgaaaacagagaactatcattgttgtgagtaaactctgcctttgtaccacaattattcaataatcaagatcttggcttgg

SEQ ID NO: 11663 - protein, 422 aa, Panicum virgatum
  misc_feature: Ceres CLONE 1748407
  misc_feature (5)..(204): Pfam Name: ATP-grasp_2 Pfam Description: ATP-grasp domain
  misc_feature: SWISSPROT Homolog: EC 2.3.3.8 ATP citrate synthase
  misc_feature: Useful for making plants with modulated root development
MARKKIREYDSKRLLREHLKRLVGIDLQILSAQVTQSTDFTELANQEPWLSSMKLVVKPDMLFGKRGKSGLVVLNLDLAQVRQFVKERLGVEVEMGGCKAPITTFIVEPFVPHDQEYYLSIVSERLGCTISFSECGGIEIEENWDKVKTIFLPTEKQMTPDACAPLIATLPLEVRTKIGDFIRGVFSVFQDLDFSFLEMNPFTLVNGEPYPLDMRGELDDTAAFKNFNKWGNIEFPLPFGRVLSPSESFIHELDEKTSASLKFTVLNPKGRIWTMVAGGGASVIYADTVGDLGYASELGNYAEYSGAPNEEEVLQYARVVLDCVTADPDGRKRALLIGGGIANFTDVAATFSGIIRALREKESKLKAARVNIYVRRGGPNYQTGLAKMRTLGAELGVPIEVYGPEATMTGICKQAIDCIMAA

SEQ ID NO: 11664 - DNA, 806 bp, Panicum virgatum
  misc_feature: Ceres CLONE 1748547
  misc_feature: Encodes the peptide sequence at SEQ ID NO. 11665
accccgtctcgccctcgcccaaatccccaccccaaaccgaaccagcgaaagctcccctgcctgagcctgcctgctccgccctccgatcgcagggaggaagaggagggagatgagctactacggccagcagccccccgtcggcgtcccgccgcagcaaggctacccggggaaggacggctacccgccgccggggtacccgccggccggctaccccccgccggcgcagggctacccgccgcaggggtacccgcagcagggctacccgccgccgtacgcgcagccgccgccccagcagcagcagagcagcgggccttccttcatggagggatggtacgttccttgatttcctactcatctcgtcccctcctccacctatttgtgctgcttgcctgcgcaggctcggatgcctctgcggtatctccttgccggattaggtctaggttgccggcttcgcgcgctgggatcaccggtcagatctgccagcccggcccccggcgggggcggcggccgcggccgcgcttgctggtgcgtgcgcacgtttgccgcggtgtgtgggaccccgacttgacgcgtgaaccacccttggaaagggcaacccgccagcgccagcctcgtggctctggcgacgtgccgccgtgtccgtcgctgcacgcaaacgcgcacacgtatccgcgcagagggaggctaggctgtgaggctgtgaggtttatctaggttgatttgtctcggtttattttctctcacaaaatattattcattttaccagttctacattatttatacggtcagccgaacagcacctgtgt

SEQ ID NO: 11665 - protein, 77 aa, Panicum virgatum
  misc_feature: Ceres CLONE 1748547
  misc_feature: Useful for making plants with altered cell wall content and/or composition
MSYYGQQPPVGVPPQQGYPGKDGYPPPGYPPAGYPPPAQGYPPQGYPQQGYPPPYAQPPPQQQQSSGPSFMEGWYVP

SEQ ID NO: 11666 - DNA, 662 bp, Panicum virgatum
  misc_feature: Ceres CLONE 1748547-R
tttagtctatatttaatacttcaaatgttgaaaatttctttccaaaaatgtaaaaatacaaaatgcaatgcccttggtttggttggaaggataatatatttccgttgactcgctgataccaatgagatgtgatagatgctctagcactagcgttgtacttacaatatcacggttgggcattggaatctgtcgatggatggctgggaattttgaaggaatatgttacagcttctgcatcatagtgatctttacattttagtaaagcatgctttagaattggcatatgcttttctttcgtttgatcttcatctgatgctcgtttcacttgtggttgaacagcttggctgctctctgctgctgctgcctcctggacgcctgcttctgagacgaccctcgccgacggattcgaggtgactgcaagtgaaatgaaactgcctcaaggaagaaacggcttgaaatgctagtgtcctagactatagctttcttgtcctgcattatcgtctattttttttcattctcttttatgaaacccagcaatgagacttctagtactagtactctgtcggtgttgattggatgatggctggtgtgtattctgtggattgccgagtttctggtggaattcaacttgggattatggagtgcgcaacttggtttgttct

SEQ ID NO: 11667 - DNA, 661 bp, Panicum virgatum
  misc_feature: Ceres CLONE 1748650-R
  misc_feature: Encodes the peptide sequence at SEQ ID NO. 11668
ttgtcattgtctggtccattgtactggcttcaatcttctcactcctttgggtccggatcgatcctttcctagcaaaaaatgatggcccgcttcttgaggagtgtggtttggattgcaactaggatgtcagcatatcagctcccccagcgccgaatgcttgaaaataaaaaccatttacaatgtcccctctgtaaataaaaatccatggtggtagttcagcctcatgccttcagatatatactgggcagaatggaggctatggcaatccttgtgcagttgggccgtggaatagaacatatgcaaagtgttcgatcgttcagcattctttattacttgggcgcaaaattgatcgggtgggagccgaagagcaaggtgtctgattctgcactgctcccgtgtacaaacttgggtctgaataaggcaggcggggatggttctgccagtggaaaagagcaacatgcacagtatttatacggcggctcgtgtatgcctgcccattgaagggcttgttcttacatgttcgtctatactagaaaaacagaatattagtgtttagttctgtagttaaaagtgcgtaaactgtaaaggctcgtttttttgttcgtgtactgtaatggtggcagttgtgacatggtcatgtcatagaagaaatgttgtacgg

SEQ ID NO: 11668 - protein, 39 aa, Panicum virgatum
  misc_feature: Ceres CLONE 1748650-R
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Useful for making plants with altered cell wall content and/or composition
  misc_feature: Useful for making plants with modulated biomass
  misc_feature: Useful for making plants with altered carbohydrate content
  misc_feature: The sequence is a functional homolog of SEQ ID NO 6 in US patent 7285702
  misc_feature: The sequence is a functional homolog of SEQ ID NO 2 in US patent 7049481
VIVWSIVLASIFSLLWVRIDPFLAKNDGPLLEECGLDCN

SEQ ID NO: 11669 - DNA, 750 bp, Panicum virgatum
  misc_feature: Ceres CLONE 1748846
  misc_feature: Encodes the peptide sequence at SEQ ID NO. 11670
agagccagccgccgcagaccgacccgaagcgagcacacgcaaggggcgagccgccgacgctccttcagatcctcggcgagccgtggctggccctctgctgctgtccgccgagcggtttgaacatcacctgcagccatgggtaaggagaagtcccacatcaacattgtggtcattggccatgtcgactccggcaagtcgaccaccaccggccacctgatctacaagcttggaggcattgacaagcgtgtgatcgagaggttcgagaaggaggctgctgagatgaacaagcggtccttcaagtacgcgtgggtgctcgacaagctcaaggctgagcgtgagaggggtatcaccattgatattgccctgtggaagttcgagaccaccaagtactactgcactgtcattgatgcccctggacaccgtgacttcatcaagaacatgatcacgggtacctcccaggctgactgtgctgtccttatcattgactccaccactggtggttttgaggctggtatctccaaggatggccagacccgtgagcatgctctccttgctttcactcttggagtcaagcagatgatctgctgctgcaacaagatggatgccaccactcccaagtactccaaggcccgttatgatgagattgttaaggaagtctcctcctacctgaagaaggtgggatacaaccctgacaagatttccttcgtccccatctctagttttgagggtgacaacatgattgagaggtcc

SEQ ID NO: 11670 - protein, 204 aa, Panicum virgatum
  misc_feature: Ceres CLONE 1748846
  misc_feature (5)..(204): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKISFVPISSFEGDNMIER

SEQ ID NO: 11671 - DNA, 1627 bp, Panicum virgatum
  misc_feature: Ceres CLONE 1749743
  misc_feature: Encodes the peptide sequence at SEQ ID NO. 11672
ctgttgccaccccagacgggcaaatccacttcttctccccttcacttcctcttcccaaatctattctcccaaagaacctcgaccgaatcgagcttcctttggccagatcgcagcccaagcagccagatcggcgaatccatggccgccgccgctgccgcttggggagctccgatgtgcgcagtgccacccatggacgctgggcgcgtgttgctgagggtcgccgtctagtcggacgggggaagggtacgccgctggtccttgtctgggtcgcagccatgggcaggatagagcgagcagattgaaggcagtcaggattaataacgacggatatatgaaccagccgatctccaaacgacgccgtccagcgccgccagaggtcggcagcagcagcataattccagatgaggtgctgctgttgaacatcctggtgcgccttcctgtgaagtcccttgtgcgctttaaatctgtctgcaaggcgtggtgcgccaccatagccagcgctcactttgctcgcctgcacttggagcttgcaagagctaccagcccatcatccatggtcgtagtcccccggaagtaccagtcggaaccgagaaaggtggcctctcagttcgtgcacatctatcgcttccagccagcagtgcagagcaaggtcgccaagctcattatgatgagcaagcctcgtcccgagtggggcatcccacggttcaccatcccgctgcactgcgacggcctggttctaatccccagcatgacagggcacatattcgtgtgcaacccggccacgaaggagttcgtcgagctgccgccgggcacccggaatgtgtcgttggaccaaagggtggcctttggcttcgatccctccagtggtacatacaaggtggctaggcacttcttgcgctcctaccatgaagggcagatacgtacagactacgacgttggctatgaggtcttgacacttggcgatggcgtaaagaagttggaatggaaagccaccattgatccaccttaccctatcaatgccaggactcctatttgcttgccaggattcttctattggagtgcggtccagtccgtggctgacgccgacgaccacggcaagctagccacagatgttatccttagattcagcatgcgtgatgatacgttcactgtgcaccccaatcctccatgcagtagctgcctaagtctcaatgacctcatgtgtgagctaagtggcaagctgtgctatgtccactccccttccccgtgcgatgtctccatttggttagcacaaggtggacaagacacaataacatggtcacgacgttgtcgtgtcaatctgcccataccaaggattcttcgtgtttatgcttgtgcttcagctgatcaagaaggcacagtattcctgtctgtggatttccgacatgtttacaagtgcaacctccgtgatggatctgttgaagcagtagtcagtatgccatatggcttgttctatgagcacggggaaggggtaaaatttgtccttggttcactccctttttcgcattacatggtgccatatgtggaatctttgctgcgtattgcaccatgctagctagccaagtgactgtatgttatcaataccaataatagaagaaagggtatgctt

SEQ ID NO: 11672 - protein, 413 aa, Panicum virgatum
  misc_feature: Ceres CLONE 1749743
  misc_feature (17)..(65): Pfam Name: F-box Pfam Description: F-box domain
MNQPISKRRRPAPPEVGSSSIIPDEVLLLNILVRLPVKSLVRFKSVCKAWCATIASAHFARLHLELARATSPSSMVVVPRKYQSEPRKVASQFVHIYRFQPAVQSKVAKLIMMSKPRPEWGIPRFTIPLHCDGLVLIPSMTGHIFVCNPATKEFVELPPGTRNVSLDQRVAFGFDPSSGTYKVARHFLRSYHEGQIRTDYDVGYEVLTLGDGVKKLEWKATIDPPYPINARTPICLPGFFYWSAVQSVADADDHGKLATDVILRFSMRDDTFTVHPNPPCSSCLSLNDLMCELSGKLCYVHSPSPCDVSIWLAQGGQDTITWSRRCRVNLPIPRILRVYACASADQEGTVFLSVDFRHVYKCNLRDGSVEAVVSMPYGLFYEHGEGVKFVLGSLPFSHYMVPYVESLLRIAPC

SEQ ID NO: 11673 - DNA, 734 bp, Panicum virgatum
  misc_feature: Ceres CLONE 1749798
  misc_feature: Encodes the peptide sequence at SEQ ID NO. 11674
ccccccgaaccttggcgcgccctctctcccatccctcaccccccgaaccttggcgcggcagctcgtgggcatacgagttctctatctctcatggcaccggcgctgagcgggaccctgggcgcgtcgtcagtggcggcgctgcggccctgcgcggcgaggggggcgccgtccgccgcgagctttgtcgcgtcgcgggggagcggggcggcaaggtgccccagaggaggggtcagatgggaggccgagaggagcaggggcagaattgcccgggtcaggtgcgatgcggccgtcacggagaagcccgccggggaggaggcggccgaggagcagttcgagtaccaggcggaggtgagccgcttgatggacttgatcgtccacagcctgtacagtcataaggaggtatttctccgtgagctcgtcagtaatgccagcgatgcattggataagttgaggtttcttggtgtgactgattcttcattacttgctgatggtggtgagctggaaataaggattaaacctgaccctgatgctggaacaattactatcactgatactggtgttgggatgactaaagatgagctgaaggactgccttggtacgattgctcagagtggcacctcaaaatttttgaaggccctcaaggagaacaaagaccttgggtccgacaatggtttaattggtcagtttggtgttgggttttactcagcttttcttgtagcggagaaggttgtggt

SEQ ID NO: 11674 - protein, 214 aa, Panicum virgatum
  misc_feature: Ceres CLONE 1749798
  misc_feature (101)..(214): Pfam Name: HATPase_c Pfam Description: Histidine kinase-, DNA gyrase B-, and HSP90-like ATPase
MAPALSGTLGASSVAALRPCAARGAPSAASFVASRGSGAARCPRGGVRWEAERSRGRIARVRCDAAVTEKPAGEEAAEEQFEYQAEVSRLMDLIVHSLYSHKEVFLRELVSNASDALDKLRFLGVTDSSLLADGGELEIRIKPDPDAGTITITDTGVGMTKDELKDCLGTIAQSGTSKFLKALKENKDLGSDNGLIGQFGVGFYSAFLVAEKVV

SEQ ID NO: 11675 - DNA, 2332 bp, Panicum virgatum
  misc_feature: Ceres CLONE 1749828
  misc_feature: Encodes the peptide sequence at SEQ ID NO. 11676
aaaagaggggatggagcaagaggacaactttgctgccctgagtcgtcgcgtctcccgtctccaacatcaaactccgcacccaaatccacaaggaattccccttcctccccccaccaaaacccgccccggcgacgaacatcaaacccccctagcggcgccgatcagggcgccgccgccctttgccaggtctcgtcgggcgcttctccagcgacaacatctcgccaggttgcttcacaaaatttgcaacgtccagggtacaactagccaaagagtcaataaactttctctggacttgcagagaacccatcctgcagggtgtctcagacatactgatggatggggaacccaagatccttgacaaattatcacatgaacgcatgtactcttggtacttcaccagggaagaactagagaagttttctccgtcaaggaaagatggaattactgaaagcaaggagttagaacttcggcatttatattgttcatttattcgggatgttggcatcaggctgaaactacctcagatgactctagcgacagcaataatgttttgccatcgcttctatatacaccagtcccttgccaaaaatggatggcagacagttgcaactgtatgcgtatttcttgcatcgaaagctgaagatactccttgccccctggaccatgtagttagagtagcctacgagacaatgtataggcgggacactgctgcagctcaaaggatccgccagaaggatatttttgagaagcagaaagcactaattttaatcggagagagattggttcttacaactattcgatttgatttcaacattcagcatccttatagaccactttttgatgctatgagaaatcttggcatcaatcagaaggaagtgaaacaagtagcatggaactttgtgaatgattggcttaaaacaacactgtgcctacagtataaaccacagtatattgctgctggatctctttacctggcagcaaagcttcacaatatcaagctcccgttacatggagcgcatgtctggtggcaccaatttgatgttgcaccgaagcctctggaagctgtcattcagcaaatgatggagcatgctgctgtgaaaaaactgatgcctgctcgtcccagtccagttaagcaaaaggaagttccatgtgaagctaaactgcacatatctaacagcccggactctgtgttgaatcaatcaagcttgttaataagcagctcaagtcctgatattggcgagcccagtgacccaatgcagctggattcctgtcaatacttgacaagcagtcatacaagtgatggtagggtctcaggcccggacagcagttcgttgagtgtaagtgcttatataaatgtttctaggaaagtacatgatgaagagagcttgcatcaggcctcaataaccaaacatgatgctgggatgatgtcatgtagtaatcagacatcattagatgcgattgcagccaccgagggcagtgctgaatgtatgcagctggatgcaagccattgcacagtcaatggcaaaatcttgaaccaggcatcaagaaattggcacggtggtaacgtgaacccattatctgtggtgatatcactggatgccaaggtggacaaagaaagcacttggtgtgttgaaccattgattggaagctctaatcattgttctgatagtctgattgcggatagcttgtgcacagatcagatattggctgatgtggcttcagtcccaattaacaatgcatcatctgcattgccagttttggtggaggctgttccttcgagggcagaacttaaaaatgttgatgttgtcagaataaaggatttattgtcgaagaggaagaggcagagagaggtccaagagcgggctattggttcagacgacctcggtgaagaagcctggattgagagagagctcgagtctgggattgttatgaaacaagaagctgctgcctcagatgagctgagtgatgaagcctggatcgagagggagctcgaagcagggattgtggttggaccaagaaacaagcaggcaattactttagatggtttgagtgaagatgattggattgagagagagctcgagtctgggattattttagggccagcgtctgccagcaagaaacagaagctagattcaagctgctgctagctcctcctgagcagatgcactcagagtatgctttccaagcaggtgaataatgacagattgagttagcagatagatgtcacttctttattatttgtttaatgagacacctcgagtgcttttaacacgagggatatgtgcacagtgggacattcccaatttcttgaattcagaatggcatcaaatcc

SEQ ID NO: 11676 - protein, 604 aa, Panicum virgatum
  misc_feature: Ceres CLONE 1749828
  misc_feature (15)..(160): Pfam Name: Cyclin_N Pfam Description: Cyclin, N-terminal domain
MDGEPKILDKLSHERMYSWYFTREELEKFSPSRKDGITESKELELRHLYCSFIRDVGIRLKLPQMTLATAIMFCHRFYIHQSLAKNGWQTVATVCVFLASKAEDTPCPLDHVVRVAYETMYRRDTAAAQRIRQKDIFEKQKALILIGERLVLTTIRFDFNIQHPYRPLFDAMRNLGINQKEVKQVAWNFVNDWLKTTLCLQYKPQYIAAGSLYLAAKLHNIKLPLHGAHVWWHQFDVAPKPLEAVIQQMMEHAAVKKLMPARPSPVKQKEVPCEAKLHISNSPDSVLNQSSLLISSSSPDIGEPSDPMQLDSCQYLTSSHTSDGRVSGPDSSSLSVSAYINVSRKVHDEESLHQASITKHDAGMMSCSNQTSLDAIAATEGSAECMQLDASHCTVNGKILNQASRNWHGGNVNPLSVVISLDAKVDKESTWCVEPLIGSSNHCSDSLIADSLCTDQILADVASVPINNASSALPVLVEAVPSRAELKNVDVVRIKDLLSKRKRQREVQERAIGSDDLGEEAWIERELESGIVMKQEAAASDELSDEAWIERELEAGIVVGPRNKQAITLDGLSEDDWIERELESGIILGPASASKKQKLDSSCC

SEQ ID NO: 11677 - DNA, 2140 bp, Panicum virgatum
  misc_feature: Ceres CLONE 1749973
  misc_feature: Encodes the peptide sequence at SEQ ID NO. 11678
agcaaagcctttctcttttagtggcttccagcaaagaccatgtttgaaggatgtgctctagccaattttctcatctcaaacacaaaagaagacaactgattggaatttttgtgatcttttccctctctctctcacctgattttttataagactctctctctctcctgattacctcagcctttgactggccccacatcgtctcattaaaaagatcccaaacacacgcactcgaacagacgaacacaaccacacaccatccccacgcgccgccatggccagctccatcatcccgagcgcaagcagcggggagcacgcggcggcgtcgcccacgaccaagctcggccggctcaacgcggcggtggagcgatcctggctcgggctgcggttccgcctcgcggcgcgcaggaccacgttcaccacggagctgcgcgccggcacgaccacgttcctcaccatggcctatatcctcgccgtcaacgcctccatcctgtccgactccggcgccacctgcaccgtcgacgactgcgacgcgccgtcccccgggtgcaagttcccgcccgtggaccccgggtacgccgcctgcgtggcgcgcgcccgccgggacctgatcgtcgccaccgcggcgtcgtccgtgatcgggtccttcatcatgggcgccttcgcgaacctccccatcgcgctggcgcccgggatgggcaccaacgcctacttcgcttacaccgtcgtcggattccacggctccggcacgctcccctaccgcacggcgctcaccgcggtgttcctcgagggcctcatcttcctcttcatctcggtggtgggcctgcggtcaaagctcgcccagttcatccccaaacccgtgcggatctcggcgtccgcggggatcgggctgttcctggccttcatcgggctgcagagcaacgagggcgtcgggctcgtggggtttagctcgtcgacgctggtcacgctcggcgcgtgcccggcgtcgcagcgcgcgtccgtggcgcccgtggtgacgttccccaatggcacggtggcgctgatgccgggcggcaccgtctccggggccatactctgcctctcggggcgcatgacctccccgactttctggctcgccctcgtggggttcctcatcatcgccttctgccttatcaagaacgtcaagggagccatgatctacggcatcctgttcgtgaccttcgtgtcctggccgcgccacaccgccgtcaccgtgttcccggacacgcccgccggcgacgacagcttccactacttcaagaaggtgttcgacgtgcaccggatccgctccacggccggcgctctcgacttccgcgacatcggccacggctacttctgggaggcgctcttcaccttcctctacgtcgacatcctcgacaccaccggcgggctctactccatggcgcggttcgccggcttcgtcgacgacgccacgggcgacttcgaggggcagtacttcgccttcatgtcggacgcgtcggcgatcgtcttcggctcgctcctcggcacgtcccccgtgacggcattcatcgagtcctccacggggatccgggagggcggccggacggggctgacggcgctcacggcggcggcctacttcacggcggcgctgttcatcacgccgctgctggcgtcgatcccgtcctgggccgtcgggccgccgctggtgctggtgggcgtgatgatgatgcgcgcggtggcggaggtggactggaacgacatgcagcaggccgtgccggcgttcctgacgctggcgctcatgccgctcacctactccatcgcctacgggctcatcggcggcatcggctcgtacatgctcctgcactcgtgggactgggcgtgcgaggcggccgcaaggctgggctgccgccggaaggtcggaggcggcgccgagaggagtagtggcggcgaggcagagcaggggaaggagacggaatcagcatagcctttcttcccctttcgtgctttcccgcttttcctcttggatatatcccattttgtccctttctctccaaatttcatttttttaattaggaatttaacatcaggatctactgtactaggtaaaatagatcaaaattctagtatgtagaatactcgtctatatagttttatttttggaatg

SEQ ID NO: 11678 - protein, 562 aa, Panicum virgatum
  misc_feature: Ceres CLONE 1749973
  misc_feature (49)..(514): Pfam Name: Xan_ur_permease Pfam Description: Permease family
MASSIIPSASSGEHAAASPTTKLGRLNAAVERSWLGLRFRLAARRTTFTTELRAGTTTFLTMAYILAVNASILSDSGATCTVDDCDAPSPGCKFPPVDPGYAACVARARRDLIVATAASSVIGSFIMGAFANLPIALAPGMGTNAYFAYTVVGFHGSGTLPYRTALTAVFLEGLIFLFISVVGLRSKLAQFIPKPVRISASAGIGLFLAFIGLQSNEGVGLVGFSSSTLVTLGACPASQRASVAPVVTFPNGTVALMPGGTVSGAILCLSGRMTSPTFWLALVGFLIIAFCLIKNVKGAMIYGILFVTFVSWPRHTAVTVFPDTPAGDDSFHYFKKVFDVHRIRSTAGALDFRDIGHGYFWEALFTFLYVDILDTTGGLYSMARFAGFVDDATGDFEGQYFAFMSDASAIVFGSLLGTSPVTAFIESSTGIREGGRTGLTALTAAAYFTAALFITPLLASIPSWAVGPPLVLVGVMMMRAVAEVDWNDMQQAVPAFLTLALMPLTYSIAYGLIGGIGSYMLLHSWDWACEAAARLGCRRKVGGGAERSSGGEAEQGKETESA

SEQ ID NO: 11679 - DNA, 642 bp, Panicum virgatum
  misc_feature: Ceres CLONE 1750085-R
  misc_feature: Encodes the peptide sequence at SEQ ID NO. 11680
aggtggctgcctaccttccctaaacagggttgtgtctgccatgactaattcatcaaggctctgcgtacaacaccttgagcaacttggggaccattactacccgactctgatgcactggagggacaattttgtggccaacagaaaaaaagtttctgccctgggattcgatgaaaaattcatccgtacttgggagtactatttttcatattgtgcggctttgttcaaatcgcgcacaattttggactaccagatggtgttttctcggcccggcaacgccaagttgccaagctatctgaccattgagtaaatggaagaccttgtgcttatgtatcccgatatgtgttggattggtctttttgtttatgtatcccgaaatgttttatggaagaccttgtgagttattgtcagtcatgtatgtgtgtggagaagaccgagcaggtcagtaataggtgcatgtgtgagttagtttgaataaagaagacatgatctgcatgttagtgattgcacgcaggaagtccatccaggtgtgcactttggcttggagctgtggccaagtgaagcgtggtgtgaagagtggttatttaagtattgtaatcagcttgcttaagtgtgttgaagagaggcactggtgtgcattgccac

SEQ ID NO: 11680 - protein, 101 aa, Panicum virgatum
  misc_feature: Ceres CLONE 1750085-R
  misc_feature: SWISSPROT Homolog: EC 2.1.1.79 Cyclopropane-fatty-acyl-phospholipid synthase
GGCLPSLNRVVSAMTNSSRLCVQHLEQLGDHYYPTLMHWRDNFVANRKKVSALGFDEKFIRTWEYYFSYCAALFKSRTILDYQMVFSRPGNAKLPSYLTIE

SEQ ID NO: 11681 - DNA, 773 bp, Panicum virgatum
  misc_feature: Ceres CLONE 1750085
gtcacagccaaacgcagcacagaaccccacgaactagctgtctatagcttgcactgggagttgaataggaggtagagagagatgagggtggcggtggtgggcggcggcttgagcggcctggcggcggcgcacgagctggccagctagtygtgcggcgcgcgcgtgaccggtacggaaggagggccacctcggcggccgtggcaaccaggccgtggccgtcgacgacggagccggcggccgtgtcctcgtcgaccttggctgcatggccttcaacacgatgacatgcccaaacatgatgaaatggtttgaagggctgggggtggaggtggagccrtcggacatgtcattctcagcaagcatgcggttgggcaaaggtgtaggcttcgagtggggcagccgcaatggtgtatctggtgttctggcccagaagagcaacctgcttagccccagattctggctagtaatccgtgagatatttaagttcaagagccacgctctcaagtacctggaggaccatggaagaaaccctgaccgcarcgagactttggggcagttcattcagtcacacagatattctcagctcttccaggatgcttaccttattccaatgtgtgcatgcatctggtcctgccccgccagatggagtattgggcttcccagctctccttgtgctctcttttttccgcgacaatcatcttctcgagttgtttggtcgcccgccgtggctcccggtccagagtggctcggggtcctacctgaaccaggtcagggaa

SEQ ID NO: 11682 - DNA, 1852 bp, Panicum virgatum
  misc_feature: Ceres CLONE 1750150
  misc_feature: Encodes the peptide sequence at SEQ ID NO. 11683
agtttttcgccgcacatgcgtggcgcgggtgccgccgccgcctcctcccgacgcagcagccgcggccgcaccaccagcgatgtcgcgtagcggggtggaggtggtcgccagcagggggtgcgcgcggctggtgctccccgggatgcaccaccacaacccctcctctgccgcgtccgtcgcctcctccaccgcctcgcgcggcggggccgccgccgccgccgatggccccttctcgggcctcgtcatctgcgtcaccgggctgtccaaagaggccagggctcaggtgaaggaggcggcagagcggctggggggcgagtacagcgggagcctgcaccccaagtgcacgcacctcgtggtgcagaaccttgctgggcgcaagttcgagcatgcactgaagcatggtccgaggaacgggctattcgttgtaacgctgggttggttcgttgattgtgtgcggagaaacatgaggctggatgaatccttgtatgctatcaagaatatcggggagaatggtttgccactcggggagttcaaccgctttattggagttcctgtcgatgagaagtcttgccttccaccagtgttttttcaagacaaggctagctcagatatgaccgggaagcatccaactcaggctcctaggaaagaaagtggcaatgctgagctggtttttatgaatgacacaatctacatcgaccatgggatatctggtgagatgaagaaaaagatatctgatgctgctacaagagaaggtgcaaagttgctgggacactggtttattggttgtcctgccacttatgttgtgtgtgaggatgcttctatcaagagatatgtaggccactcggacaacattgtaactccactttggatcttgaaaacagtgaaggaaaaaaacttgcaacgtcttgtccatttgtcttcggacctagccaggcatgttgccattgttctgcaaaatgtccggacatctggagagaatagaaaacctgggagtgttccttctatgaactccagtggacgtccatcgacacaagaggagattgatgagatccatcaagagaagcaaaaatttgttgaagttgcaaagaaagaagttcgagaccgccgtgctcgtcgtatgcagtcatgtgaggtgccaattcatccgatcacaccaactacacttttggattcgatttgctggacaatctctgagccaacttcatccgcgtctatttatacggattcttcatggtctgatgatgccaatgagcagcaaagcaccacttattttgatgcaaacggtgatgtgagggatccagatcaaccaactgatattttttcccgcccactgaaagaaagtgagcgaagtgagttgatcttcaagaatcactttcttaccatactcttccctattgatcggtttggagagcttggaccttcctcaaagacgttctataacaatggtggttttacacgtatacaagtgctggatcacatctacaacttctaccaggagaacatgtcgaccgatgaggtagagatggccttgcatacagattctcggcatgctgatcgacttcgatctttatattcaagtgctgaatcagcagagaaaggagttgtagcttttaaaagaatagacttcttaggaagcagaagaagttttgaggcactaaagcgcctcaacagggagaataatagcaatgtatatgagcttgtgattagggcatgaatgcaccaccctcaggtgccatttggcgaaacttatctgttgctttcaaaaagaaaaaaaagaatgtatatatagtgagaaaggatgtactatgtttgctgaaagaaaatatgcgggaaataaatccatagtttattt

SEQ ID NO: 11683 - protein, 544 aa, Panicum virgatum
  misc_feature: Ceres CLONE 1750150
  misc_feature (46)..(125): Pfam Name: BRCT Pfam Description: BRCA1 C Terminus (BRCT) domain
MSRSGVEVVASRGCARLVLPGMHHHNPSSAASVASSTASRGGAAAAADGPFSGLVICVTGLSKEARAQVKEAAERLGGEYSGSLHPKCTHLVVQNLAGRKFEHALKHGPRNGLFVVTLGWFVDCVRRNMRLDESLYAIKNIGENGLPLGEFNRFIGVPVDEKSCLPPVFFQDKASSDMTGKHPTQAPRKESGNAELVFMNDTIYIDHGISGEMKKKISDAATREGAKLLGHWFIGCPATYVVCEDASIKRYVGHSDNIVTPLWILKTVKEKNLQRLVHLSSDLARHVAIVLQNVRTSGENRKPGSVPSMNSSGRPSTQEEIDEIHQEKQKFVEVAKKEVRDRRARRMQSCEVPIHPITPTTLLDSICWTISEPTSSASIYTDSSWSDDANEQQSTTYFDANGDVRDPDQPTDIFSRPLKESERSELIFKNHFLTILFPIDRFGELGPSSKTFYNNGGFTRIQVLDHIYNFYQENMSTDEVEMALHTDSRHADRLRSLYSSAESAEKGVVAFKRIDFLGSRRSFEALKRLNRENNSNVYELVIRA

SEQ ID NO: 11684 - DNA, 773 bp, Panicum virgatum
  misc_feature: Ceres CLONE 1750330
  misc_feature: Encodes the peptide sequence at SEQ ID NO. 11685
aaatctcgcagcaacgaattcccatttcgcccacctccgccccactttcccttccgcccccttcctcggcgcgatccaaatccggccatggacggcggggcgcagccgccggacacggagatgacggacgccggcgcgtgcggcggcgggcagccgccgcagcagccggcgggcgggggaggcgggatgatggataacatccaggcgacgctgagccacggcgggcgcttcatccagtacaacatcttcggcaacgtgttcgaggtcaccgccaagtacaagccccccatcctccccatcggcaagggcgcctacggcatcgtctgctcggcgctcaactccgagacgggggagcaggtggccatcaagaagatcgccaacgccttcgacaacaagatcgacgccaagcgcacgctccgcgagatcaagctgctccgccacatggaccacgagaatattgttgcaataagggatatcatacctcctccacagagggaggcattcaatgatgtttatattgcgtatgaattgatggatactgatctgcatcaaattattcgttcaaatcaagctttatcagaggagcactgccagtattttctttaccaaattcttcgtggtttgaagtatatacattcagcaaatgtccttcaccgtgacttgaagcctagcaatcttcttttgaatgcaaactgtgacctcaagatttgtgattttgggcttgctcgcaccacctcagaaactgattttatgactgaatatgttgtcacaag

SEQ ID NO: 11685 - protein, 228 aa, Panicum virgatum
  misc_feature: Ceres CLONE 1750330
  misc_feature (70)..(228): Pfam Name: Pkinase Pfam Description: Protein kinase domain
  misc_feature: SWISSPROT Homolog: EC 2.7.11.24 Mitogen-activated protein kinase
MDGGAQPPDTEMTDAGACGGGQPPQQPAGGGGGMMDNIQATLSHGGRFIQYNIFGNVFEVTAKYKPPILPIGKGAYGIVCSALNSETGEQVAIKKIANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDFGLARTTSETDFMTEYVVT

SEQ ID NO: 11686 - DNA, 2457 bp, Panicum virgatum
  misc_feature: Ceres CLONE 1750333
  misc_feature: Encodes the peptide sequence at SEQ ID NO. 11687
acggcataccctccctcccctcaagcagccgaaggccgaagctctcctcccccaatccttcccagatgctgcgccgcaaccgcggctgcgaaatcgagttcgaattccgacgcgctcccatggagctcaggatttaggtgtgagctgcgccccctcgtatggatccagatgttctcgtggggccgtaagcagtcctcttcatccggctcgtcctcctccggccgccgccgccgcggcggcggggcggacgcctccatggactccagcagccgcggcggcggcgggagcgggagcggcagccgagggcggagcccgcggctggatcgccgcaacgcggcgaagcgcatcgagtacgaggtgggcggcgcgggggcgtccgcgttggtgggcgcgtcgtggtcgtcctcgtcctcggcggagcagcagcggtcaccggggctccgcccctcgcgctcgctcgaccttgcccccggcgcggacctccgcatcagcgggagcgtggagggggaggtcgacgagctctgccgcagcctggggctctcggggcccgaggagttcgccatccccatcgcggcctgggaggcgcgcaagtcgcgctccaactccgacctcctcccgcgcccccgcctcgtcgcgtcccctcccgccgatgaactctcgcccatcgcgcgcgcggtctcggcgcccaatgttcagccggctctctccgtccctgcgcccattcctgaggagtcgccccactcgtcctccacctccaccgccaccgagtcggcggaggagcctaccgttccggcgccggagttgtcccccaaggccgcccctgccgttgctgttgcgcctcccgtcgggggtttgcccctctcctcgcccaagaggggaggcggggaggtcggaatacggggtgtccggtcgcctctgctctccccgcctccgcctatcacagcactcgctcctccgccggtgaggaggcccgttgttgctgatgacttgactgggtcggcttgggacattgtgcagtcgtttgctcccagtgaagagagaagtgaactgggaggggctcatgaacgcgcggacaatcgtcacgtgtcagacacagaggagggcgaggttgaagatggggtggcagcagtggagggggagctgaaagagttgagaataggagagaccttcgagggtttcactggaacatcttccttgtcgacaacaaacgatgatgacgcatccagtacaaccacagaagccatgttcatcatctcaccaaatggcaagttcaagcggaagattaagtcatggatgcgtggtgctatgcttggaagcggctcatttggaatggtgtacgaggggatcagtgatgagggtggattttttgctgtgaaggaagtatctttgcttgatcaaggaagcaacgcacagcaatctattctcgcacttgagcaggaaattgctctccttagtcagtttgaacatgaaaatatagtccagtattatggaactgacaaggaagaatcaaaactatatatctttattgagcttgtcactcaaggatctctttcatccctctatcaaaagtataaactacgagaatcgcaagtctctgcatacactaggcagattcttaatggattgctttacctccatgagcgaaatgttgtccacagagatatcaaatgtgccaatatattggttcatgcgaatggatctgtaaagcttgcagattttggattggcaaaggagatgtcaaaaattaatatgctaagatcatgcaaaggaagtgtttactggatggcacctgaggttattaatcctaaaaagatgtatgggccttcagctgacatatggagccttggctgcactgtattggaaatgttaactcggcaaataccatttcctaatgtcgagtggacaaatgctttcttcatgattggaaaaggggaacaacctcctattcccaactacctgtcaaaagaagcgcaagatttcattggccagtgtgtaagagttgatccagagagccggccttcggcatcacaacttttggagcacccatttgttaacaggccgctgcgagcttcttttgaatcttctccccctggcatccgctcgtagtatgatggatgggcacttgtctttgtgaaaccaatgcttaggtcatgtatcgatcttcatgatttccactcgtggtgccagaaaggaacaacgagggtttgtttaggatatagttttgtatgtgtggtcagttggcatggtgcgcttcagtattggatgcgttccactgtattctttgggtattcttggttaggcaaagggttttccattcaatagggggttcttctttttcttctttttgtacatttgctaggcaaaaggggtgggttttactgtaatagtgttctagacttagctgatgtttgtaaatgtttggcatcatcattctttactccatggcttgtttgctcg

SEQ ID NO: 11687 - protein, 645 aa, Panicum virgatum
  misc_feature: Ceres CLONE 1750333
  misc_feature (375)..(628): Pfam Name: Pkinase Pfam Description: Protein kinase domain
  misc_feature: SWISSPROT Homolog: EC 2.7.11.25 Mitogen-activated protein kinase kinase kinase
MFSWGRKQSSSSGSSSSGRRRRGGGADASMDSSSRGGGGSGSGSRGRSPRLDRRNAAKRIEYEVGGAGASALVGASWSSSSSAEQQRSPGLRPSRSLDLAPGADLRISGSVEGEVDELCRSLGLSGPEEFAIPIAAWEARKSRSNSDLLPRPRLVASPPADELSPIARAVSAPNVQPALSVPAPIPEESPHSSSTSTATESAEEPTVPAPELSPKAAPAVAVAPPVGGLPLSSPKRGGGEVGIRGVRSPLLSPPPPITALAPPPVRRPVVADDLTGSAWDIVQSFAPSEERSELGGAHERADNRHVSDTEEGEVEDGVAAVEGELKELRIGETFEGFTGTSSLSTTNDDDASSTTTEAMFIISPNGKFKRKIKSWMRGAMLGSGSFGMVYEGISDEGGFFAVKEVSLLDQGSNAQQSILALEQEIALLSQFEHENIVQYYGTDKEESKLYIFIELVTQGSLSSLYQKYKLRESQVSAYTRQILNGLLYLHERNVVHRDIKCANILVHANGSVKLADFGLAKEMSKINMLRSCKGSVYWMAPEVINPKKMYGPSADIWSLGCTVLEMLTRQIPFPNVEWTNAFFMIGKGEQPPIPNYLSKEAQDFIGQCVRVDPESRPSASQLLEHPFVNRPLRASFESSPPGIRS

SEQ ID NO: 11688 - DNA, 1444 bp, Panicum virgatum
  misc_feature: Ceres CLONE 1750351
  misc_feature: Encodes the peptide sequence at SEQ ID NO. 11689
atcgccgcgccgctcggctccctccccccctcctcctcctcgtcgccgttgccgtcgtcgtctcgcgccaccgcccgtcatcctcggttgctgcgcagggtcgggacggggaggcgcggatgggggtgtacctcagcacgcccaagaccgacaaggtctccgccgatggggagaacgaccgcgtacggttcggcctctcctccatgcaggggtggcgggccaccatggaggacgcgcatgctgctttgccggaccttgatgactgcacttccttttttggtgtttatgatggccatggaggaaaagctgcgtctaaattctgcgcaagacatttgcataaacaagtcctcataaatgatgcaaattcatcgggtgatctacctgcttctgtttataaagctttcttaagaatggatgagatgatgaaaggccagagggggtggagagaattgactgagctcggagaaaaggggaacaagatttcgggtatgctagagggcataatatggtcccccaagggtggagattcagataatctaggggatggatgggaaaccgaggagggtccgaattcaaattttcctgggccaacatctggaagcacagcttgtgtggctgtcataagaaatgatcaactcattgttgcaaatgctggggattcccggtgtgttatctcgcgtaagggtcaggcgttcaatttgtccacggatcacaagccggatcttgagggagaaaaggagaggattttgagtgccggtggatttgttgttgctgggcgggtcaatggaagtctgaacttgtcaagggcgataggtgacatggaactgaagcaaaatgaggttttgccagctgagagacagattgtgactgctgaacctgagttgaaaacagtcaagctttctgaggatgatgaattcattgttttagcatgtgatggcatatgggactgtatgacaagtcaagaagtggttgattttgtacataagcatttgaacactgaggataagctatcggatgtgtgtgagaagttgctcaaccgctgtgtggcacctacatctggtggcgaaggatgtgataacatgactgttatcattgttcagtttaataaaccactctcttcagctgctactactagtatcgagcagcctgcagcaactgcagaagagatgcggccaaaaatttgagtccttgcctttgtgaacagcgagctcggcggcccagatgacccccagaagtaggatcaagtagcacaccatgctggtaaccggtgggtaatagacaacgaaaaggatagtgagtggtgtacataagaaaagggattctattcgacaatctctatagggtttgttccttctttctagtgttcagagtcgtcgcaatctgtaatacatggcgtgttgtttcttaaaccgggttttgtgaaatgcatggatgagttgtcagt

SEQ ID NO: 11689 - protein, 354 aa, Panicum virgatum
  misc_feature: Ceres CLONE 1750351
  misc_feature (22)..(317): Pfam Name: PP2C Pfam Description: Protein phosphatase 2C
  misc_feature: SWISSPROT Homolog: EC 3.1.3.16 Phosphoprotein phosphatase
MGVYLSTPKTDKVSADGENDRVRFGLSSMQGWRATMEDAHAALPDLDDCTSFFGVYDGHGGKAASKFCARHLHKQVLINDANSSGDLPASVYKAFLRMDEMMKGQRGWRELTELGEKGNKISGMLEGIIWSPKGGDSDNLGDGWETEEGPNSNFPGPTSGSTACVAVIRNDQLIVANAGDSRCVISRKGQAFNLSTDHKPDLEGEKERILSAGGFVVAGRVNGSLNLSRAIGDMELKQNEVLPAERQIVTAEPELKTVKLSEDDEFIVLACDGIWDCMTSQEVVDFVHKHLNTEDKLSDVCEKLLNRCVAPTSGGEGCDNMTVIIVQFNKPLSSAATTSIEQPAATAEEMRPKI

SEQ ID NO: 11690 - DNA, 765 bp, Panicum virgatum
  misc_feature: Ceres CLONE 1750364
  misc_feature: Encodes the peptide sequence at SEQ ID NO. 11691
ggcatcgcatcagcttcgcctcctcttctcttccgctgagcactgcgatggcgagttcgtggtcgcgggcgctgacgcagatctcgccctacaccttcgcctccgtcggcatcgccatctccatcggcgtctcggtcctcggggccgcctgggggatttatatcaccgggagcagcttgattggtgccgcgatcaaagcccccagaatcacctcgaaaaatctcattagtgttatcttctgtgaggctgttgctatatatggagttatcgttgcaattatcctacaaacgaagttggaaagtgtgccagcatcgaaaatatatgatccagagtctctaagagcgggatatgcaatttttgcttctgggattattgtgggttttgcaaatctgatgtgtgggctttgtgtaggaataattggaagcagttgtgctctatccaatgctcaaaattcaacactttttgtgaagattctggtcattgaaatatttggcagtgcacttgggttattcggcgtgattgttggaattattatgtcatcgcaagcaacatggccagcaaaaacaacatgagctgttttcgcagggccaatgagcttcatttgttccccgaaagatcaaatctgtgcagtatatctcaatcatgatcagcactcacgactttcttcatcagaggtacacttaattcctcggaaattacttctactttgctttctaccatcatatttagtccaggatctgcctttgtgaactggcatgtattact

SEQ ID NO: 11691 - protein, 174 aa, Panicum virgatum
  misc_feature: Ceres CLONE 1750364
  misc_feature (17)..(82): Pfam Name: ATP-synt_C Pfam Description: ATP synthase subunit C
  misc_feature (101)..(166): Pfam Name: ATP-synt_C Pfam Description: ATP synthase subunit C
  misc_feature: SWISSPROT Homolog: EC 3.6.3.14 H(+)-transporting two-sector ATPase
MASSWSRALTQISPYTFASVGIAISIGVSVLGAAWGIYITGSSLIGAAIKAPRITSKNLISVIFCEAVAIYGVIVAIILQTKLESVPASKIYDPESLRAGYAIFASGIIVGFANLMCGLCVGIIGSSCALSNAQNSTLFVKILVIEIFGSALGLFGVIVGIIMSSQATWPAKTT

SEQ ID NO: 11692 - DNA, 720 bp, Panicum virgatum
  misc_feature: Ceres CLONE 1750364-R
cgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgatt

SEQ ID NO: 11693 - DNA, 767 bp, Panicum virgatum
  misc_feature: Ceres CLONE 1750388
  misc_feature: Encodes the peptide sequence at SEQ ID NO. 11694
aaagaggaaacccttcccaagtcccaacccccacgaatcgagactcctccgctcttcccgacccgccgccgtcggtcctcctcctgctggttcgccgccatgttggaggagctgctcatcttcacgcggggcggcctcatcctctggtcctcgtgccgggcgctcggcgccgccgccctcaagggctcgcccatcgacgccctcatccgatcctgtctcctcgaggaccgctccgccgacgccagcttctcccaggacaactacgccctcaagtggaccttccacaacgagctcggccttgtctttgtcgccgtctaccagaagattctccatctcctctacgttgatgatctcctcgccgccgtccgcaaagacttctcccagatttatgatcccaagtgcaccaactatgacgacttcaccgacatattccgccagctccatctcgaggcccaagcgcgtgccgaggacatgaacaagtccaagcaggccatttcgtcccgtccgctgccagccgtctcccacaagactgctcccaaggctcgcggcgctggcacccgtgctacgaccaagggtggcgcctctaggaaggatgactctgatggggaatcatccggcaaggaccaccacgctctggcaaatggtagccacgagaatgctgctcccaaggacagctctcatacccgccctgctgttgttaagggcaaggagaacgggggccccaaagacaacggggccttcgatgtaactaaactacagaggttgcg

SEQ ID NO: 11694 - protein, 222 aa, Panicum virgatum
  misc_feature: Ceres CLONE 1750388
  misc_feature (27)..(220): Pfam Name: SRP-alpha_N Pfam Description: Signal recognition particle, alpha subunit, N-terminal
MLEELLIFTRGGLILWSSCRALGAAALKGSPIDALIRSCLLEDRSADASFSQDNYALKWTFHNELGLVFVAVYQKILHLLYVDDLLAAVRKDFSQIYDPKCTNYDDFTDIFRQLHLEAQARAEDMNKSKQAISSRPLPAVSHKTAPKARGAGTRATTKGGASRKDDSDGESSGKDHHALANGSHENAAPKDSSHTRPAVVKGKENGGPKDNGAFDVTKLQRL

SEQ ID NO: 11695 - DNA, 1194 bp, Panicum virgatum
  misc_feature: Ceres CLONE 1750424
  misc_feature: Encodes the peptide sequence at SEQ ID NO. 11696
acatcgcctccccacacctccccagccccccaccgcccccgccgctccaggccccgaaatgtcggtcgaaggcggcgccggcgagccgctcagtgacagccagaagcgggagatcgccgtctggttcctcaccaacgcgcccgccggcgagatccactacgtcgccaaagatgtgcgcgctctgctgggggacgacgcggtgtacgaggccgccgccgtggaggccttcccggagtacaacaaggcccacctcgtgtccctcgagctccccgaccgcagtggcgacataatcatcgcaacttacggggagcttgacaggaacaattatctggaccccaggactgctcaagttgctactgttgatcacattaaacagacttgtacaaaattgaggcctgctgcagatgaggagcttccgtcagcttacattgaagagtttaggagtgctttagatgtggaattatcaaaatatgttgccgaagcttatcccaaaggggtctgtgctgtttattgtactagtggaaaggatatagagggaccaggagcagattttggttttgcagtagttatttctgctgctaaacgtagcccacagaacttctgcaatggcagctggcgttcaatttggactatggatttcaattatgagttgcaatttgttgatataaagggaaagatacaggtagatgctcactattttgaagagggaaatgtccagctggatactaacattgattgcaaggactccaccataatgcagtcacctgacgattgtgcagtttcaataactaacatcattcgacatcatgagtctgagtatttgtcgtctcttgaggaatcatacttgaatttgtctgatgcaactttcaaggatcttcggaggaaacttccagttaccaggacccttttcccatggcataacacattagccttcagtctcacaagagacctcgccaaagaactagcgcttggaaaatgaagtctgcaggctatgtcactggatagcttcaagtggattttttttttttttatctccatgccatgtgctgttctgtagattgtactattcatatgatgtaaccaagactactttgatcttttgatatgtgagcttcatcgtcccagtcattgtaaatcaagaacacagacttctgttgagaattgcatttcctgaaaatatacatccattcacat

SEQ ID NO: 11696 - protein, 306 aa, Panicum virgatum
  misc_feature: Ceres CLONE 1750424
  misc_feature (15)..(297): Pfam Name: F-actin_cap_A Pfam Description: F-actin capping protein alpha subunit
MSVEGGAGEPLSDSQKREIAVWFLTNAPAGEIHYVAKDVRALLGDDAVYEAAAVEAFPEYNKAHLVSLELPDRSGDIIIATYGELDRNNYLDPRTAQVATVDHIKQTCTKLRPAADEELPSAYIEEFRSALDVELSKYVAEAYPKGVCAVYCTSGKDIEGPGADFGFAVVISAAKRSPQNFCNGSWRSIWTMDFNYELQFVDIKGKIQVDAHYFEEGNVQLDTNIDCKDSTIMQSPDDCAVSITNIIRHHESEYLSSLEESYLNLSDATFKDLRRKLPVTRTLFPWHNTLAFSLTRDLAKELALGK

SEQ ID NO: 11697 - DNA, 1469 bp, Panicum virgatum
  misc_feature: Ceres CLONE 1750426
  misc_feature: Encodes the peptide sequence at SEQ ID NO. 11698
acgcctcccaacccctctctcctcctctgctcccaagatctcctcatctcccggcccggcagcagcgcgcggggtgggcagaaagatcgagatccggaggaggcgcggcacctcgcggcaccagcaatggcgggcacggtgacggtcccgggggcgaacgtcccctccacgccgctgctcaaggacgagctcgacatcgtgatcccgacgatccgcaacctcgacttcctggagatgtggcggcccttcttccagccgtaccacctcatcatcgtgcaggacggcgacccgaccaagaccatcaaggtgcccgagggcttcgactacgagctctacaaccgcaacgacatcaaccgcatcctcggccccaaggcatcctgcatctccttcaaggactccgcctgccgctgcttcggctacatggtctccaagaagaagtacatctacaccatcgacgacggctgcttcgttgccaaggatccatctggcaaggacatcaatgctcttgagcagcacatcaagaacctcctcagcccatccaccccgttcttctttaacacgctgtatgacccctaccgtgagggtgctgactttgtgcgtgggtaccccttcagcctcagggagggtgcccacactgctgtctcccacggcctgtggctgaacattcctgactatgatgctcccacacagctggtcaagcctaaggagaggaatgaaaggtatgttgatgctgtcatgacaatccccaagggaaccttgttccccatgtgcggcatgaaccttgccttcgacagggatctcattggccctgctatgtacttcggtctcatgggtgatggccagcctattggtcgctacgacgacatgtgggctgggtggtgtgtgaaggtcatctgcgaccacttgagcctgggtgtcaagaccggcctgccatacatctggcacagcaaggctagcaacccctttgttaacttaaagaaggaatacaagggcatcttctggcaggaggacatcatccccttcttccagaacgtgaccatccccaaggagtgcgacacagtccagaagtgctacatctacctctctgggcaggtgaaggagaagctgggcaagattgacccctactttgtgaagctcgccgatgccatggtcacctggattgaggcctgggatgagctgaacccaaccgccgccgctgcgaacggcaaggccaagtagaggttgtccctggtcttcacttccccttcgaagtgatgaaagtatgattggggcctgcctaggccccatagatatagctctttttgagagggaagagagattaattcagcagcagcttttataattctttgttgttatgataccgtggttcttttgtagttgatgaaagggatttgtggttactatcatttacataattcaagacaataatttatcgtgtaattttgagaatgaaagcactgtttgtgtgg

SEQ ID NO: 11698 - protein, 363 aa, Panicum virgatum
  misc_feature: Ceres CLONE 1750426
  misc_feature (13)..(356): Pfam Name: RGP Pfam Description: Reversibly glycosylated polypeptide
MAGTVTVPGANVPSTPLLKDELDIVIPTIRNLDFLEMWRPFFQPYHLIIVQDGDPTKTIKVPEGFDYELYNRNDINRILGPKASCISFKDSACRCFGYMVSKKKYIYTIDDGCFVAKDPSGKDINALEQHIKNLLSPSTPFFFNTLYDPYREGADFVRGYPFSLREGAHTAVSHGLWLNIPDYDAPTQLVKPKERNERYVDAVMTIPKGTLFPMCGMNLAFDRDLIGPAMYFGLMGDGQPIGRYDDMWAGWCVKVICDHLSLGVKTGLPYIWHSKASNPFVNLKKEYKGIFWQEDIIPFFQNVTIPKECDTVQKCYIYLSGQVKEKLGKIDPYFVKLADAMVTWIEAWDELNPTAAAANGKAK

SEQ ID NO: 11699 - DNA, 745 bp, Panicum virgatum
  misc_feature: Ceres CLONE 1750432
  misc_feature: Encodes the peptide sequence at SEQ ID NO. 11700
ataaatcctccgccctctctctctcttcctcggccggcctgctcctgcgatccgtgctgcagatcgccagatcagtcgacatggcgctcgtattgcattctggacctggtaacaagaatgccttcaaggcacttattgctgcagaatacagtggggttaagattgagttgacaaagaattttgagatgggtgtcaccaacaagacccctgagtttcttaagatgaacccccttgggaaggtgcctgttctggagactcctgaaggtgctgtttttgagagcaatgctattgcacgctatgttgctcgcttgaatgatggcaaccctctttttgggtcttctcgtattgaacaagcccatgttgagcagtggatggactttgctgcaacagaagttgatcctggtgttgcatggtacttgtacccaaggcttggttacattccttattctcagacgacagaggaaacagctattgcctcattgaagagagcgcttggttctctgaacacccaccttgcctcaaagacattccttgtagggcattctgtcactctagctgacattgtattgacatgcaacctctaccatggatttgcacggatcttgaccaagagcttcacatccgagttccctcatgtcgagaggtatttctggaccatggttagccagcctaacttcaagaaggtcatgggtgatgtcaagcaggcagagtcagtgcctcctgttccgaaaaggctgctgccctc

SEQ ID NO: 11700 - protein, 221 aa, Panicum virgatum
  misc_feature: Ceres CLONE 1750432
  misc_feature (1)..(76): Pfam Name: GST_N Pfam Description: Glutathione S-transferase, N-terminal domain
  misc_feature (104)..(197): Pfam Name: GST_C Pfam Description: Glutathione S-transferase, C-terminal domain
  misc_feature: SWISSPROT Homolog: EC 2.5.1.18 Glutathione transferase
MALVLHSGPGNKNAFKALIAAEYSGVKIELTKNFEMGVTNKTPEFLKMNPLGKVPVLETPEGAVFESNAIARYVARLNDGNPLFGSSRIEQAHVEQWMDFAATEVDPGVAWYLYPRLGYIPYSQTTEETAIASLKRALGSLNTHLASKTFLVGHSVTLADIVLTCNLYHGFARILTKSFTSEFPHVERYFWTMVSQPNFKKVMGDVKQAESVPPVPKRLLP

SEQ ID NO: 11701 - DNA, 769 bp, Panicum virgatum
  misc_feature: Ceres CLONE 1750493
  misc_feature: Encodes the peptide sequence at SEQ ID NO. 11702
gactcttctgtgggcgtgctacgatccatttgccatggctaacatagcacagcagttcatgcttgagctgacggctccacggtcatggatgctgctgctcctccctctcctcctcctgcttgtacgctgctggttccgtgccaagagagcgaggggtatcaggcagcaacaagatgaccacctaccgccttcccctccggcgctgcccgtcctcgggcatctccacctcgtcggctcgctcccgcacgtctctctccgaagcctcgctcggaaacacggctacgacctcatgctcctccgcctcggcgccatgccggtcgtcgtcgtgtcgtcgccgagcgccgccgaggcggtgctgcgcacgcacgaccacgtgctcgcgtcccggccgtactctctggtcgccgacgtcgtcatgtacggcatctccgacatcggcagcgcgccgtacggggactactggaggagggcgaggaagctcgtcaccacgcacctgctcaccgtcaagagggtgcagtcgttacgccacgcccgcgaggaagaagtgagcagggtgatagctcagatcggagaggcggccggcgtcggcgccgcagtggacgtgagccatctgctcggctcgttcgcgaacgacctggcctgccgcgccgttatgggcaagtcatcgtcccggaacgagggcccgagcaagctgttccggcagctcatcgtcgacacgtcgccgctccttggaggcttcaacgtcgaggaattcttccccttcctggct

SEQ ID NO: 11702 - protein, 244 aa, Panicum virgatum
  misc_feature: Ceres CLONE 1750493
  misc_feature: SWISSPROT Homolog: EC 1.14.13.68 4-hydroxyphenylacetaldehyde oxime monooxygenase
MANIAQQFMLELTAPRSWMLLLLPLLLLLVRCWFRAKRARGIRQQQDDHLPPSPPALPVLGHLHLVGSLPHVSLRSLARKHGYDLMLLRLGAMPVVVVSSPSAAEAVLRTHDHVLASRPYSLVADVVMYGISDIGSAPYGDYWRRARKLVTTHLLTVKRVQSLRHAREEEVSRVIAQIGEAAGVGAAVDVSHLLGSFANDLACRAVMGKSSSRNEGPSKLFRQLIVDTSPLLGGFNVEEFFPFL

SEQ ID NO: 11703 - DNA, 1749 bp, Panicum virgatum
  misc_feature: Ceres CLONE 1752760
  misc_feature: Encodes the peptide sequence at SEQ ID NO. 11704
aaccgagtaaaccccaagttcgatctcccaacaacaaaacccttccccgacccttcccgccgccgccacgccgacgaccaccacctcaacgccgaacgccgtcctcccgtccgccgccgcagccatggacgctgacccctcgcgccaggtgcgcgtacgcttcgttaccaagctgccgcccccactgcgggcgccgcccgccgccatcgccgtccccgccgacctctcccgcatgggcctctctgagatcgtcaacagcctcctcgccgccgccgaaccggaccacaaggcgcagcccttcgacttcctcgtggacggcgagctcgtgcggctgccgctccagcagttcctcctctccaagggcatctcggcggagagggtgcttgagctagagtatgtgaaagctgtggcgccaaggaagcaggaggaaccctgcccccatgatgactgggttagtgcggtcgatgggtcaaacccgagattcatattaacaggatgctatgatggtcttgcaagattatggaaagatgctgcagtatgtacacaaattttggagggacacagcgatgcaattacttctaccaggttcatcaataaaggagttgaaactgtgggcagtctgcatgtagtgactggctcaaaggataggtcattgcggctatacaagtgtgatacatcagtcagtatggactacccaaagcgggtcggagcttacaaaattcttcgtgggcatacatcatcagttcaaagtatcgctgtagacccttcaagtgacatgctctgttctggttcctgggatagcaccatcaagctgtgggctgttgaaggatctgaagaagatggcgatgctgtttcattgaagaagagaaggatgaattcttactcatctggacctgaagagtcccagttagagggtttagccacttcaacgtttctgggacatacacaatgtgttactgctgttacctggcctggtcaacaaatgatatattcagcatcttgggatcattctgttcggcagtgggatgtccaaacagtgaaagaaacatggaatatgttttgtgggaaggccttgaattgcttggactgtggcggtgagggctcttcattgattgctgctggaggctctgaccccgtcctgagggtatgggaccctcgcaaacctggaacattagctcctgtttttcagttctcctcacactcaagctggatcactgcctgtaaatggcatccaagctcctggttccatctagtatcatcttcatttgatgggaaagtcatgttgtgggatctaagaacagcatggccactggcttccgtggactcgcacaaagataaggttttatgtgccgattggtggaaaggggacagtgtgatcagtggtggagctgattccaagctatgtatcgcatctggtgttgaaattgtgtgaaggttttttgtcgtgcttcttgagtccatgctattgaggtgcaatgtgaaacaatgtatggtcgacaagccatacctaaaagccaaacaatgtcaattatggttgggaacatatgcaacccttcagtcagatcaagatacagcacagggcttggcatttgtgtatgcacttatgcatgagtatgcataagtaagatccatagtaatggatcactgcattttgctcttcaacttttttgtttgttacttggtgaaattggcaccagaattattgaattatcccaagatgatgaattataaatcagttgattgttggct

SEQ ID NO: 11704 - protein, 435 aa, Panicum virgatum
  misc_feature: Ceres CLONE 1752760
  misc_feature (350)..(389): Pfam Name: WD40 Pfam Description: WD domain, G-beta repeat
  misc_feature (194)..(232): Pfam Name: WD40 Pfam Description: WD domain, G-beta repeat
  misc_feature (264)..(301): Pfam Name: WD40 Pfam Description: WD domain, G-beta repeat
  misc_feature (137)..(181): Pfam Name: WD40 Pfam Description: WD domain, G-beta repeat
  misc_feature (8)..(76): Pfam Name: NLE Pfam Description: NLE (NUC135) domain
  misc_feature: SWISSPROT Homolog: EC 2.7.11.7 [Myosin heavy-chain] kinase
MDADPSRQVRVRFVTKLPPPLRAPPAAIAVPADLSRMGLSEIVNSLLAAAEPDHKAQPFDFLVDGELVRLPLQQFLLSKGISAERVLELEYVKAVAPRKQEEPCPHDDWVSAVDGSNPRFILTGCYDGLARLWKDAAVCTQILEGHSDAITSTRFINKGVETVGSLHVVTGSKDRSLRLYKCDTSVSMDYPKRVGAYKILRGHTSSVQSIAVDPSSDMLCSGSWDSTIKLWAVEGSEEDGDAVSLKKRRMNSYSSGPEESQLEGLATSTFLGHTQCVTAVTWPGQQMIYSASWDHSVRQWDVQTVKETWNMFCGKALNCLDCGGEGSSLIAAGGSDPVLRVWDPRKPGTLAPVFQFSSHSSWITACKWHPSSWFHLVSSSFDGKVMLWDLRTAWPLASVDSHKDKVLCADWWKGDSVISGGADSKLCIASGVEIV

SEQ ID NO: 11705 - DNA, 831 bp, Panicum virgatum
  misc_feature: Ceres CLONE 1752778
  misc_feature: Encodes the peptide sequence at SEQ ID NO. 11706
gacaaaaccctagcccccagcagccgcagcggccaccacttcgcgtcccctgtctccctctcgtcacccgccgccgccgccgccgcagtgagcatcccgccctgccgcagatcagataagatggccgcagttgacaccttcctctttacctcggagtctgtgaatgagggacaccctgacaagctctgcgaccaggtctcagatgccgttcttgatgcttgccttgctgaggacccagacagcaaggttgcttgcgagacctgcaccaagactaacatggtcatggtttttggtgagatcaccaccaaggccaacgttgactacgagaagattgttagggagacctgccgcaacatcggtttcgtgtctgcagatgttgggcttgatgctgacaactgcaaagtgcttgtgaacattgagcagcagtcccctgatattgctcagggtgtgcatggccacttcacaaagcggcctgaggagattggagctggtgaccagggacacatgttcgggtatgcaactgatgagaccccagagctgatgcccctcagtcatgtccttgccaccaagcttggtgctcgtctcactgaggtgcgcaagaacgggacctgcccctggctcaggcctgatgggaagacccaggtgactgttgagtaccgcaatgagggtggtgccatggtccccatccgcgtccacactgtcctcatctctacccagcatgacgagacagtcaccaacgacgagattgctgctgacctcaaggagcatgtcatcaagcccgtcatccctgagcagtaccttgatgagaagaccatcttccacctgaaccct

SEQ ID NO: 11706 - protein, 236 aa, Panicum virgatum
  misc_feature: Ceres CLONE 1752778
  misc_feature (119)..(236): Pfam Name: S-AdoMet_synt_M Pfam Description: S-adenosylmethionine synthetase, central domain
  misc_feature (5)..(104): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
MAAVDTFLFTSESVNEGHPDKLCDQVSDAVLDACLAEDPDSKVACETCTKTNMVMVFGEITTKANVDYEKIVRETCRNIGFVSADVGLDADNCKVLVNIEQQSPDIAQGVHGHFTKRPEEIGAGDQGHMFGYATDETPELMPLSHVLATKLGARLTEVRKNGTCPWLRPDGKTQVTVEYRNEGGAMVPIRVHTVLISTQHDETVTNDEIAADLKEHVIKPVIPEQYLDEKTIFHLN

SEQ ID NO: 11707 - DNA, 676 bp, Panicum virgatum
  misc_feature: Ceres CLONE 1752778-R
  misc_feature: Encodes the peptide sequence at SEQ ID NO. 11708
gacacctatggtggctggggagcccatggtggtggcgctttctctggcaagaccccaaccaaagtcgaccgaagtggagcctacgttgcaaggcaggctgccaagagcatcgttgctaacggccttgctcgccgcgccatcgtccaggtctcgtatgccattggtgtgcctgagccactctctgtgtttgtcgacacatacggtactggcacgatcccagacaaggagattctcaagattgtgaaggagaactttgacttcaggcctggcatgatcatcatcaaccttgacctcaagaaaggcggcaacgggcgctacctcaagacagcagcctatggtcacttcggaagggacgactctgacttcacctgggaggtggtgaagcccctcaagtgggagaagccttctgcttaaggcgcccttccagaagaagcttttggtcttctgggcttatcatatggcttctgtgttatggttcttgatataccccttgctttcatttgtattgtagtgtcgtaataagtggtacttgtgagtgtattactgtcttgttatttacgtagaggaggatttattgtctgctatttcttctttcactacttattatgtaatggtcaacgaaagaaagaagctacaggctactttgagaagaaatggaagctgctgttttctggtt

SEQ ID NO: 11708 - protein, 137 aa, Panicum virgatum
  misc_feature: Ceres CLONE 1752778-R
  misc_feature (1)..(126): Pfam Name: S-AdoMet_synt_C Pfam Description: S-adenosylmethionine synthetase, C-terminal domain
  misc_feature: SWISSPROT Homolog: EC 2.5.1.6 Methionine adenosyltransferase
  misc_feature: Useful for making plants with modulated biomass
DTYGGWGAHGGGAFSGKTPTKVDRSGAYVARQAAKSIVANGLARRAIVQVSYAIGVPEPLSVFVDTYGTGTIPDKEILKIVKENFDFRPGMIIINLDLKKGGNGRYLKTAAYGHFGRDDSDFTWEVVKPLKWEKPSA

SEQ ID NO: 11709 - DNA, 1816 bp, Panicum virgatum
  misc_feature: Ceres CLONE 1752838
  misc_feature: Encodes the peptide sequence at SEQ ID NO. 11710
aaaaaattccggcgaaactaatcaaatccctccccctttgtacgtgtcctcgtacgcgtgggtgggagaacccaccagctcacagtgccttcccctcttggatcgggaggagcggagccgacgcgagattcggatttgaattccgacggttgggggaggaacaggagggtcgccatggagaaggaggagaaggtggcggcggaggctgccgcggcggaggccaggcggcggctggtgatcggggtcgggttctgggtgcaggggttccggctgttcccgtggctgggcgtcaacttcttcctcaaggacggcatgggcgtcgccgcctcctccctgcagatcctccaggcctccgccaacctgcccatggtcgccaagccgctcctcggcctcctctccgacgccgttcccatacgcgggcaccggcgcctgccttacgtcgccatcggcgctctcttgcaggcagtttcatggttagccatttccctttggccaactatttcccttccagttcttaccatttttctcctcttgagcaactttggtgcttccatttgtgaggttgccaatgatgccatagtagcagaggctgggaagcaagtgagctcttcctcagggtcaggtcagcttcaatcctttgcttggatgtttggctcctctgctggtgctttaggaaatctccttggtggcgttgctctcagttatttttctcccaaaatcatgtttctgttttttgcaatccttctcgtgatccagttcttcacaactgtggctatacctgagagctccctcagactcccaaaggcagctaccaatctatcggcactaaccagcatccgtaagcaagtcaaagagctgtcatgtgccctgtgtatgcctgaaatgttttggtcaatcatatggtttacattatcgtacactgtcataccttttctacttgggaccatgttcttctatcagactgaagtgttaagactagactcatcagttatcggcttatcaaaggtgtttgggcaagttgcactcttggcctggagcatgtcatacaacaaatacttcaaaacaatgtctgcccgtaaggtcctatcagttctgcagtttgccttagcactcgtaatgttgtcggatgtgttgttcgttcagggaatatacaggaagatcagaataccagactccatatacacaattatcttctccgggttgtttgagggtcttatgtttttcaaggtgctgcccttcagtgtccatattgcaaaactttgccctgctggttgtgagggatcagtaatggccttcgttatgtctgcacttgcccttgccactatcgtcagtggctatcttggagttgttcttgctgctttcatgggagtatctggagatgatttttcggcactgcctgcttgcctgttgattgaagctgcatgcacaatgctaccattgtgttgctcgtcattgatcaaagagagaagagaaaaggagaagaaagaagaatagactacatatatatcatctggaggtggtgtaatggtgactgtcgggctttaccctaaccttttttggccagttcaattctataaagtcatcacctccggaagaaagaaaatagaagattcgatccatcaggtgctaaatcctctaaggcttcaccagaactatcgtctagcaaagagcttatatgtacatacaagttagctgccattcttctacagatcaattattacttttatgtaactagttttcatacgttgtttaatgtaccttggtttgcttgttacatgtgttctacatggacagttcgatttgcatatgttgcgcc

SEQ ID NO: 11710 - protein, 439 aa, Panicum virgatum
  misc_feature: Ceres CLONE 1752838
  misc_feature (29)..(438): Pfam Name: BT1 Pfam Description: BT1 family
MEKEEKVAAEAAAAEARRRLVIGVGFWVQGFRLFPWLGVNFFLKDGMGVAASSLQILQASANLPMVAKPLLGLLSDAVPIRGHRRLPYVAIGALLQAVSWLAISLWPTISLPVLTIFLLLSNFGASICEVANDAIVAEAGKQVSSSSGSGQLQSFAWMFGSSAGALGNLLGGVALSYFSPKIMFLFFAILLVIQFFTTVAIPESSLRLPKAATNLSALTSIRKQVKELSCALCMPEMFWSIIWFTLSYTVIPFLLGTMFFYQTEVLRLDSSVIGLSKVFGQVALLAWSMSYNKYFKTMSARKVLSVLQFALALVMLSDVLFVQGIYRKIRIPDSIYTIIFSGLFEGLMFFKVLPFSVHIAKLCPAGCEGSVMAFVMSALALATIVSGYLGVVLAAFMGVSGDDFSALPACLLIEAACTMLPLCCSSLIKERREKEKKEE

SEQ ID NO: 11711 - DNA, 1502 bp, Panicum virgatum
  misc_feature: Ceres CLONE 1752997
  misc_feature: Encodes the peptide sequence at SEQ ID NO. 11712
gggaggtggtggtggtggaggagaccggggggtgatccggctcccgtctcggccgatggcgtcgctgttcggcaacggcggctacagctactcctcggggtcgtcggatggggaggacgaggacgaagggacggaggggtaccggaagggcgggtaccacgcggcccggcccggggaccgcttcgccggcgggaggttcgtcgcgcagcggaagctaggctggggcaacttctccaccgtctggctcgcctacgacaccctccacagcagatttgtggccctcaagatccagaagagcgcgagggattacgcacacgcagctctccacgaaatcgagctactgtcagcggtagcgaaaggagacccgacgaattccaagtgcgtcgtgcggttgttagaccatttcaagcacgttggccccaacgggcaccacgtctgcctggtcacggagtttctcggcgacagcctgctccggctgatacggtacaaccggaacaagggcgttgggctgagcagagtgaaggaaatctgccgatctttgctggtcggccttgactacctgcatagtgagcttggcatcattcacacggatttaaaaccggagaatgttcttctggtttcgacaattaatccggccaaggatcctgtgcgctcggggttcaccccaattcttgataggcctgtgggaagccaatatggtaggacagtgatcagtttcagtgagaagatgctaaaaatgagagcaagacgtgccgtggcaaagatttcacggaggcgagtttcgcttggcgggtttgcagctgaagtggagaaggagaggaaccttgatgggattagcttgaagtgcaagatcgtcgattttgggaatgcctgctggggcgatcagcagcttgctggtgaaatacagacaaggcagtacagagctccggaggttatcatcggttcagggtactcgtattctgctgacatgtggtcgtttacttgcatagcctttgagcttgccactggtgacttgttgtttgctcccaagaattgcgaaggatgcagcgaagatgaggaccacttggctctaatgatggaaactcttggaaagatgcctcggaagattgctacctcgggaactcgttccaaggattactttgatcggcacggtgatttaaagaggatccggagactgaagttctggcccctggattgtttacttgttgaaaggtacaatttcactgaaactgacgcccgagggtttgctgattttcttcggccaatcctagattttacaccggagaacaggccttctgctgcgcagtgcttgaaacacccatggcttaattgatctgatgagatgaggaagtctaaccaacagaagtttatacataccaagtacgctcacgatcgaggactctttgtgaccgggactgcagatatccacagactttaatgtaacatagtcaggaactatgttttttttggtgcagcttgatgaggcatgatgcttcagcttc

SEQ ID NO: 11712 - protein, 425 aa, Panicum virgatum
  misc_feature: Ceres CLONE 1752997
  misc_feature (48)..(424): Pfam Name: Pkinase Pfam Description: Protein kinase domain
  misc_feature (238)..(425): SWISSPROT Homolog: EC 2.7.11.1 Non-specific serine/threonine protein kinase
  misc_feature (33)..(189): SWISSPROT Homolog: EC 2.7.12.1 Dual-specificity kinase
MASLFGNGGYSYSSGSSDGEDEDEGTEGYRKGGYHAARPGDRFAGGRFVAQRKLGWGNFSTVWLAYDTLHSRFVALKIQKSARDYAHAALHEIELLSAVAKGDPTNSKCVVRLLDHFKHVGPNGHHVCLVTEFLGDSLLRLIRYNRNKGVGLSRVKEICRSLLVGLDYLHSELGIIHTDLKPENVLLVSTINPAKDPVRSGFTPILDRPVGSQYGRTVISFSEKMLKMRARRAVAKISRRRVSLGGFAAEVEKERNLDGISLKCKIVDFGNACWGDQQLAGEIQTRQYRAPEVIIGSGYSYSADMWSFTCIAFELATGDLLFAPKNCEGCSEDEDHLALMMETLGKMPRKIATSGTRSKDYFDRHGDLKRIRRLKFWPLDCLLVERYNFTETDARGFADFLRPILDFTPENRPSAAQCLKHPWLN

SEQ ID NO: 11713 - DNA, 1712 bp, Panicum virgatum
  misc_feature: Ceres CLONE 1753011
  misc_feature: Encodes the peptide sequence at SEQ ID NO. 11714
gtccgatcggctacctaactcccgctgtcttggacaggtcatcctgagcccgccgccggcgagccatggcgcaccaaccaggagacgccgaggcgccgctgctcgccaagccggcggcgaagcgcaacaagtacccctttttctgcgccgtgctcgcctccatgacctccgtcctcacgggctaccacatggcggtgatgagcggcgcgcagatcttcatggcggaggacctgggcatcagcgacgcgcaggtggaggtgctctcgggcgtcatcaacatctactcgctcgtcggcgcgctgctggcggggtggacctccgaccgccacggccgccgccttaccatcgtgctcgccaacgtcttcttcctcgccggcccgctcgccacggcgctcgggggagggtacgccgcgctcatggtgggccgcttcatcgccggcctcggctccgggtacgcgctcgtcgtcgcgcccgtctacgccgccgagatcgcgcccgcgtcgtcccgcggcctcctcacctcgcttcctgagatctttatgaacaccggagcgatgctgagctacgtttccaacttggccttctcggggctacccgtgcacctgtcgtggcgggtcatgttcgcggtggcggtggtgcccacggtgttcctggcggccggcgtgctcaccatgccggagtcgccgcggtggcttgccatgaagggcagggtcgccgaggccaaggccgtgctcgacaagacgtcggacacgcccgccgaggccgagcagcggctgctggagatcgaggcagtcgtcagcagcggtgaaggcggcggcggcgcgtggaaggaggtggccacaaaggccggcgtccgccgcgtgctggccatcgtgctcacgctgcagttcttccagcagtcgtcgggcatcgacacggtggtgatgtacgccccgcgtgtgctggccatggccggggtcacctccaccaccctgctcctgagcctcaacgttctcttcggcatcgccaaggccggctccgtcctcatcgccatggcgctcgccgaccgcgtcggacgccgcccgctcctcctcgcgagcacgggcggcatgacggcgtccctgctcgtcctgggctcgctgttcgtggcgttcgccggcgccaaggacgacgccgcggtggccgcggtgagcgccgccgccgtggtggcgttcgtggtggccttctccgtcgggctcgggccgctggcctgggcgtacagctcggagatcctgccactccggctgcgcggccatggcgcggggctcggcaccgccttaaacctgttcgtgagcggcgtcgtcaccatgaccttcatctcgctctacaaggccatcaccatggccggcgcgttctacctctacgccgccgtcgccgcggcctcgttcgtgttcatctacacgtgcctgccggagaccatgggccggagcctcgaggacatggaggagctcttccacaccaagtgattcgtgtgatctgaccaaaccatcaattcgattcgattcagtagcattgccaaatgccaatttggcattgtcggagcttcgtctagaattttggtcgatcacggacgcaaatatgactcctgcaaatacaaatttcaacactgtaaatttgtattctttttatcaagaccacgggaataaaagaatttgcacttcatcatgctgttaatgatgatggatgcattattc

SEQ ID NO: 11714 - protein, 472 aa, Panicum virgatum
  misc_feature: Ceres CLONE 1753011
  misc_feature (27)..(469): Pfam Name: Sugar_tr Pfam Description: Sugar (and other) transporter
MAHQPGDAEAPLLAKPAAKRNKYPFFCAVLASMTSVLTGYHMAVMSGAQIFMAEDLGISDAQVEVLSGVINIYSLVGALLAGWTSDRHGRRLTIVLANVFFLAGPLATALGGGYAALMVGRFIAGLGSGYALVVAPVYAAEIAPASSRGLLTSLPEIFMNTGAMLSYVSNLAFSGLPVHLSWRVMFAVAVVPTVFLAAGVLTMPESPRWLAMKGRVAEAKAVLDKTSDTPAEAEQRLLEIEAVVSSGEGGGGAWKEVATKAGVRRVLAIVLTLQFFQQSSGIDTVVMYAPRVLAMAGVTSTTLLLSLNVLFGIAKAGSVLIAMALADRVGRRPLLLASTGGMTASLLVLGSLFVAFAGAKDDAAVAAVSAAAVVAFVVAFSVGLGPLAWAYSSEILPLRLRGHGAGLGTALNLFVSGVVTMTFISLYKAITMAGAFYLYAAVAAASFVFIYTCLPETMGRSLEDMEELFHTK

SEQ ID NO: 11715 - DNA, 1523 bp, Panicum virgatum
  misc_feature: Ceres CLONE 1753047
  misc_feature: Encodes the peptide sequence at SEQ ID NO. 11716
aatgatcaccaaacgcattagaaaaccgcggcgagctggaaagccggcggcgcggaggggaggccgacaggcgacaggcaggcggcagccggaaaggcacccgccccccagcttggccacagccactgccgccgctcctcctctgcttcttcatctcttgcctttctctgacgagccgccacccaagaaactgcccagagcagacccgcccccattgcctcccggcgcagcagttctttacatcaggaaagaagagcaagaagagttcagtaggtcaccatgcgccggtggttttgctgcactcattttgacacaccatatctcgaaaatgagaatggatttacaaaaagtccggacagaacaagtggaaacggtctaacttcgaacagtgatcctgcgaaaccaccttccattgaagtaccggcattgtcgtttgatgaactgaaagaaaagacagatgattttgggtcaaagactttggttggtgagaggtcatatggaagagtatattatgctgttttggaaaatggaaaacatgcagccgtgaagaagcttgatgcttcagcagaccctgagcccgacaatgaatttctagcgcaggtctccgttgtttcaagattaaaacatgaaaattttgtggacatgcttggttattgcattgaaggagatcaacgtctgttggcttatgaattcgctacaatgggctccctacatgatattttgcatggaagaaaaggtgtcgcaggtgcgcagcctggtcctgctctcgactggatgcaaagagtcagaattgctgttgatgctgcaaaaggtcttgagtaccttcatgagaaggttcaaccttccatagtccatcgagacatacgatctagcaatgttcttttatttgaggactataaggctaaaattgcggacttcaatctttcaagccaatctccagatatggctgctcgcctacattctacccgtgtcctcggaacctttggatatcatgctccagagtatgctatgactggccaactgactcaaaaaagtgatgtttatagctttggagttgtccttttagagcttctaactggaaggaaacctgtagatcatacaatgccaaggggccagcagagtcttgttacttgggcaacaccaaggctcggtgaggacaaggtgaaacaatgtgttgatccaagattaaatggagagtaccctccaaagggtgttgccaagcttgcggcagtggcagctctctgcgctcaatatgaatctgagttcagaccaagcatgagcattgtagtcaaggcattgtctccccttcttgtaaatgcaccctatcaagcggcggcggctcctgatacaccttcagaagcctgacaaaatgttcaactcaactcatgtaaagaaatagcatttgtttctgggtaataccaattttatcaattatttgtcttttatacatctgaattatgtgtgtttactatagaggaagggggaagaaaggagtaatgcaatttttttaacacgtgtacttc

SEQ ID NO: 11716 - protein, 361 aa, Panicum virgatum
  misc_feature: Ceres CLONE 1753047
  misc_feature (50)..(340): Pfam Name: Pkinase_Tyr Pfam Description: Protein tyrosine kinase
  misc_feature: SWISSPROT Homolog: EC 2.7.11.1 Non-specific serine/threonine protein kinase
MRRWFCCTHFDTPYLENENGFTKSPDRTSGNGLTSNSDPAKPPSIEVPALSFDELKEKTDDFGSKTLVGERSYGRVYYAVLENGKHAAVKKLDASADPEPDNEFLAQVSVVSRLKHENFVDMLGYCIEGDQRLLAYEFATMGSLHDILHGRKGVAGAQPGPALDWMQRVRIAVDAAKGLEYLHEKVQPSIVHRDIRSSNVLLFEDYKAKIADFNLSSQSPDMAARLHSTRVLGTFGYHAPEYAMTGQLTQKSDVYSFGVVLLELLTGRKPVDHTMPRGQQSLVTWATPRLGEDKVKQCVDPRLNGEYPPKGVAKLAAVAALCAQYESEFRPSMSIVVKALSPLLVNAPYQAAAAPDTPSEA

SEQ ID NO: 11717 - DNA, 1431 bp, Panicum virgatum
  misc_feature: Ceres CLONE 1753065
  misc_feature: Encodes the peptide sequence at SEQ ID NO. 11718
agtcccctccaagcctcccccgccgccgtggccgcattccatctcttgccggcgcggcggcgacgagcaccaaccaggtaaggaaggaggagttcggcgaggatgtcgcaccgtaaattcgagcacccaaggcatgggtccctcggcttcctccctaggaagcgatcctcccgccaccgcggaaaggtgaaatccttccctagggataacccgaagaagccctgccacctcactgccttccttggctacaaggctggcatgacacatatcgtgcgtgaggttgagaagcctggctctaagctgcacaagaaggaaacttgtgagcctgtgaccatcattgagacccctcctcttgtcattgttggacttgtggcgtacgttaagaccccacgtggtctgcgtaccctcaactctgtctggccccagcaccttagcgaagaagtgaggagaaggttctacaagaactggtgcaagagcaagaagaaggccttcaccaaatatgccctaaaatacgacagtgatgcaggcaagaaagaaatacagttgcagcttgagaagatgaagaagtatgcttcagttgtccgtgttatcgcccacactcagattagaaagatgaagggtttgaagcagaagaaggcccatctcatggagatccaggttaacggtggcaccatcgcagacaaggttgactatggctacaagttttttgagaaggaggtgccggtggatgccgtcttccagaaggatgaaatgattgacatcattggtgtcaccaagggtaaggggtacgaaggtgtggtcacccgttggggtgttacccgtcttccccgcaaaacccacaggggtctccgcaaggtcgcctgtatcggtgcttggcatcctgctagggtgtcgtacaccgttgcccgtgctggtcagaatggataccaccaccggactgagataaacaagaaggtttacaagatcggcaaggctggacaggaaagccacgacgcctccacagaatttgataggactgagaaggacatcactccaatgggtggcttcccccactatggtattgtcaagggtgactacctgatgatcaaggggggctgcgttggccccaagaagagggtggtgacactccgccagtccctgctgaagcaaagctcacgggtggcgctggagcagatcaacctcaagttcgtcgatacctcatccaagttcgggcacgggcgcttccagaccactgacgagaagcagaagttctacggcaagctcaagacctgagctgccgtttgtgttgtcaaagcaaaacatagtaccagatagtgttcagttttttttcctcagttttgttggagatattcagggaaccgcagttttgcagcattttttattttctgttattggatggtgtacttgtgctccctgtcaacacgattgttc

SEQ ID NO: 11718 - protein, 389 aa, Panicum virgatum
  misc_feature: Ceres CLONE 1753065
  misc_feature (50)..(343): Pfam Name: Ribosomal_L3 Pfam Description: Ribosomal protein L3
MSHRKFEHPRHGSLGFLPRKRSSRHRGKVKSFPRDNPKKPCHLTAFLGYKAGMTHIVREVEKPGSKLHKKETCEPVTIIETPPLVIVGLVAYVKTPRGLRTLNSVWPQHLSEEVRRRFYKNWCKSKKKAFTKYALKYDSDAGKKEIQLQLEKMKKYASVVRVIAHTQIRKMKGLKQKKAHLMEIQVNGGTIADKVDYGYKFFEKEVPVDAVFQKDEMIDIIGVTKGKGYEGVVTRWGVTRLPRKTHRGLRKVACIGAWHPARVSYTVARAGQNGYHHRTEINKKVYKIGKAGQESHDASTEFDRTEKDITPMGGFPHYGIVKGDYLMIKGGCVGPKKRVVTLRQSLLKQSSRVALEQINLKFVDTSSKFGHGRFQTTDEKQKFYGKLKT

SEQ ID NO: 11719 - DNA, 825 bp, Panicum virgatum
  misc_feature: Ceres CLONE 1753075
  misc_feature: Encodes the peptide sequence at SEQ ID NO. 11720
actagccgcctccccaacctcctcaccgaggagagagaggacagaggagagagaggaggttccatttccgcgtcgtctccgcccgcagccccaccctccacatggccgcgctgccgggtggggcccacgccgccggctccgcggacccgatgcaggtggaccagccgcgccccgccgccgcggcagcagcgaccgctcccgcggacgccaagcaagctggttctatgattgaagggggtgatccagtcactggtcacataatctcaacaaccattggaggcaagaatggagaacctaaaaggactatcagctacatggccgagagagttgtgagaactggatcattcggaatcgttttccaggctaaatgtctggagactggtgagactgttgcaattaagaaggttttacaggacaagcggtacaagaatagggagcttcaaatcatgcgatccatggatcactgcaatgtcgtctccttgaagcattgcttcttctctaccacaagcagggatgaacttttccttaacttggtgatggagtttgttcccgagtcactgtatcgtgtactgaagcattacagcaatatgaaccagaggatgccgcttatatatgtcaagttatacacctaccagatatttcggggtttagcctacattcacattgtacctggcgtttgccacagggatgtgaaacctcagaatcttttggttgatcctctgactcaccaagtgaagatatgtgattttgggagtgccaaaatgttggtcaaaggtgaagcgaacatatcatatatatgctcacgttattaccgtgctccagagt

SEQ ID NO: 11720 - protein, 241 aa, Panicum virgatum
  misc_feature: Ceres CLONE 1753075
  misc_feature (71)..(241): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated biomass
  misc_feature: Useful for making plants with modulated water use efficiency
MAALPGGAHAAGSADPMQVDQPRPAAAAAATAPADAKQAGSMIEGGDPVTGHIISTTIGGKNGEPKRTISYMAERVVRTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHIVPGVCHRDVKPQNLLVDPLTHQVKICDFGSAKMLVKGEANISYICSRYYRAPE

SEQ ID NO: 11721 - DNA, 655 bp, Panicum virgatum
  misc_feature: Ceres CLONE 1753075-R
  misc_feature: Encodes the peptide sequence at SEQ ID NO. 11722
ttccacaagcggatgcctccagaagctatagatctcgcttcacgtctgctccagtattcaccaaatctacgatgcactgctcttgaagcatgcgcacatccattctttgatgagttgcgggaaccacatgcaaagttgccaaatggtcggccattccctccactgtttaactttaaacaggaactagcaaatgcttctcctgagcttatcaacaggttgatcccagaccatgcgaggcggcatcttgggctcagttaattgcctgcaactggaccatagggaagctgtatggtgttttaccctgcgcttccaatgcttcgtgacgaagggcaacctgcatgtccgcacatttaagatgtagaatctgaccattattggaaagccaaacgtgagctggtgccattgtgttgcatgaggggaggtgtgtttggtacagccagccctcgtcacttgttttaatgctccatccaatttagcctaagtagcgggagggaagggggtggtgtattgttaagctattgaaggaatccctactatcgtattactttctccaatggtaaatgttgtagtgcgcctgtaagtgttccatatccccgggtgtcagtcaatgtaattctgtaaatgttattgatgggaaattatcttgtgttatggt

SEQ ID NO: 11722 - protein, 85 aa, Panicum virgatum
  misc_feature: Ceres CLONE 1753075-R
  misc_feature: SWISSPROT Homolog: EC 2.7.11.1 Non-specific serine/threonine protein kinase
  misc_feature: Useful for making plants with modulated biomass
  misc_feature: Useful for making plants with modulated water use efficiency
FHKRMPPEAIDLASRLLQYSPNLRCTALEACAHPFFDELREPHAKLPNGRPFPPLFNFKQELANASPELINRLIPDHARRHLGLS

SEQ ID NO: 11723 - DNA, 1748 bp, Panicum virgatum
  misc_feature: Ceres CLONE 1753110
  misc_feature: Encodes the peptide sequence at SEQ ID NO. 11724
ctctcgctctcgcctccgcgccctagggtttcgccgccttgccggggacgagatgcagccgccggtgaacgggcagcagggcccgcccccgccgcagggctctgggtccccggcaccgcctccacagcagcaccaggcgccaccagcaccgtattaccagcagcagccgcagtactaccagccggggccgcccccgcagccgtggggccagcagcagcagtatcctcctccgccgcagcagtacgctccgccgccgcagcagtacgcgcccccgccacagcagtacgccccgccgccaccccagcagtacgctcctccaccaccccagcagtacgcgcctccgccacagcagtacgcgccgcagcagcagtacggcaccgcgccaggaagcggcgagatcaggtctctttggatcggggatctccagtactggatggacgagaactaccttaactaccaagccttcgcgtccgtggcgccgcagattgccaatgtgaaaattatacggaacaaacagagtgggctgtctgaaggttatggatttattgagtttcactcccgagctgctgcagaatatactctgatgaacttcaatgggcagatgatgccgaatgttgacatggcttttaagctaaactgggcttcagctagcactggggataagcgtggagacaatggttctgatcacacaatatttgttggtgatttggctgctgatgttactgactccatgttggaagaggtgttcagagctagctacccttcagttagaggggccaaagttgttgttgacaaggtcactggacgccccaaaggatatggtttcgtgcgctttggagatctgaatgagcagacacgtgcaatgactgagatgaatggaatgatgttatctacaaggcaaatgaggattggacctgcagccaacaagaagaatatggatgcccagcagacatacacaactaatggagcataccagagctctcaaggaaatctttcagagaacgatcccaataatacaacagtgtttgtgggtgggttagattccaatgtaaatgaggagtatctaaggcaaacttttactccatacggagaaattgcctatgtgaagattcctgtaggcaagcgttgtggatttgttcaatttacaagcaggtcgtctgctgaggaagcaatccgtatgctcaatgggagcttgattggtgggcagaatgttcggctttcatgggggcgcagtcctcaaaacagacaggcgccccagcaagatgccaacagccagtataacggaaacaactactatggataccaacagcagggttatgaaggttatggctacagtgcacccaatgcacaagactcaagcgtgcaaaactattatggataccctggttatggcaactatgagcagcagcagcaacaggcagcaccccaacagcagccactgccagcacaagaggagcagcagcagcctccaccaccacagcagcaacccccgcagcagtgacgaccactgcagggatgattgctttgtgcacttccagagcgctatcagcttagaggaatgtagagttacaactgcagttcacttccaccgtgaggagtcctatagattagtggttatgcagttgcatggacgtggttgaacttgttcttagggaccagtgttatgtatgatgacactcctgatgtttcttctgaagatcttgattattgaagtacgttgtgtgtctttgagattgatgtttttgtcg

SEQ ID NO: 11724 - protein, 482 aa, Panicum virgatum
  misc_feature: Ceres CLONE 1753110
  misc_feature (214)..(286): Pfam Name: RRM_1 Pfam Description: RNA recognition motif. (a.k.a. RRM, RBD, or RNP domain)
  misc_feature (324)..(389): Pfam Name: RRM_1 Pfam Description: RNA recognition motif. (a.k.a. RRM, RBD, or RNP domain)
  misc_feature: The sequence is a functional homolog of SEQ ID NO 536 in the 10/666,642 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
MQPPVNGQQGPPPPQGSGSPAPPPQQHQAPPAPYYQQQPQYYQPGPPPQPWGQQQQYPPPPQQYAPPPQQYAPPPQQYAPPPPQQYAPPPPQQYAPPPQQYAPQQQYGTAPGSGEIRSLWIGDLQYWMDENYLNYQAFASVAPQIANVKIIRNKQSGLSEGYGFIEFHSRAAAEYTLMNFNGQMMPNVDMAFKLNWASASTGDKRGDNGSDHTIFVGDLAADVTDSMLEEVFRASYPSVRGAKVVVDKVTGRPKGYGFVRFGDLNEQTRAMTEMNGMMLSTRQMRIGPAANKKNMDAQQTYTTNGAYQSSQGNLSENDPNNTTVFVGGLDSNVNEEYLRQTFTPYGEIAYVKIPVGKRCGFVQFTSRSSAEEAIRMLNGSLIGGQNVRLSWGRSPQNRQAPQQDANSQYNGNNYYGYQQQGYEGYGYSAPNAQDSSVQNYYGYPGYGNYEQQQQQAAPQQQPLPAQEEQQQPPPPQQQPPQQ

SEQ ID NO: 11725 - DNA, 792 bp, Panicum virgatum
  misc_feature: Ceres CLONE 1753116
  misc_feature: Encodes the peptide sequence at SEQ ID NO. 11726
attttgccgcgctcgcgcgctcccgccccacacacacacaccccgaccttccacgcttctccagcctcactcttcctggtcaggtgggagcgcaggagacagggctgggaggatggcgtcggtttccagggctgtctgcggcctgcagatgccgtgcttgaacggcagggaggcgcccgccggccgccgatcggtcgcggcgccgagggcccggaacgccaaacggggcgtcatccgctccgtgtccgcctccgcctccgcctccgactccgcctccgcctccggctccgtctccggccgcggccagcattgcgcgcctgccaacgccgtcgccgacgccgcgccgattacggcgacgaagagggtgttccccttcggcaagggcaagagcgagggcaacaggggcatgaaggacctgctgggcggcaagggcgcgaacctggcggagatgtcgagcatcgggctgtcggtgccgccggggttcacggtgtcgacggaggcgtgccagcagtaccaggaggcggggcggtcgctgcccgcggggctctgggccgagatcctcgacggcctggcgtgggtggaggagtacatgggcgcgcgcctcggcgacccgcagcgcccgctcctgctctccgtccgctccggcgccgcggtgtcgatgcccggcatgatggacacggtgctcaacctggggctcaacgacgaggtggccgctggcctggccgccaagagcggcgagcgcttcgcctacgactcgtaccgccgcttcctcgacatgttcggcaacgtcgt

SEQ ID NO: 11726 - protein, 226 aa, Panicum virgatum
  misc_feature: Ceres CLONE 1753116
  misc_feature (84)..(226): Pfam Name: PPDK_N Pfam Description: Pyruvate phosphate dikinase, PEP/pyruvate binding domain
  misc_feature: SWISSPROT Homolog: EC 2.7.9.1 Pyruvate, phosphate dikinase
MASVSRAVCGLQMPCLNGREAPAGRRSVAAPRARNAKRGVIRSVSASASASDSASASGSVSGRGQHCAPANAVADAAPITATKRVFPFGKGKSEGNRGMKDLLGGKGANLAEMSSIGLSVPPGFTVSTEACQQYQEAGRSLPAGLWAEILDGLAWVEEYMGARLGDPQRPLLLSVRSGAAVSMPGMMDTVLNLGLNDEVAAGLAAKSGERFAYDSYRRFLDMFGNV

SEQ ID NO: 11727 - DNA, 2432 bp, Panicum virgatum
  misc_feature: Ceres CLONE 1753123
  misc_feature: Encodes the peptide sequence at SEQ ID NO. 11728
gtccaactgcccattctcttctcttctcagctcaactcatctcatctcagctcgttcatccattcgtgtttgctaactgccttcgcttcggattgcgattggaattggattgcatcgcatcgtcacaaaggcttattacagcgacagcagcagcaatggctagcggcgcggcgatcgacgagtggccgtcgtccccctactcctcgtcggcgcccgacggggaggtgctgcgctccctgcaccgcctggcgcgggacctctcggcggcggaggcgccggcgccgttcctgcggccggtcttcgcggcggtggccaggcgggcgcggctgctcgcagccgtctccgacgacctgctgctgttcggcggcgcggccgcggggccgctgctgctgctgccgcgctcggcgtcgctctgcctgcgggaggtcctgctcgtgctgcagcggttcaaggcgctggtggcggactgcgcggcgcgcagccgcacgcggctgctgctgcagtcggacgaggtggccgcgcgcgccggggagctgcagcacgacctcgccacgctgctcgacctgctccccgtggccgacctcgggctcgccgacgacgtggcggacctgctcgcgctcgcgtcgcgccagtgccgccgcgcggcgaccgcggagctggggctcagggcggccgtgctcgagctgatccacgaggtggagcgggagatcgtgcccgagcgggagcggctcgagggcatcctcgaggaggtgggcatcaacgacccggccagctgcagcgatgagatcgagaccctggagcgggagatcggcgaccgcgtcgccgagaggtggacgtcgtcgatgatcgcgctcgtcggcctcctccgctacgccaagtgcgtgctcttcagcgccgccacgccgtggcccgtggactccaaggtggatcccgacgacgacggcgccgagcccccgtcgccgccgctggacttccggtgccccatctccctcgagctcatgcgcgatcccgtcgtggcttccagcggccagacgtacgaccgcgagtccatcacgcggtggttcggctccggcaagtccacgtgcccaaagaccgggcaggtgctagcggatctggagcttgtgcctaacaaggcgctcaagaacttgatcgttcggtggtgccgggagaacggcgtcgccgtggaggtcgccgaggctgggaaggccgagccggcgccggtggtggccgcgaacaaggccgcgctggaggcggcgcggatgaccgcgtcctttctcgtgaagaagctgtcggcatccttctcccccgaggcgaccaagcgcgtggtgtacgagatccggcagctggccaagtccgggtccgacaaccgcgcgttcatcggggaggcaggcgccgccgcgctcctggtgccgctgctccgctccgaggactcggcgctccagctcaacgccgtgacggcgatgctcaacctctccatcctggaggccaacaagaagcgcatcatgcacgctgagggcgccgtggacgcgctgtgccacgtgatgggctccggcgcgtcgtggcgggccaaggagaacgccgcggccaccgtgctgagcctggcggccgtccacgcgtaccgccgccggctgggccggaacccgctcgtcgtcgagagagtcgtgcagcttgcgcgcacggggctctccagcaccaagaaggacgcgctcgccgcgctgctgtccctgtccggggagcgggagaacgtcgggaggctcgtggaggccggcgccgcggaggcggcggtgtcggcggtcggcgaggccgaggccgcggcggcggtgctggcgtcgctggccaagcgcggcggcgcggaggcgatcgtggcgctcgacggcgccgtggcgcggctggtggccgagatgcggcgcggcacggagtggtcgcgggagtgcgcggcggccgcgctggtgctgctgtgccggcgcgcgggcgccaaggcggcggcgcaggtgatggcggtccccggcttggagtgggccatctgggagctgctgggcaccggcaccgaccgcgcgcgcctcaaggccgcgtcgctcggcagggcgtgccggcggtgggccgccgccgccagcgcggagcagagcaccaccgagtgccccacctccgacgccgcgccggcgctcacgatggcgtcgtgaattccactacacgattcttagcagaaactccaaaaaaaaagaaagcaacaatatttttaggtaccatgattcctgtacaaaatttgttcctggccatcaaggccttcacgattctttggtccgtagtgcgggcagtgagtaactgatcaactgtaaatacaaaacgttcttgtcctctctctttttttcctgcaaacattgttacacattttctcgtcacagaaatacagagaaagaaacaaaacactttgg

SEQ ID NO: 11728 - protein, 674 aa, Panicum virgatum
  misc_feature: Ceres CLONE 1753123
  misc_feature (273)..(342): Pfam Name: U-box Pfam Description: U-box domain
  misc_feature (401)..(441): Pfam Name: Arm Pfam Description: Armadillo/beta-catenin-like repeat
MASGAAIDEWPSSPYSSSAPDGEVLRSLHRLARDLSAAEAPAPFLRPVFAAVARRARLLAAVSDDLLLFGGAAAGPLLLLPRSASLCLREVLLVLQRFKALVADCAARSRTRLLLQSDEVAARAGELQHDLATLLDLLPVADLGLADDVADLLALASRQCRRAATAELGLRAAVLELIHEVEREIVPERERLEGILEEVGINDPASCSDEIETLEREIGDRVAERWTSSMIALVGLLRYAKCVLFSAATPWPVDSKVDPDDDGAEPPSPPLDFRCPISLELMRDPVVASSGQTYDRESITRWFGSGKSTCPKTGQVLADLELVPNKALKNLIVRWCRENGVAVEVAEAGKAEPAPVVAANKAALEAARMTASFLVKKLSASFSPEATKRVVYEIRQLAKSGSDNRAFIGEAGAAALLVPLLRSEDSALQLNAVTAMLNLSILEANKKRIMHAEGAVDALCHVMGSGASWRAKENAAATVLSLAAVHAYRRRLGRNPLVVERVVQLARTGLSSTKKDALAALLSLSGERENVGRLVEAGAAEAAVSAVGEAEAAAAVLASLAKRGGAEAIVALDGAVARLVAEMRRGTEWSRECAAAALVLLCRRAGAKAAAQVMAVPGLEWAIWELLGTGTDRARLKAASLGRACRRWAAAASAEQSTTECPTSDAAPALTMAS

SEQ ID NO: 11729 - DNA, 815 bp, Panicum virgatum
  misc_feature: Ceres CLONE 1753170
  misc_feature: Encodes the peptide sequence at SEQ ID NO. 11730
ccttttcgccgccgccgccgctagctccagcgccccgtcggccgcccttctcccgctacaagcttggcgtcaccttcgcctatccaacatgggtaagacacgtggtatgggagctgggcgcaagctcaagacccacagaaggaaccagaggtgggctgacaaagcctacaagaagagccatcttggcaatgagtggaagaaaccttttgctggctcatctcacgcaaagggaatcgtccttgaaaagattggcattgaggctaagcagccaaactctgctatccgtaagtgtgcccgtgtccagcttgtgaagaatgggaagaagattgctgcctttgtgcctaacgacggttgcttgaactacatcgaggaaaatgatgaggtgctgattgctgggttcggtcgtaagggtcatgctgtgggagatattcccgatgtccgtttcaaggtcgtgaaggtctctggagtttccctgctcgccctcttcaaggagaagaaggagaagccgagatcttaaacatctgttcccccttgccttaatgaaatttgtaatgaatgtttttggttgtggcgcatctgaagggctctctcatatcggaactcatgttatgcctagatgagccttaccatcagtacgacagttcctgtatggccatagttttgttgagaagcaccagaatttgaattctaaactgcttgtcggtgtgataaacctcacatccccctccttccaccccgagcttctccctcgtttaaaccccaaccctaatcgcgacctccgttgccccaaaaccctacccgtgcggcgtccatgg

SEQ ID NO: 11730 - protein, 142 aa, Panicum virgatum
  misc_feature: Ceres CLONE 1753170
  misc_feature (8)..(141): Pfam Name: Ribosomal_S12 Pfam Description: Ribosomal protein S12
MGKTRGMGAGRKLKTHRRNQRWADKAYKKSHLGNEWKKPFAGSSHAKGIVLEKIGIEAKQPNSAIRKCARVQLVKNGKKIAAFVPNDGCLNYIEENDEVLIAGFGRKGHAVGDIPDVRFKVVKVSGVSLLALFKEKKEKPRS

SEQ ID NO: 11731 - DNA, 564 bp, Panicum virgatum
  misc_feature: Ceres CLONE 1753199-R
  misc_feature: Encodes the peptide sequence at SEQ ID NO. 11732
gaggcgccgccgccgctgcagctgcttatggagcacacaagctctctcatgggcatagcggacacggtggacacggggtctttggaggctatggccacggtgggcacggctacggcggtcacggcaagttcaagcatggtcacggccaccacggcaagttcaagcacggccacggaaaattcaagcatggcaagcatgggcacggcatgttcggcggcaagttcaagaagtggaagtgatgtgcacccaatgggttgatcatactaagcccctatgcaggcttccagaaattctgttgtcgggaatgcctttgcgatgtatttagcagggtgatcgttcatcctttctatatgttcgggtattctagcctgtgtgcgagtgacaagatggtttgctaataagtaactgaataaccttgtggattccctgcgatgctgctgtactttttgtgcatagctgttctctgaagatcatcatttctctagtggagtgatgctgatgccctgcgtttatatggtccactgaaattcttctcttgatgtgaattgatgccgattttgcgtt

SEQ ID NO: 11732 - protein, 78 aa, Panicum virgatum
  misc_feature: Ceres CLONE 1753199-R
  misc_feature: The sequence is a functional homolog of SEQ ID NO 2 in US patent 7189892
  misc_feature: Useful for making plants with altered alkaloid content
  misc_feature: Useful for making plants with altered lignin content
  misc_feature: Useful for making plants with modulated nitrogen use efficiency
GAAAAAAAYGAHKLSHGHSGHGGHGVFGGYGHGGHGYGGHGKFKHGHGHHGKFKHGHGKFKHGKHGHGMFGGKFKKWK

SEQ ID NO: 11733 - DNA, 1372 bp, Panicum virgatum
  misc_feature: Ceres CLONE 1753199
aatcacgcgtcgcccacagaaacatcgccgagatcgggtacttggtttgctgatcgccggagttctcgtcgtcgttcggtatgccgccgaatctcccagccttgaacttgtctctctacctgttcgcgattctgtagattgctttttcgttccacgatttctggggcgcatgggctgtgctttcgtcatgccctttctactcgtcaatgatcgcggtttcggcgaactggggagtggatggtgagatccgtcgatcaacggagcggggttgtggtgatccagcaaaccgtcctctgtttggtagagttggattggaggtggggatttttttgggggttgtgacttgggagcgatgatcaggatcgggaattcggggtgataagtttatttctctgaatttgggcaaccagtaacgcctagaattaaattggagatctctgtttgtttgcacaaaaataaagcctcaaattgaattcctgcttgatcatagttcgtcttatagcaaacacgatatattcggttaagtagttggccactcttgatataacagcatactgaagtaatccgtggtacaaaattggagatgcagatacttagattgtttttgtaggactggtattcgatctctgttttgttaggaattgattgtgcaaatgcagagttgcatgctgtaaggcatggttatattttaagtgcatcatatttttaccaactacgtatcattgtttccctgtggaacatgtaaaggttgatcagaagttgtgtaacgagtggggaacagaccactagtttcacttttgacatcgcgcatccaaaatgaagctaccccctttgttccctgtgttgactgttcgttgaatgcagtttgtcgatatcagatatttttactagtataccttccatcttgttcaaattatactgttcgatgttctcagtaaatcacactagctcagtgcctgacgccgcatccaaagtgaagctactcctctgttgtctctgcaccacttgctcgccacagcacattttcattaatatgttgaagatctgctcagtgcatcttcttgttttattctacaatattcagattcagttggctcacagtttacctctgcatgttctttattcaggtagcttggggtaacaatgggaggcggcaaggacaagcatgacgagggtgacaaggggctcttctcaaacataatgcatggtgctgccggtggccatgggtacccgcatcagggataccctcctcaaggctacccaccaccacctggggcgtacccgcctccccctggggcatatcctcctccaccaggggcttaccccccagcacccggggcatacccgccacagcatgggtaccctcaacccg

SEQ ID NO: 11734 - DNA, 1660 bp, Panicum virgatum
  misc_feature: Ceres CLONE 1753257
  misc_feature: Encodes the peptide sequence at SEQ ID NO. 11735
aacacttgccagagtcccatggcaaccgcatccgacagcacccactcgcctccttccgtcccccacggccacgacgaggatgacgatggcgaattcgacgacgacgacctcgatgacgaagccgacgagtacgacgacgacgagccctcggcgtccccgtccgaggaggcgcgccacgaggccgtgctccggcgtctcaccgccgatgaggtccggatccgggtgtaccaggtcacgatccggggttgcgcccgcacgcgccgcgccgcggtcgaggctgcggtgggcccggacctcgcgcgcgccgccaccgtgcgagacctcgtgcgcgccgccgccgcggccggcgaccgcctccgtcgcctcggcgccttcgatactgtctccatcacgctcgacgcggctccgtcagggatccccggcagcgccgtcgtcgtacttgttgacgtcgcagaggcccgcggccgcgctgccgctgaattaggcgtcttcgccaccacccagactcggtcatgttcacttgaaggttcactgaagttgaagaacctatttggatactgtgagacctgggatgcagcaggtgcccttgaattagataagacagcagaactaagtgctggagtggaaatgcctagaatcggagcgataccaactccgctggtggctagaatatcatttctgtccgaggactggttaaactcctcactaaaagaacacctgatgggcgtttctgttggcttgctctccaccatgaaccacaaccttgcttacaatttgacatggcgaaaattaactgatccagcacgcatgtcatccaattctgtacaagaacagttagggcatagccttttgtcctctgttaagtatgcgtacacggttgaccaaagggactcaagcataaggcctacacgtggatatgcttttctgtcgtcttctcaagtaggaggtcttgcgccagggagcaaagattcacggtttcttagacaggaatttgatcttcgagtggctttgcctctgggcgtgcttaatggttctctcaatgctggagttgcggcaggagtcatccatccattggtaaggggatccaaaggatctgtctcaccactttcagaaaggttttacttgggaggtaacaggtctcttgtatgccgcttgggtggaccatcgtcactcttaggcttcaaaacaagaggactaggagcaagggaattcagaacctgtgaccccaacaattctgaaaatagtagttccagttgtcctgagctaattggtcctggtggtgacatagcagtgacagcatttgcggacctctcctttgatatacctctgaagccacttagggatctaggaattcatggccatgcatttgtctgtgctgaaaatcttggtaaattaactgagtgtgatctacggaagtttccccttactgacttcctacaaacgttcaggagttctgcaggatttggtgtagtcctgccaaccagattgtttcgcatagagataaattactgccacatcctgaaacagtttgaccataacaagggaaagacgggcatacagtttaactttgcttcaccctaatttcattggcaatatgttcacatcaagatgaatagttgtatttttccctcactattctgatttttttaatccttttgac

SEQ ID NO: 11735 - protein, 520 aa, Panicum virgatum
  misc_feature: Ceres CLONE 1753257
  misc_feature (176)..(519): Pfam Name: Bac_surface_Ag Pfam Description: Surface antigen
MATASDSTHSPPSVPHGHDEDDDGEFDDDDLDDEADEYDDDEPSASPSEEARHEAVLRRLTADEVRIRVYQVTIRGCARTRRAAVEAAVGPDLARAATVRDLVRAAAAAGDRLRRLGAFDTVSITLDAAPSGIPGSAVVVLVDVAEARGRAAAELGVFATTQTRSCSLEGSLKLKNLFGYCETWDAAGALELDKTAELSAGVEMPRIGAIPTPLVARISFLSEDWLNSSLKEHLMGVSVGLLSTMNHNLAYNLTWRKLTDPARMSSNSVQEQLGHSLLSSVKYAYTVDQRDSSIRPTRGYAFLSSSQVGGLAPGSKDSRFLRQEFDLRVALPLGVLNGSLNAGVAAGVIHPLVRGSKGSVSPLSERFYLGGNRSLVCRLGGPSSLLGFKTRGLGAREFRTCDPNNSENSSSSCPELIGPGGDIAVTAFADLSFDIPLKPLRDLGIHGHAFVCAENLGKLTECDLRKFPLTDFLQTFRSSAGFGVVLPTRLFRIEINYCHILKQFDHNKGKTGIQFNFASP

SEQ ID NO: 11736 - DNA, 1960 bp, Panicum virgatum
  misc_feature: Ceres CLONE 1753348
  misc_feature: Encodes the peptide sequence at SEQ ID NO. 11737
atccccgaaagcacacgacgcgagaggagagagagaaaaaaaagaggcgcagaagacaggagagaggcagcgggcgaactcccagctaaatccccaaatccacgagctcccgccccgatctcgatctcgccggccgcgatgatggatccggagatgctgcggctggcgcaggagcagatgcgccgcatgtcgccggacgacctcgccaggatgcagcagcagctgatgtccaacccagacctcataaggatggcgtctgagagtatgaagaacatgaaagctgaggatttaaggcgagcggcgcagcagatgaatcaagcaaaaccagaggacatgcgtgatatgactgagaaactcgccaacactacgcccgaggagtttgctgctatgaaggctcaagcagacgcgcaaatgtcgtatgctatatctggtgccaagatgttaaagaagcagggaaatgaacttcataaccggggacagtatgcggatgctgctagcaaatacaaactggccaaggataatttaaaaaacataccatcgtctgcggcgcatactctgcagttgcaatgtacccttaatctaatggcttgttatttgaagacggggcaatttgatgaatgcgtaagcgaaggttcagaggttctaacttatgattcaagcaatgtcaaagcatattatcggaagggtcaagcgtatagagaacttggaaagttggaggccgctgtttccgacttgagtaaagcccatgaaatttcccctgaggatgaaactattgctgaggttctcagagatactgaagaaaaacttgtacgggaagggggaggagtgaacatgcgaaaaggtgttgttattgaagaagttgtagaagatgatacttcatcacagccatcaagcagtcaaagttctcctgggtatactgtttcacaaccacctgaaagccatcaagcagtcaggccatcccaaaattatgtttccaagagcgatactgaaggcctatcagagttaggagttgaaggaatgtcacctgaacttgtcaaaactgccactgatatgattggcacaatgaaaccagaagaacttcagaaaatgtttgaagttgcttcttccatgaatggcactagctccattggtcccaatatgggatccaatatgccagcagtgtctcctgatatgcttaagatggcatctgatatgattgggaagatgtctcctgatgatctacagaatatgatgaatcttgcttctcagatgggtgggcctggtggtgcccccaggagctcagagaataacttccaaccttcatcgagagccacaacaagtaattcaccccttggatcatcttctcaaactattttggagagccctgatgatctgtcaaacgatcaaaggatggggcagtcatcttctagtcttccaccttctacagctgatatgcaggaaaacatgagaaactctatgaaagaccctgcaatgcggcagatgatggcaaacatgatgaagaacatgagccctgagatgatggcgaatatgagcgagcaatttggaatgaagttatcaaaggaggatgctgcaaaagctcaacaagccatgtcctcattatcccccgaggatttggatagaatgatgagatggatggagcgagcacagagaagggtagaagtcgcgaagaagacaaagaactggcttttaggccggcgaggcttgatccttgctattgtcatgctgatcctggcattcatcctccaccagcttgggtttatcggcacatgatagcgtgaccttgcagtctgcttgtggcaaataatttgttggatagtgatggagtttctccttgctcacaactgttttgagcacccgggaaattccgaatacgataattctttgagtctgtatctgttttagaagtgtaactgtgtaactttgtttataagcaataacattcatcttatatcttcaagcg

SEQ ID NO: 11737 - protein, 543 aa, Panicum virgatum
  misc_feature: Ceres CLONE 1753348
  misc_feature (176)..(209): Pfam Name: TPR_1 Pfam Description: Tetratricopeptide repeat
  misc_feature: SWISSPROT Homolog: EC 5.2.1.8 Peptidylprolyl isomerase
MMDPEMLRLAQEQMRRMSPDDLARMQQQLMSNPDLIRMASESMKNMKAEDLRRAAQQMNQAKPEDMRDMTEKLANTTPEEFAAMKAQADAQMSYAISGAKMLKKQGNELHNRGQYADAASKYKLAKDNLKNIPSSAAHTLQLQCTLNLMACYLKTGQFDECVSEGSEVLTYDSSNVKAYYRKGQAYRELGKLEAAVSDLSKAHEISPEDETIAEVLRDTEEKLVREGGGVNMRKGVVIEEVVEDDTSSQPSSSQSSPGYTVSQPPESHQAVRPSQNYVSKSDTEGLSELGVEGMSPELVKTATDMIGTMKPEELQKMFEVASSMNGTSSIGPNMGSNMPAVSPDMLKMASDMIGKMSPDDLQNMMNLASQMGGPGGAPRSSENNFQPSSRATTSNSPLGSSSQTILESPDDLSNDQRMGQSSSSLPPSTADMQENMRNSMKDPAMRQMMANMMKNMSPEMMANMSEQFGMKLSKEDAAKAQQAMSSLSPEDLDRMMRWMERAQRRVEVAKKTKNWLLGRRGLILAIVMLILAFILHQLGFIGT

SEQ ID NO: 11738 - DNA, 1853 bp, Panicum virgatum
  misc_feature: Ceres CLONE 1753411
  misc_feature: Encodes the peptide sequence at SEQ ID NO. 11739
gtcagacgccgatcacagcaacgagaagggagctagaagagagatcaatcggatctcataccaccacgcgatggcgtcggagaaggtggagacgatcgtggccgggaactacatggagatggagagggccgccggcggtgaggccgctgacgacggtggagacgaccatcaagccggcggcacggcgtcggcgtcgaggaggggcggcggcggcaagacggcgctgtcgagcctgttctggcacggcgggtccgtgtacgacgcgtggttcagctgcgcgtccaaccaggtggcgcaggtgctgctgacgctgccctactccttctcgcagctgggcatggcgtccggggtcgtcttccagctcttctacggcctcatgggcagctggacggcctacctcatcagcgtcctctacgtcgagtaccgcaccaggaaggagcgagagaaggtcgacttcaggaaccatgtcatccagtggtttgaggttctggatggactgctggggaagcactggaggaacatgggcctcttcttcaactgcactttcctcctcttcggctccgtcatccagctcatcgcatgtgcaagcaacatctactacatcaacgacaagtatgacaagcggacttggacgtacatcttcggcgcctgctgcgccaccaccgtcttcatcccctccttccacaactaccggatctggtttttcctcggcctcctcatgaccacctacaccgcatggtacctcaccatcgccgccatcgcgcacggccaggtggaaggtgtgacgcactcggggccgaccaagatggtgctctacttcactggggccaccaacatcctctacacctttggaggccacgctgtcacagtggagatcatgcacgccatgtggaagccgcagaagttcaagctcatctacctggccgccacgctgtacgtgctgacgctgacgctgccgtcggccgccgccgtctactgggccttcggcgacgcgctcctggaccactccaacgccttctccctcctcccgcgctctggcttccgcgacgccgccgtggtcctcatgctcgtccaccagttcatcaccttcggcttcgcctgcaccccgctctacttcgtgtgggagaagctcgtcggcgtgcacgaggcccggggcgtggcgctccgcgccgccgccaggctccccgtcgtgctccccatctggttcctcgccgtcgtgttccccttcttcgggcccatcaactccaccgtggggtcgctgctcgtgagcttcaccgtgtacatcgtcccggcgctggcgcacatggcgaccttcgcgccggcggccgccagggagaacgccgtggagcggccgccgcggggggtcggcggctggccggggatgttcgccgccaactgcttcgtggtggcgtgggtgctcgtcgtcgggttcgggttcgggggatgggccagcaccgtcaacttcgtccgccaggtcgacaccttcgggctcttcgccaagtgctaccagtgcccgccaaagcactgacatgatctactctgacagatcgagagagacacatcaagattaagcagatcgagcttgttcttcgtctatttccatgtcggcacggcacacatacgacaaattattggacatgatgtcgtcttgtcagttcgcgtgctgtatgtatgtatgtgtgtgtacggtgtaccgtacctctcatgatatatatcgatcgaattagttttattatcgtcctcgatcgagttgtaaccctgtcgattaattcaggtttgtttttgtttctgtttctttgacgagagagaatgaaacagttttgtttggattttgtaaaaattcaggttttact

SEQ ID NO: 11739 - protein, 485 aa, Panicum virgatum
  misc_feature: Ceres CLONE 1753411
  misc_feature (58)..(452): Pfam Name: Aa_trans Pfam Description: Transmembrane amino acid transporter protein
MASEKVETIVAGNYMEMERAAGGEAADDGGDDHQAGGTASASRRGGGGKTALSSLFWHGGSVYDAWFSCASNQVAQVLLTLPYSFSQLGMASGVVFQLFYGLMGSWTAYLISVLYVEYRTRKEREKVDFRNHVIQWFEVLDGLLGKHWRNMGLFFNCTFLLFGSVIQLIACASNIYYINDKYDKRTWTYIFGACCATTVFIPSFHNYRIWFFLGLLMTTYTAWYLTIAAIAHGQVEGVTHSGPTKMVLYFTGATNILYTFGGHAVTVEIMHAMWKPQKFKLIYLAATLYVLTLTLPSAAAVYWAFGDALLDHSNAFSLLPRSGFRDAAVVLMLVHQFITFGFACTPLYFVWEKLVGVHEARGVALRAAARLPVVLPIWFLAVVFPFFGPINSTVGSLLVSFTVYIVPALAHMATFAPAAARENAVERPPRGVGGWPGMFAANCFVVAWVLVVGFGFGGWASTVNFVRQVDTFGLFAKCYQCPPKH

SEQ ID NO: 11740 - DNA, 1886 bp, Panicum virgatum
  misc_feature: Ceres CLONE 1753475
  misc_feature: Encodes the peptide sequence at SEQ ID NO. 11741
aaaccgcatgctggacctgggcgtgctgctaattcaggagccgagccacatgacacccgcggcaatatgaacaccaaacgctccacgcgccgacacatgatggcagggtttcagtgagcgggccgggggacgacgacggagacctgtagatcgaggagctagcagcagtagcaggctcgtctcggcggcatggcggcagcggcggcgggggcggtggccgctctcatggcggcgctgctgctcgcgctgctgtggcgcctcgcgtggcgaccgcgcgcggtggcgcgggcgttcgcgaggcagggggtccgtggcccgccctacacgttcctggccgggtccctgccggagatgaagcggctgctgatcgccggccgggtcggggtggcgcccctcaacgccacctgccacgacatcatgccagtcctgctgccgatgttccacagatgggtcgctcactatgggaaaacatttctgttctggatcggtcccattcccgccttcttctccactgatcttcatctggttaagcaagtgctcgcggacaggacgggcctgtaccagaaggacttcctgatccccgtgctcaacttcctcttcggcaacggggtcgtgttcatcaatggagacgactggaaacgccaccggaaggtggttcttccggcgttcacccatgacaagatcaagagcatgtcggcggtgacggcggaggtcacgaagcagatgatgcagcaatggcgcgagcaggcccaccagagcggcggcaagggcgcggccgagatagacatgatcgtcgccttcaacgacctgacctccaggatcaacggccgcgtcgccttcggcacgagccaccaggacgtcgaggaggtcgtcgccttcatgcgggagatgcagaagctcgccacatcggccacgctggatgctccaatactctggtatctgccgactcggcggaactggcaggtctggcgcgtgaacaaacagctgaggagcaagatcatgtcgatcatgcaggcgcggctggccgccaaaggcggcggcgactgcgggaacgacctgctcgggctgctgctggaggcgtggacgccgcagcggatggcgggtgccgagacgctgacgaccgacgaggtgatcgacgagtgcaagaccttcttcgccgcggggcaggagaccaccgccaccctcctcgtctgggccgtgttcctgctcgccgtgcacccgcagtggcaggacagggtccgggaggaggtcctccgggaattccccgacggcgacgccggagaggcccccagcgccgatgtcctcggccagctgaagctgctaaacatggttctgctggaggcgtcgcgcctgtacccgccgttcgtctacatccagcggcgggccgccatggacgccgtcctcggaggcatcaaggtaccgcgagggaccgtggtgtcgatccccatcgccatgctgcaccgggacaaggaggtctggggccccgacgccgacgagttcaaccccatgaggttcgagcacggcgccgcgaaggctgccaaggaccccaaggcgctgctgacgttctccatgggcccgagggtgtgcactggacagagcttcggcatcgttgaggcgcaggttgccatggcgatgatcctcagcaagttctccttctccctctccccgaagtacgttcacaagccaaaatatctcctgtccttgactcccaggagggggatgcctctgatcgtgaagaatttagatgggtgacaaacgttgcaaacctcgttgtagtgtgtgagaataaatgtacggctaccggccagtgtgtgataaacggtgacgttttgtctaggtataacgaaaacttttaaaatactttctactcaaattagacttatcat

SEQ ID NO: 11741 - protein, 520 aa, Panicum virgatum
  misc_feature: Ceres CLONE 1753475
  misc_feature (52)..(514): Pfam Name: p450 Pfam Description: Cytochrome P450
  misc_feature: SWISSPROT Homolog: EC 1.3.3.9 Secologanin synthase
MAAAAAGAVAALMAALLLALLWRLAWRPRAVARAFARQGVRGPPYTFLAGSLPEMKRLLIAGRVGVAPLNATCHDIMPVLLPMFHRWVAHYGKTFLFWIGPIPAFFSTDLHLVKQVLADRTGLYQKDFLIPVLNFLFGNGVVFINGDDWKRHRKVVLPAFTHDKIKSMSAVTAEVTKQMMQQWREQAHQSGGKGAAEIDMIVAFNDLTSRINGRVAFGTSHQDVEEVVAFMREMQKLATSATLDAPILWYLPTRRNWQVWRVNKQLRSKIMSIMQARLAAKGGGDCGNDLLGLLLEAWTPQRMAGAETLTTDEVIDECKTFFAAGQETTATLLVWAVFLLAVHPQWQDRVREEVLREFPDGDAGEAPSADVLGQLKLLNMVLLEASRLYPPFVYIQRRAAMDAVLGGIKVPRGTVVSIPIAMLHRDKEVWGPDADEFNPMRFEHGAAKAAKDPKALLTFSMGPRVCTGQSFGIVEAQVAMAMILSKFSFSLSPKYVHKPKYLLSLTPRRGMPLIVKNLDG

SEQ ID NO: 11742 - DNA, 147 bp, Panicum virgatum
  misc_feature: Ceres CLONE 1753529
  misc_feature: Encodes the peptide sequence at SEQ ID NO. 11743
gtcttgccacatatccccctttcgccaactggcctattagcgaagaggcccgtaccgatagcacttcccaaaagttgccccccctgaatggcgaatgggacgcgcccggtaaaggcgccttcaccccgccgggtgcggtgattgcgc

SEQ ID NO: 11743 - protein, 48 aa, Panicum virgatum
  misc_feature: Ceres CLONE 1753529
  misc_feature: SWISSPROT Homolog: EC 3.2.1.23 Beta-galactosidase
LATYPPFANWPISEEARTDSTSQKLPPLNGEWDAPGKGAFTPPGAVIA

SEQ ID NO: 11744 - DNA, 1719 bp, Panicum virgatum
  misc_feature: Ceres CLONE 1753694
  misc_feature: Encodes the peptide sequence at SEQ ID NO. 11745
gaaaactctcttcgtccttcccctccctctctccgcggcggcagctccgaacgcgcacgcctcctccgccaaagcctagcacgccgccgacctcgacggaatcctcccctcgcagtcatcctctccgtcgccctcctcctcctcctcctcctcctcctcctcgcagccgggtaggcgtggcgcgaagatccatccggacctggaatcgtcgtttttctggtcacataaacttttggataggaggataataccatctcgttctttgtagttgaggttgaagattgttctaaaaaatggagatccagacttcagggaagcccattgatttgctgatggagaaggttcttcgcatgaacattctgtcttctgaatactttaaggagctctacaggctaaaaacctatcatgaagtcattgatgagatctactcttgtgtcgaacacgtggaaccttggatgactggcaattgcagggggccctccactgcattctgtcttctctacaagttcttcaccatgaagcttactgtcaaacagatgcacggtttgttgaagcatcctgactccccatacattagagctatcggtttcttgtatcttcgttatgttgcagatccaaagactctgtggacatggtatgagccctatttgagggatgatgaggaattctcccctggatctaatggccgtgtgactaccatgggtgtttatgtccgtgaccttatactcggacagtattattttgatagtcttcttccaagaattcctcttccagtaactcgtcaggtaacagccaatcttgagaagatgaaattacccaccaagctttctggagtgactggagactccagtcgtcagggatcagaagatactgcacgtcgccctccttctgtgaaagcctctctgtcagtttcctttggacaacgggctccacaccgggcttccaccagagattcatcccctgttcggcgaaccatcacccatgatgatactcgaagctcttactcaccatatcgtcgcagtggtagtcgtgacggtcctgatcgtgatcgttctgaccgggaacttgaccgttctagccgtgaccgggaccgtttgagccgggatcaggatcgctcaagacgtgaccgtgatcgtgatcgggacatcagagattatcatcaacgtgggcgtgatagcagggaccgtgactactacaggtccaggcattcagaaaaaagacgagacgacagaagggatcgtgaaagtagcaggcacaagcgctctagctctcgtcataggagcagaagccggagtcgaagcaggggcaggagccgaagcaggagccggagccggaatgagcagcgatccagcccattcagggatggaaataaagataaggcagccaccgtctcaagcaacctagcaaagctgaaggatctgtacggtgatgttactgagaagaaggaagatggcgatactgataagctttgccgtgattcatgcgctgaggaggtcatcaggttaggaggccctagatggaggtaaattcagacctgtaatactgcggtctctacctgtcaatgtgctgcgttggttgagtctcgaaaagctacttgttcttagacttgctattgctgagtgttattttgaatctcgacttcttatcactaagagtagtcattaacggatttttcatatgctgctcccatgcatctggagatattggaacatactgtac

SEQ ID NO: 11745 - protein, 410 aa, Panicum virgatum
  misc_feature: Ceres CLONE 1753694
  misc_feature (1)..(169): Pfam Name: PRP38 Pfam Description: PRP38 family
MEIQTSGKPIDLLMEKVLRMNILSSEYFKELYRLKTYHEVIDEIYSCVEHVEPWMTGNCRGPSTAFCLLYKFFTMKLTVKQMHGLLKHPDSPYIRAIGFLYLRYVADPKTLWTWYEPYLRDDEEFSPGSNGRVTTMGVYVRDLILGQYYFDSLLPRIPLPVTRQVTANLEKMKLPTKLSGVTGDSSRQGSEDTARRPPSVKASLSVSFGQRAPHRASTRDSSPVRRTITHDDTRSSYSPYRRSGSRDGPDRDRSDRELDRSSRDRDRLSRDQDRSRRDRDRDRDIRDYHQRGRDSRDRDYYRSRHSEKRRDDRRDRESSRHKRSSSRHRSRSRSRSRGRSRSRSRSRNEQRSSPFRDGNKDKAATVSSNLAKLKDLYGDVTEKKEDGDTDKLCRDSCAEEVIRLGGPRWR

SEQ ID NO: 11746 - DNA, 709 bp, Panicum virgatum
  misc_feature: Ceres CLONE 1753758
  misc_feature: Encodes the peptide sequence at SEQ ID NO. 11747
cttccttcttccccccagtgcctttgctacctccctggttagctagctagatctctctctagttctctcttctcacatgtctaccatctacatgagccacatgtctactctccctctaatggagggagagcaggatcaggggctctttccggccttccatgtcacgaaggacccacctatcttgttcccgttcatgatcagcaaccccgtggatcagctccaagggcaaagtagctatggagatcagcgcttgagccatcaagttttggctgaatctactactcatcaacagttcactgatcgcatgatgatgatgagcggatcagacgtcttccctaggccatcaccgttccggccgaccattcaaagcatcgatggtgacatgatccaacggtccgcgtatgatccatacgatatcgagaacacgccgcgtgccgatggatcgatcagggcagcggcggcggcactgccggtgaagatgaagatcatgaggaaggcgacgagcagtgagtatcccgagggaggggcagcgagaaagccaaggagaagagcacaagcacaccaggatgagagccagcagctgcagcagcaggctatgggtgtcgtcgttagagtgtgctccgactgcaacaccaccaagacccccttgtggaggagtggtccttgtggccccaagtctctttgcaacgcatgcggcataaggcaaagg

SEQ ID NO: 11747 - protein, 196 aa, Panicum virgatum
  misc_feature: Ceres CLONE 1753758
  misc_feature (167)..(196): Pfam Name: GATA Pfam Description: GATA zinc finger
  misc_feature: The sequence is a functional homolog of SEQ ID NO 1032 in the 10/666,642 US patent application
MEGEQDQGLFPAFHVTKDPPILFPFMISNPVDQLQGQSSYGDQRLSHQVLAESTTHQQFTDRMMMMSGSDVFPRPSPFRPTIQSIDGDMIQRSAYDPYDIENTPRADGSIRAAAAALPVKMKIMRKATSSEYPEGGAARKPRRRAQAHQDESQQLQQQAMGVVVRVCSDCNTTKTPLWRSGPCGPKSLCNACGIRQ

SEQ ID NO: 11748 - DNA, 655 bp, Panicum virgatum
  misc_feature: Ceres CLONE 1753758-R
  misc_feature: Encodes the peptide sequence at SEQ ID NO. 11749
tcacggctgccaaggcggcggcgccgacgacagtcgctgctccgaccgagcaggatcaggatcacgtctccggtgacaaggttgctgctgcagcaacggcggtgagtatgcagagcaaggtcgccgccgctcctgatccgcctgccatgtcgtcgttccacgccttcgccgccgacgagatcaccgacgccgccatgctgctcatgacactgtcctgtgggctcgtccgcagctagctagcgagctatatatatagctagcttctactagcagatgagagatcactagtagacactgatgagttcgacccgatttgcaacgaactaagtactcaacccctatatatcatattgcttgcattgtgtttccttgtttgattttgtgctgaaggagaggaagaagatcaccaggagatatatagagtgatcacatggccaaggcaaaataataataagcgtaaaactctggctagccagtaattagtaccaggatttgctataagagtgagttttttaatttatttaccttttttcccagctgtggctaattattcaatccacaataagctatgcaactttgttcatttgtattagttatgttttggatcatctgagttaataataataattatatatatatatatatatatatatgc

SEQ ID NO: 11749 - protein, 77 aa, Panicum virgatum
  misc_feature: Ceres CLONE 1753758-R
  misc_feature: The sequence is a functional homolog of SEQ ID NO 1032 in the 10/666,642 US patent application
TAAKAAAPTTVAAPTEQDQDHVSGDKVAAAATAVSMQSKVAAAPDPPAMSSFHAFAADEITDAAMLLMTLSCGLVRS

SEQ ID NO: 11750 - DNA, 1943 bp, Panicum virgatum
  misc_feature: Ceres CLONE 1753770
  misc_feature: Encodes the peptide sequence at SEQ ID NO. 11751
cacttcgacagagcagcactctgatcacacacacacacacacaaacacggagttccagtacgagccagcaagaagcttaggcgcgcggcgatggagattgtcctggactggcgcgcgctggggtccctgctcgcgacgttcatggtgttccgcaccgccgtgcgggacttcctgccgccggaggcggaggcgtgcctgcgccgcctcctcgcgcgggtcgccgccgcgctccgcccgcccaggggcaccgtcctcatcgacgaggccgacggcgccagcggcggcgccaacgacctctacgacgccgcgcagctctacctcggcgcgcgctgcctcgccacggcgcccgccgtgcgcctgcacaagccgcgccagtcgccccgccccgtcgcctcgctcccggacgcgcacgccacgcacgacgtcttccgcggcgtccgcgtcaagtggacctccaccgcgcgcgccgtcgagcgcgccggccacggcccctacggaggcgcgttcggccgcggcggcggcggcgaccagcgcaccctcgagctccagttcccgcgccaacaccgggatctcatccacgaccactacatcccccacctcatcgccgaggccgccaggctgcggctcaagtcgcgggagcgccggctctacaccaaccgcgccacggggcccggcgacgaccaccaccgcctctggacctcgcacgccttcgcgcacccgtccaccttcgacacgctcgccgtcgacccggcgctccgcgaggagatccgcgccgacctcctccgcttcgccgcgcgccgggaccactacgcgcgcgtcggccgcgcctggaagcgcgggtacctgctccacggccctccgggcacgggcaagaccagcctggtcgccgcgatcgccaacctgctcgagttcgacgtctacgacctggagctcaccacggtgcccaccaactcccacctccgccgcctgctcgtctccaccacgcccaagtccgtcgtcgtcgtcgaggacatcgactgctccctcgacctctccgaccgcaacaagaagaagaatggcggcgccgacgaggagaccgcggcgcagctcgccatggtgtcgccggccgccgcggcggccatggcggcggcggggcgcgaatccataagcctctccggggtgctcaacttcgtggacgggctctggtcgtcctgcgtcggcgagcggctgatggtgttcacgaccaaccacccggagcggctggacccggcgctgctccgcccgggccgcatggaccgcaagatcgagctcggttactgcacggcccccgcgctgagggtgctcgccaagaactacctcggcgtcggcgacgatggcagcgacgaggacgccgacgccgaccccgacgcggtgagcagcctcatggccgaggcggaaggcctggtcgccgccgccggggtgcgcatcacgcccgccgacatcgccgaggtgttcatgggctgcgacggcgcgggcgccgccgccgccctgaggaagctcgtgggcgagctgcggcggaggcgcgacggtgcgaccgccgcggcagccgtggtgccgggcgaatcggcggaggacacgacggagtgaagctgtacgcggcgacgcaacgatgatgcatggctgcctcgtcagcttttcacactagtttgatcgatgcagctgagctgacgcctgatggcggacacgactggagtatgacagggcagggcactgtgtctgtgcttgttggtgttgctgtgtagatagggtgtttctttggccctctttgtttccgtttttctggacttcgcttttctgagaatcaggattctgagataagccagctgtccggagaatcggctgtctgaataaactgggtgtttggcaatcctgattattttgagccgttctctgagctgagtggtataaagtctgaaatactcttg

SEQ ID NO: 11751 - protein, 504 aa, Panicum virgatum
  misc_feature: Ceres CLONE 1753770
  misc_feature (250)..(460): Pfam Name: AAA Pfam Description: ATPase family associated with various cellular activities (AAA)
  misc_feature: SWISSPROT Homolog: EC 3.6.4.6 Vesicle-fusing ATPase
MEIVLDWRALGSLLATFMVFRTAVRDFLPPEAEACLRRLLARVAAALRPPRGTVLIDEADGASGGANDLYDAAQLYLGARCLATAPAVRLHKPRQSPRPVASLPDAHATHDVFRGVRVKWTSTARAVERAGHGPYGGAFGRGGGGDQRTLELQFPRQHRDLIHDHYIPHLIAEAARLRLKSRERRLYTNRATGPGDDHHRLWTSHAFAHPSTFDTLAVDPALREEIRADLLRFAARRDHYARVGRAWKRGYLLHGPPGTGKTSLVAAIANLLEFDVYDLELTTVPTNSHLRRLLVSTTPKSVVVVEDIDCSLDLSDRNKKKNGGADEETAAQLAMVSPAAAAAMAAAGRESISLSGVLNFVDGLWSSCVGERLMVFTTNHPERLDPALLRPGRMDRKIELGYCTAPALRVLAKNYLGVGDDGSDEDADADPDAVSSLMAEAEGLVAAAGVRITPADIAEVFMGCDGAGAAAALRKLVGELRRRRDGATAAAAVVPGESAEDTTE

SEQ ID NO: 11752 - DNA, 2235 bp, Panicum virgatum
  misc_feature: Ceres CLONE 1753814
  misc_feature: Encodes the peptide sequence at SEQ ID NO. 11753
gcctcactcgccccgcccatcccactcttttccccgtccaacgccaccgggccgcgcacccatggcgaaccccggcggcggcctgcgcccccgccacctcctcatcttcgtcgccgccgccgtgctctgcgccgtctcctcccccgccggcgccttctacctccccggcgtggcaccccgcgacttccagaaggatgatgagcttcaggtgaaagtcaacaaactgtcatctataaagacacagcttccatatgactactatttcctggactactgcaaacctgaggcgattaagaacagtgctgagaacttgggtgaagtccttcgtggggaccgcatcgaaaattctgtctataatttcaagatgaggagggatgagagttgcaagattgtttgtcgaaagaagctttctcaagaagctgtgaagaatttcaaagaaaaaatcgatgatgaataccgagttaacatgattctagataatctcccagttgtggtacctagacagacacgggaaggaagccaaacaccaagctttgagcatggttaccgagttggttataagctcaaggatgacaagtattatatcaacaaccacttgagttttaaagtcttgtaccatgaagaccaaacttctcccgatgctcgcattgttgggtttcatgtgattcccagcagcatcaagcatgaatatggtgcctgggatgatgctaatcccacagcgcaaacttgcaatgctaacattaagattacacctggtagtcacactcctcaagaggtggcccctgatgcatatgtagtattctcttacgatgttacctttgaggctagtgatatcatatgggcatctcgctgggatgtctaccttctttctagcgatagccaaatccattggttctcaattgttaattcattgatgattgtcctattcctgtctggtatggtagccatgatcatgatgagaaccctttacaaggacatagcgaactataatcagcttgacaatcaggatgaggcccaggaagaaactggttggaagttagtgcatggtgatgtattccggcctcctgtccattcaggcctcctttgtgtttacgttggcactggcgtgcagttctttgggatgacactagtgaccatgatgtttgcgctacttggattcttatcgcctgcaaaccgtggaggactcatgactgctatggtccttttgtgggtgttcatgggtgtactggcaggatacacctcatctcgcctgtacaagatgttcaaaggcactgagtggaagaagatcaccctcaaaactgccttcatgtttcctggtattatctttgcggtcttcttctttttgaatgccctcatctggggtgagaaatcatctggtgcagttcctttcggaacaatgtttgctttgttcctcctctggttcggcatctctgtgccactggtctttgttggaagtttcttgggattcaagcagccagccattgaggacccagtgaagacaaacaagattcccaggcaaattcccgagcaagcatggtacctgcagccagcttttgcaatacttgctggtggtatattgccatttggggctgtctttattgagctcttattcatcctgacatcgatctggctgaaccagttttactacatctttggcttcctcttcatagtcttcatcatcctcattgtgacctgtgctgagatcacgattgtgctatgctacttccaactatgcagcgaggattaccactggtggtggagggcatacctgactgcaggctcatcggcgctctatctgtttgcttatgctatcttctactacttcaacaagttggagatcacaaagcttgtctcaggcatcctgtactttggttacatgctgatcatctcttatgccttcttcgtgctgactggtaccattggcttctatgcctgcttctggttcgtgaggaagatctatgcttctgtgaagatcgactgatagaaccagtctctagagaaacttagagcaccttgtttccaaggtatggttgcaacatcgtgcatgctgctgctcggttgacatgtaaaggaaactgggatttgagatgggattccatggttttggtagaatatgtgtagtctattaggagtaagaactgctggaagtttaagtgagatcttgatacgtgatgatcaacatggattttgtacctttaaagatattgagtgcgtcttgttatatgccttatcgtg

SEQ ID NO: 11753 - protein, 639 aa, Panicum virgatum
  misc_feature: Ceres CLONE 1753814
  misc_feature (62)..(597): Pfam Name: EMP70 Pfam Description: Endomembrane protein 70
  misc_feature: Useful for making plants with altered cell wall content and/or composition
MANPGGGLRPRHLLIFVAAAVLCAVSSPAGAFYLPGVAPRDFQKDDELQVKVNKLSSIKTQLPYDYYFLDYCKPEAIKNSAENLGEVLRGDRIENSVYNFKMRRDESCKIVCRKKLSQEAVKNFKEKIDDEYRVNMILDNLPVVVPRQTREGSQTPSFEHGYRVGYKLKDDKYYINNHLSFKVLYHEDQTSPDARIVGFHVIPSSIKHEYGAWDDANPTAQTCNANIKITPGSHTPQEVAPDAYVVFSYDVTFEASDIIWASRWDVYLLSSDSQIHWFSIVNSLMIVLFLSGMVAMIMMRTLYKDIANYNQLDNQDEAQEETGWKLVHGDVFRPPVHSGLLCVYVGTGVQFFGMTLVTMMFALLGFLSPANRGGLMTAMVLLWVFMGVLAGYTSSRLYKMFKGTEWKKITLKTAFMFPGIIFAVFFFLNALIWGEKSSGAVPFGTMFALFLLWFGISVPLVFVGSFLGFKQPAIEDPVKTNKIPRQIPEQAWYLQPAFAILAGGILPFGAVFIELLFILTSIWLNQFYYIFGFLFIVFIILIVTCAEITIVLCYFQLCSEDYHWWWRAYLTAGSSALYLFAYAIFYYFNKLEITKLVSGILYFGYMLIISYAFFVLTGTIGFYACFWFVRKIYASVKID

SEQ ID NO: 11754 - DNA, 1733 bp, Panicum virgatum
  misc_feature: Ceres CLONE 1753820
  misc_feature: Encodes the peptide sequence at SEQ ID NO. 11755
atcgcgtcgtcgtcgaaaccatttgcccctcccaaatcgaggaaaccctagcccccaaatctctcatcataccgcagctgcagcagcagctggtactcaaccctatcctctcgtcgaggcctcggctccttcccccacccaaaaacccagaaccccctctaatccgattctttctttgcagtcgccgccgctccaatccccccttacttccccagctccgctcgctagatccatacatgatgggagaggcaaaggagaacgacgtctacgaggaggagctcctggactacgaggaggacgacgacaagacagtcgatggctccgccgccaagcccaccggagaggtcgcgaagaagggctacgtcggcatccacagttccgggttcagagacttccttctcaagccagagctgcttcgtgctatccaggactgcggttttgagcatccatccgaagtgcaacacgagtgcatccctcaagcaattcttgggatggatgtcatatgccaagcaaaatctgggatggggaagactgcagtttttgtcctttcatctctccaacagattgaccctgttgcgggtcaagtagcagcacttgtgttgtgccacacaagggaactggcctaccagatctgccatgagtttgagaggttcagcaaatatctgcctgaagttaaagttgctgtcttctacggaggagttcacatcaggaagcataaagatttgctgaagaatgagtgccctcatattgttgttggcacacctggaaggatacttgctcttgccagagagaaggatctctcactcaagaatgtgcggcatttcatccttgatgaatgtgacaagatgctcgagtcacttgatatgcggagagatgtccaggagatcttcaaaatgactcctcatgataagcaagtcatgatgttttctgcaacactcagcaaggagatacgtcctgtatgcaagaagtttatgcaagatccaatggaaatttatgtcgatgatgaggcaaaattgaccctccatgggcttgtacagcactacataaaacttagcgaggcagagaagaacaggaaactgaacgatctgttggatgctcttgatttcaaccaagttgtgatattcgtgaagagtgttagcagagctgcagaactgaataagttgctttgcgagtgcaacttcccttcaatctgcatccattctgggatgacccaggaagaaagattaacccggtacaagaacttcaaggaaggccacaagagaattctggtggctactgatttagttggcaggggcattgatattgagcgtgtgaacatcgttataaactatgacatgcctgactctgctgatacatatttgcacagggttggaagggctggtcgttttggcacaaaggggcttgcaattacctttgtttcctcggcctcggattctgatgttcttaaccaagtgcaagaaaggttcgaggtggacataaaggaactgcctgagcaaattgacacctccacatacatgccatcataagcggccaagttgctgctgccacgcattctctccgtgcttcaatggtggagaatttagcaggagaggggagtgcgcaggctcgaggttgtcactgctgtgacacttctgggactaatgcattatggaggaatttgtgttgcctcctgtactttaaacggcagtcttgatgctgatctgtaccttaagactactttccattttggtgtc

SEQ ID NO: 11755 - protein, 428 aa, Panicum virgatum
  misc_feature: Ceres CLONE 1753820
  misc_feature (71)..(240): Pfam Name: DEAD Pfam Description: DEAD/DEAH box helicase
  misc_feature (308)..(384): Pfam Name: Helicase_C Pfam Description: Helicase conserved C-terminal domain
  misc_feature: Useful for biocontainment applications
  misc_feature: Useful for making plants with modulated biomass
  misc_feature: Useful for making plants with modulated cold sensitivity
MGEAKENDVYEEELLDYEEDDDKTVDGSAAKPTGEVAKKGYVGIHSSGFRDFLLKPELLRAIQDCGFEHPSEVQHECIPQAILGMDVICQAKSGMGKTAVFVLSSLQQIDPVAGQVAALVLCHTRELAYQICHEFERFSKYLPEVKVAVFYGGVHIRKHKDLLKNECPHIVVGTPGRILALAREKDLSLKNVRHFILDECDKMLESLDMRRDVQEIFKMTPHDKQVMMFSATLSKEIRPVCKKFMQDPMEIYVDDEAKLTLHGLVQHYIKLSEAEKNRKLNDLLDALDFNQVVIFVKSVSRAAELNKLLCECNFPSICIHSGMTQEERLTRYKNFKEGHKRILVATDLVGRGIDIERVNIVINYDMPDSADTYLHRVGRAGRFGTKGLAITFVSSASDSDVLNQVQERFEVDIKELPEQIDTSTYMPS

SEQ ID NO: 11756 - DNA, 2099 bp, Panicum virgatum
  misc_feature: Ceres CLONE 1753858
  misc_feature: Encodes the peptide sequence at SEQ ID NO. 11757
actcatcagtgctcactctccagctctcatcaaacactgcaagcgagagctagctaccaaagacaaggacacaatgccacccttacccaagagacccgggcctctccttgtcctcctcgttgtcgcattcgcggccgccactgccgccgccggcgcgaccgtctccttctacccctccgcggaggccgccgcagccgcgcactgcgacggcacgctctaccctgacgtctgcctgtccacgctggccgacatcccggacctgcacaagaagcccctcccggacgtcatctgcgccgccgtgaaccgcaccgaggacgtcgtggcggccaccgcctccaactgctcctcctacctccgggagaggtccctgaccgcgcgcgaccgcctcgccctcagcgactgcctggagctcctgtccaccagcatggacgagctccaggccacggtcgcggacctggagtcccccgccgccaccggcggcggtggctcggcgtcgtcgtcgtccgcggtgggcgccaggcgcgtgacgatggaccacgtgatgacggtgctctcggcggccatcacgaaccagtacacctgcctggacgggttcgcgtaccagaacggcgggcgcgtgcggcgctacatcgagccgacgctccaccacgtctcccgcatggtgagcaactcgctcgccacggcgaagaagctgcccggcgcgacgccgtcgtcgccatcgccggcggcggtgcggcatccgttcatggggtacgggcagatggtgaaggggttcccgcggtgggtgcggcccggggaccggcggctgctgcaggcgccggcgtcgggcatcgcggcggacgcggtggtggcccaggacgggagcgggaactacacgacggtgtcggcggccgtggcggcggcgccgaccaactcgaagcggcggtacgtgatctacatcaaggccggggcgtacatggagaacgtggaggtcgggaagaagcacgtcaacctgatgttcgtcggcgacggcatcgggaagacggtcatcaaggccagccgcaacgtcgtcgacggctccaccaccttccgctccgccacagtcgctgttgtgggcaacaacttcctgggccgcgacctgacgatcgagaactcggctggcccgtccaagcaccaggcggtggcgctccgcgtgggcgccgacctctccgccttctaccgctgcagcttcgtggggtaccaggacaccctgtacgtgcactccctccgccagttcttccgcgactgcgacgtctacggcaccatcgacttcgtcttcggcaacaccgccgtcgtgctccagggctgcaacctctacgcccgccgcccgctgcccaaccagagcaacatcttcacggcgcagggccgcgaggaccccaaccagaacacgggcatctccgtccaccgctgcaaggtggcggccgccgccgacctcgccggccgggaggcctccacgcggacgtacctgggccggccctggaagcagtactcccgcacggtgttcatgcagtcggagctggactcgctcatcgacccggccgggtggctcgagtggagcggcgacttcgcgctcgacacgctctactatggcgagtacatgaacacgggcgccggcgccggcacgtccgggagggtcaagtggaaggggtaccgggtgatcaccagcgcggcggaggccagcgccttcaccgtcgggtcattcatcgacggcgacgtctggctcgccggcacgtccatccccttcaccaccggcttgtgagcgctggccggccggcgattatttatcatcattcatcagttgatcgatgcacgctgctgatgattcacatacagtgggctctggggaagatgtgtgtgtgtggcaaacaataaatgggtacggtggtggcgtgatttattgcggcattgagaggtacggtgtggaaaggcacccatagatgcatggttcggtcggtcgtgttgcgttgttgctgccgtcgttgattctttctgtcctagtgcatagcgcgcgctatcgcgcgcggacctgtaaactttgcatcattccttgtaagacaatttgtatttaattttaaactatt

SEQ ID NO: 11757 - protein, 567 aa, Panicum virgatum
  misc_feature: Ceres CLONE 1753858
  misc_feature (256)..(553): Pfam Name: Pectinesterase Pfam Description: Pectinesterase
  misc_feature (34)..(203): Pfam Name: PMEI Pfam Description: Plant invertase/pectin methylesterase inhibitor
  misc_feature: SWISSPROT Homolog: EC 3.1.1.11 Pectinesterase
  misc_feature: Useful for making plants with altered carbohydrate content
  misc_feature: Useful for making plants with modulated time to senescence
  misc_feature: Useful for making plants with altered cell wall content and/or composition
MPPLPKRPGPLLVLLVVAFAAATAAAGATVSFYPSAEAAAAAHCDGTLYPDVCLSTLADIPDLHKKPLPDVICAAVNRTEDVVAATASNCSSYLRERSLTARDRLALSDCLELLSTSMDELQATVADLESPAATGGGGSASSSSAVGARRVTMDHVMTVLSAAITNQYTCLDGFAYQNGGRVRRYIEPTLHHVSRMVSNSLATAKKLPGATPSSPSPAAVRHPFMGYGQMVKGFPRWVRPGDRRLLQAPASGIAADAVVAQDGSGNYTTVSAAVAAAPTNSKRRYVIYIKAGAYMENVEVGKKHVNLMFVGDGIGKTVIKASRNVVDGSTTFRSATVAVVGNNFLGRDLTIENSAGPSKHQAVALRVGADLSAFYRCSFVGYQDTLYVHSLRQFFRDCDVYGTIDFVFGNTAVVLQGCNLYARRPLPNQSNIFTAQGREDPNQNTGISVHRCKVAAAADLAGREASTRTYLGRPWKQYSRTVFMQSELDSLIDPAGWLEWSGDFALDTLYYGEYMNTGAGAGTSGRVKWKGYRVITSAAEASAFTVGSFIDGDVWLAGTSIPFTTGL

SEQ ID NO: 11758 - DNA, 3022 bp, Panicum virgatum
  misc_feature: Ceres CLONE 1753907
  misc_feature: Encodes the peptide sequence at SEQ ID NO. 11759
gcaacggaaccggtaagccctccattaaccctctcgctatcctctaagcaagtggtgcttagcaggcggagctctgcaaggctgcagctccgcccagatccggccccgttccccccatttgccggcgcggttcctccgtgcgtgctctgcttgctcgctgctctggtctcggccgggcaaggcgggggctgccgctgctcgggctggcaggggactggtggtaggctgaccgcgaggagggagccatggctcagatcttgctccacggcacgctccacgccaccatcttcgaggcggagtcgctctccaacccgcaccgcgcatccggcggcgcccccaagttcatccgcaagcttgtggaggggatcgaggacaccgtgggtgtcggcaaaggcaccaccaagatatatgccaccattgatctagagaaagcccgggtcgggcgtacccggatgatctccaacgagcccgtcaatcctcggtggtacgagtcgttccacatctactgcgcccacctcgccgccgatgtcatcttcaccgtcaagatcgataaccccattggggcgtccctcattgggagggcttacctgcctgtcaaggacctcctggatggtgaggagatcgataagtggcttcaaatctgtgatgacaaccgtgagcctgttggtgacagcaagatccatgtcaagcttcagtactttgatgttgccacggaccgcaactgggcgagaggtgtccggagcaccaagtatcctggtgttccttacacctttttctcacagagacagggatgtaaggttactctataccaggatgctcatgtcccagacaactttattcccaagatccctcttgctgatggcaagaactatgagccacacagatgctgggaggatatctttgatgccataagcaatgctcaacacttgatttacatcaccggctggtctgtgtacaccgagatcaccttggttagggacaccaacaggccgaaacctggaggtgatgttactcttggggagttgctcaagaggaaggccagtgaaggtgtccgggtcctcatgctagtgtgggatgataggacttcagttggcttgctgaagagagatggcttgatggccacccatgatgaggagactgcaaattactttcatggcacggatgtccactgtgttctgtgccctcgcaaccctgatgactctggcagctttgttcaggatctgcagatatcgactatgttcacacaccatcagaagatagtagtcgtcgaccatgagatgccgaaccagggctcccagcaaaggaggatagtcagcttcgttggtggtattgacctctgtgatggaagatatgatacacagtatcactccttatttaggacacttgacactgtccatcatgatgacttccaccagcctaactttgggactgcgtcaatcaagaaaggtggtccgagagagccatagcatgatattcattcacggctggaagggccaattgcttgggatgtcctttacaactttgagcagaggtggaggaagcagggtggtaaggacctccttgtacatctcagggatctttctgacattattattcccccatctcctgtgatgttcccagaggacagagaaacatggaatgtccagctcttcagatccattgatggtggtgcggcttttggcttccccgagactcctgaggaagctgctagagctgggcttgtgagtggaaaggatcaaatcatcgacaggagtatccaggatgcatacatacatgccatccggagggctaagaacttcatctacattgagaaccagtacttccttggaagttcatatggctggaagcctgagggcatcaagccggaagacattggtgctcttcacttgattccgaaggagctttcattgaagatcgtcagcaagattgaagctggggaacgatttactgtttatgttgtggtgccaatgtggcctgagggtgttccagagagtggttctgttcaggcaatccttgactggcaaaggagaacaatggagatgatgtacactgacatcacacaagctctccaggccaagggaattgttgcaaaccccaaggattacctcactttcttctgcctaggtaaccgagaggtgaagcaggagggggaatatgaacctgaggaacaaccagaatctgacactgattacagccgggctcaggaggccaggaggttcatgatctatgttcacaccaaaatgatgatagttgacgacgagtacatcatcatcggttccgccaacatcaaccagaggtccatggatggctccagggactctgagatcgccatgggtggataccagccgtaccacctggcaaccaggcagcctgcccgtggccagatccatggcttccggatggcgctgtggtacgagcacctgggcatgctggacgatgtgttccagcgcccggagagcgtggagtgcgtgcagaaggtgaacaagattgccgagaaatactgggatatgtactcgagcgatgacctggagcaggacctcccgggccacctcctcagctaccccattggcattgactctgacggcaacgtcaccgagatgccagggatggagttcttccccgacacccgtgcccgcgtctttggcaccaagtcggattacctcccacccatcctcaccacatagaggggcagactgggagtgccgtgccttctctcttgtctggcctcagcttggtgtcttgttctttgtgtttcagacaccaaaggttcagataatagtgttattatagttattgagtgataataagtgcattgtgcatggttgggacgataggatgaagagttgtttattactaatactgcatacagattgtgttgtgtccctgtccggtgtagtttgtatggcttgctgcgttgcagtgccgtttgtatgatgagactccatcaatttcacatggttggttgttcagctgttttgctgctcaatattgaatgtagttgtaatgctactatcatctgggc

SEQ ID NO: 11759 - protein, 406 aa, Panicum virgatum
  misc_feature: Ceres CLONE 1753907
  misc_feature (330)..(368): Pfam Name: PLDc Pfam Description: Phospholipase D Active site motif
  misc_feature (10)..(114): Pfam Name: C2 Pfam Description: C2 domain
  misc_feature: SWISSPROT Homolog: EC 3.1.4.4 Phospholipase D
MAQILLHGTLHATIFEAESLSNPHRASGGAPKFIRKLVEGIEDTVGVGKGTTKIYATIDLEKARVGRTRMISNEPVNPRWYESFHIYCAHLAADVIFTVKIDNPIGASLIGRAYLPVKDLLDGEEIDKWLQICDDNREPVGDSKIHVKLQYFDVATDRNWARGVRSTKYPGVPYTFFSQRQGCKVTLYQDAHVPDNFIPKIPLADGKNYEPHRCWEDIFDAISNAQHLIYITGWSVYTEITLVRDTNRPKPGGDVTLGELLKRKASEGVRVLMLVWDDRTSVGLLKRDGLMATHDEETANYFHGTDVHCVLCPRNPDDSGSFVQDLQISTMFTHHQKIVVVDHEMPNQGSQQRRIVSFVGGIDLCDGRYDTQYHSLFRTLDTVHHDDFHQPNFGTASIKKGGPREP

SEQ ID NO: 11760 - DNA, 192 bp, Panicum virgatum
  misc_feature: Ceres CLONE 1753962
  misc_feature: Encodes the peptide sequence at SEQ ID NO. 11761
ccaaaccctactcggcaccgaaggagccctccaagagaccgttccgccttcttccgcagctttgaaatggctaagtcgaagaaccacacggctcacaacccgtctcaccaagcccataagaacgggatccacaagccccgaaagcatcgccacaactccaccaaagggattggatccaaagtttctgaggaa

SEQ ID NO: 11761 - protein, 41 aa, Panicum virgatum
  misc_feature: Ceres CLONE 1753962
  misc_feature (3)..(41): Pfam Name: Ribosomal_L29e Pfam Description: Ribosomal L29e protein family
MAKSKNHTAHNPSHQAHKNGIHKPRKHRHNSTKGIGSKVSE

SEQ ID NO: 11762 - DNA, 1685 bp, Panicum virgatum
  misc_feature: Ceres CLONE 1753964
  misc_feature: Encodes the peptide sequence at SEQ ID NO. 11763
atgcaattcccaagcaaagctgcaaagtaaaaaatttcgacaagctataagccacccccatcatggagatggagccaagtgcagcaacgctcctcttcgtcttcctcctctccttgccaattcttgtgaccttgctgagccgcaaatcaactccgacctccaagaagaggcggcctccaggcccgtggaacctccccttgattggcagcctcctccacttcctcaagtcgcatccaccggtcgttctccgggacctagccaataagtatggccctgtgatgttcctcaggatgggccaaatcgatactgtcgtgatatcctcaccaccggcggcggaggaggttcttcgcgagaaggatatcaccttcgcgtcaaggccgagcaccgtggcttcagagttcttctgctaccaaaaccgcgatgttgccttctcgccatatggcgcttattggcggatgttgcgcaagctctgcacggtggagctcctcagtgcaaagatggtgcggcaagtcgcacccatcagggatggcgagacgttgtgcctcatcagaaatatccaagccgctggccgaggtggtgagccggtcaatctcgggaggcagctcttatcctgctccaactcgatcacggcacaggcggctttcggccaggtctgcagcagcgagctccaggaccagttcctaacatcaattgctgtggccttaaacttcagtgggggcttcaccatcggggatgtttttccatcgctgcgcttcattgacattgtcactgggttcagacgaaagatgtggcgagcacgcttgcagctggacgagggggacctggaattccccatcggcacaacaaacatcaaggcaattatattggatatgttcgctgctgggacagagacgacgtcgtcaactgcagagtggatcatgtcagagctcatgaggaatccagatgtaatggccaaggcacaggccgaggtgcgacgagtatttaacaacgtgagcccacaagatcatgaggccaagatggacgagctacactacattaaaatggtgatcaaggagggcatgaggctgaacccagtggtgccattgctgcttccccgtctctgtcgggagacttgcgaggtaggtgggttccaagtcataaagggcactagggtcatgatcaatgcgtgggctatggcaaggagccccgagtattggcatgacgcagagaagttcaggcccgagaggtctgaggatggcatgcttgacttcaaaggctctaggttcgagtacttgccatttggggcagggaggagaaggtgccctggtgataccttcgggctggctgctctggagctcattattgcacgccttctctactacatcgactggagcctcccagtcgggatgcagcctgacgacattgacatggaaatgatcgttggcgtaacagcaaggagaaagaaccagctgcacctagttgcatcaccatataaggtggttcccatgcaatgctgatcaacatgatagtgtcacatccaaaattctaattttgggttgtgaatatctttccgaataaatttatccatcttctagagtttttgagaatttttacatataagttagcgcccatggatagctagaggtaaaattaggccatgctaatacaataaagcatgatcacatataataaaagagctcttttac

SEQ ID NO: 11763 - protein, 477 aa, Panicum virgatum
  misc_feature: Ceres CLONE 1753964
  misc_feature (38)..(465): Pfam Name: p450 Pfam Description: Cytochrome P450
  misc_feature (251)..(471): SWISSPROT Homolog: EC 1.14.13.68 4-hydroxyphenylacetaldehyde oxime monooxygenase
  misc_feature (27)..(194): SWISSPROT Homolog: EC 1.14.99.9 Steroid 17-alpha-monooxygenase
MEMEPSAATLLFVFLLSLPILVTLLSRKSTPTSKKRRPPGPWNLPLIGSLLHFLKSHPPVVLRDLANKYGPVMFLRMGQIDTVVISSPPAAEEVLREKDITFASRPSTVASEFFCYQNRDVAFSPYGAYWRMLRKLCTVELLSAKMVRQVAPIRDGETLCLIRNIQAAGRGGEPVNLGRQLLSCSNSITAQAAFGQVCSSELQDQFLTSIAVALNFSGGFTIGDVFPSLRFIDIVTGFRRKMWRARLQLDEGDLEFPIGTTNIKAIILDMFAAGTETTSSTAEWIMSELMRNPDVMAKAQAEVRRVFNNVSPQDHEAKMDELHYIKMVIKEGMRLNPVVPLLLPRLCRETCEVGGFQVIKGTRVMINAWAMARSPEYWHDAEKFRPERSEDGMLDFKGSRFEYLPFGAGRRRCPGDTFGLAALELIIARLLYYIDWSLPVGMQPDDIDMEMIVGVTARRKNQLHLVASPYKVVPMQC

SEQ ID NO: 11764 - DNA, 1482 bp, Panicum virgatum
  misc_feature: Ceres CLONE 1754067
  misc_feature: Encodes the peptide sequence at SEQ ID NO. 11765
cccaagcggccttccgtttgctatctcctcttctcccccccccccttctcactggtcaacggccgggtggcaggcggcgcccgttgggggtgggtctagctccgtcgatcgccccggaggaacgcggcgcggtgctgcctccggcgcgcgggttttcccatggggaggaacgggagcgtgaagcgctcggggtccactggcggctcgggggccgccgccgcggggccgccgacgttcaccgtgaaccccggcgactaccggctgatggaggaggttgggtacggcgcgcacgccgtcgtgtaccgcgcgatcttcctgcccagggacgaggtcgtggcggtcaagtgcctggatctcgatcagctgaataacaacatcgatgaaatacaaagggaggctcaaataatgagcttgatcgatcatcctaatgtcatcagggcttactgctcatttgttgtggagcacagcctttgggtgataatgccattcatgacagagggttcatgtttacacttaatgaagatctcataccaggatggtttcgatgagccagtcatcggttccatcctaaaggaaactcttaaggctctggaataccttcacaggcaaggtcaaatacatcgtgatgtcaaggctggtaatatccttattgacagtgctggtatagtgaagcttggagactttggtgtttctgcttgcatgtttgatagaggtgataggcaaagatctaggaatacatttgtagggacaccatgctggatggctccagaagtgctccagcctggcactggatataatttcaaagctgatatatggtcatttggaatcactgcgcttgaacttgcgcatggccatgctccattttcgaaatacccccctatgaaggttcttctcatgactctccagaatgcaccacctggtcttgactatgaacgtgataaaaaattctcgaagtcatttaaagagatggttgccatgtgcttggtcaaagatcaaacaaagaggccaacagctgaaaagttgctaaagcattcattttttaaaaatgcaaagcctccagaattgaccatcaggagtatcttatctgatttacctcctctctgggaccgtgtaaaggctctccagcttaaagatgcagcacaattggccttgaagaaaatgccttcttctgaacaggaggccctctccctgagtgaataccaacgaggtgttagtgcatggaattttgatatcgaggatctcaaggctcaagcatcattgatttgtgatgatgagccacctgaaataagagaagatgaggacactgcaagaaacactgaagttgaaaaggatttatcttccaagaaccatttggggaagtcatttgcaaacgattgcaactccagggagcaaacttttgcaaccattgtaaattcgcatggaaacaggcctattacaaaagaagtctttgattttgatttcgattttagtgacgccaaccct

SEQ ID NO: 11765 - protein, 440 aa, Panicum virgatum
  misc_feature: Ceres CLONE 1754067
  misc_feature (33)..(294): Pfam Name: Pkinase Pfam Description: Protein kinase domain
  misc_feature: SWISSPROT Homolog: EC 2.7.11.1 Non-specific serine/threonine protein kinase
MGRNGSVKRSGSTGGSGAAAAGPPTFTVNPGDYRLMEEVGYGAHAVVYRAIFLPRDEVVAVKCLDLDQLNNNIDEIQREAQIMSLIDHPNVIRAYCSFVVEHSLWVIMPFMTEGSCLHLMKISYQDGFDEPVIGSILKETLKALEYLHRQGQIHRDVKAGNILIDSAGIVKLGDFGVSACMFDRGDRQRSRNTFVGTPCWMAPEVLQPGTGYNFKADIWSFGITALELAHGHAPFSKYPPMKVLLMTLQNAPPGLDYERDKKFSKSFKEMVAMCLVKDQTKRPTAEKLLKHSFFKNAKPPELTIRSILSDLPPLWDRVKALQLKDAAQLALKKMPSSEQEALSLSEYQRGVSAWNFDIEDLKAQASLICDDEPPEIREDEDTARNTEVEKDLSSKNHLGKSFANDCNSREQTFATIVNSHGNRPITKEVFDFDFDFSDAN

SEQ ID NO: 11766 - DNA, 1294 bp, Panicum virgatum
  misc_feature: Ceres CLONE 1754169
  misc_feature: Encodes the peptide sequence at SEQ ID NO. 11767
agccagttccacgctcgcttcgcccgtcggctcccttgcttacaagcaccggcaaggaaaaggctcggtctttccccggccgtgcccgtgctccaccacaccaatggaggctcctctcctcctccccgtttccaccgctgccgcctcttcgtcctccgtcgacatcgacgacgacgtcaccgtcgacgctgtccctgcccctcgggcggctccctcctccccttccacgcagagcatcgtgttccgcgtcgtggccgtggtcgccgtcgcgtgcgcgtccctgttcgcgcagcacgaggccgccaagggcttcggcatcgacgtcgtgagcaccggcgccgccccgcgcggcgacatcgccggacggcggttcgacctcttcctcgtgtccaacggccgcgccgagcgcatcctgcagtacgccagccgcggcgtggagcgcgcgctcttcccggacgcgtcgttcccgcgcaagcacgtccggcgcgtcaccgtcaggatggccgggcacaacctcaccgcgggcgccacggtggacgccaccgcggcgcccggcgagtacgtcatctccctgagccccgcgctcgtgtccggcaccggctccagcgcggctgccgccgacgccgtggccgcggcggtgcgccgcgccgtcgcgcgcatgtggctgtgggacggccgcggcgccgcccccgcgcgcgtgaccgaggccatggtggagtacctcgcctccgccgcggccggcgacgccgccgaggtggcggcgacgcctctgtcgtcgtcggcgtctgacgacgggggacgccggtgcatgtcggcgcggttcctggggcacctcgagcggcagcggcagggcttcgtcgcccggctgaaccgggcgatgagggaccggtggagcgacgccgccgtggacgcggcgctcggcgcgccggcccgccacgcctgcgcggcctaccgcgcggcgacgtcttcgaccggcggccaggacggacaccgccgccaccacgccggctgaccccactctacttcgtccagcgtgtcaacgtgaggcggtccgaagcaagggcagttccggtattgtacacgcccatgtgcgccgcgcccggtgtatattaaacccgccactagcggcggttaagcgcggggtggggcatggccgcggccctaatcgtggccagaggtgagtgagtggtcgctgtcacactgtagtttcatatgctcctggcctgctgcttgtaatgatcctagtatgattttgtcgtaccaatgtgatgtgagcaatagattttccgttgcc

SEQ ID NO: 11767 - protein, 302 aa, Panicum virgatum
  misc_feature: Ceres CLONE 1754169
  misc_feature (67)..(283): Pfam Name: BSP Pfam Description: Plant Basic Secretory Protein
MEAPLLLPVSTAAASSSSVDIDDDVTVDAVPAPRAAPSSPSTQSIVFRVVAVVAVACASLFAQHEAAKGFGIDVVSTGAAPRGDIAGRRFDLFLVSNGRAERILQYASRGVERALFPDASFPRKHVRRVTVRMAGHNLTAGATVDATAAPGEYVISLSPALVSGTGSSAAAADAVAAAVRRAVARMWLWDGRGAAPARVTEAMVEYLASAAAGDAAEVAATPLSSSASDDGGRRCMSARFLGHLERQRQGFVARLNRAMRDRWSDAAVDAALGAPARHACAAYRAATSSTGGQDGHRRHHAG

SEQ ID NO: 11768 - DNA, 1929 bp, Panicum virgatum
  misc_feature: Ceres CLONE 1754193
  misc_feature: Encodes the peptide sequence at SEQ ID NO. 11769
acaacaaacccaggtgtgtgcttcagcagtaaacattcggttcttggttagcctccattgccattgctctctactcgatctctagcagactcggatccatctgcaagcatggagcagctcacgtactaccttctggcgctccttctccctctcctgcttctcaagctcatcacgaggcgcgatgacggcaatggcctgaggctgccgccgggcccgtggcagctgccggtcatcggcagcctccaccacctgctcggcagcccgctgccgcaccgcgccatggcccgcatcgcgcgccgcctcggcgcgccgccgctcatctacttccggctcggggaggtccccgtggtcgtggcgtcgtccccggccgccgcccacgaggtcatgaagacgcacgacgccagcttcgccacgcgcccgtggacgcccacgactagggtccgcatggaggacggcgaggggctggtgttcgcgcgctacggcgcgctgtggcggcagctccgcaggatcagcgtcctggagctgctcagcgcccgccgcgtccactcgttccgcgccgtccgggaggaggaggcccgccgcctcgtggccgccgtcgccgccgccgcggccggcgagggcggcgccgccgtcaacgtcagcgagcggatcgccgtgctcgtcacggacacggccgtgcacgccatgatcggcgaccggttcgagaggcgggaggagttcctggcgaacctcgcggagggggtcaagatcacctccgggttcaacctctgcgacctgttcccgtcgtcgaggctcgccaggcttgtcagcggcacggaacgccgggcgcgggaaaatcaccgccggcagtccgagctcatggaccacgccatcaagcagcacgagcagcggagggaggcggccatggtacaatctgcggatggcaccgtggaaaaggaggaggacctgatcgacgtgctccttaggattcagagggaaggcggcctcgaggtgccgctcaccatgggtatgatcaaggccgtcatccttgatcttttcggtgccgggagcgagacatcagcaaccacactccaatgggccatgtcggagctcgcaagaaacccagaggtgatgcacaaggcgcaagccgaggtgcgcgagaagcttcaaggcaagccaatggtggccgaggataaccttgccgacctgaggtacacgaagctcatcatcaaggagaccctgaggctgcacccggtggtgccgctgctggtgccaagggagtgccgggagtcctgcaaggtcatggggtacgacgtccccaggggaaccaccgtgttcgtcaacgtctgggcgatcagcaaggacccctggcactggggcgccgacgccgcggcgttccggccggagcggttcgaggccggcacggtggccgacttcaagggcgccgacttcgagttcacgccgttcggggccggccggaggatgtgccctggcatggcgttcgcgcaggcgagcatggagctcgccctcgccgcgctcctctaccatttcgactgggagatgccgggtgggatgctgccgggcgagctggacatgacggaggagatgggcatcgccgtccggaggaagaatgacctttacctgcgtccggttgtccgtgtgccgccacatgtaacaccatagaactactcgtcatggtgaggtcctctgctcttgtgctggatcgaggagaggcgcttattgctaaattagcaggggtctttatgtaaaatattggatcgctattattaattgtgatccaaagtatgaatgtttttataaaataccaatctagtatttacacaaaacactgtagtttggatcatgttaatggtcgtgatccaaaccaggggttagtggaaaagtttgataaggtaatttttataaacccgcgatttggaatttccatgg

SEQ ID NO: 11769 - protein, 517 aa, Panicum virgatum
  misc_feature: Ceres CLONE 1754193
  misc_feature (33)..(506): Pfam Name: p450 Pfam Description: Cytochrome P450
  misc_feature: SWISSPROT Homolog: EC 1.14.13.68 4-hydroxyphenylacetaldehyde oxime monooxygenase
MEQLTYYLLALLLPLLLLKLITRRDDGNGLRLPPGPWQLPVIGSLHHLLGSPLPHRAMARIARRLGAPPLIYFRLGEVPVVVASSPAAAHEVMKTHDASFATRPWTPTTRVRMEDGEGLVFARYGALWRQLRRISVLELLSARRVHSFRAVREEEARRLVAAVAAAAAGEGGAAVNVSERIAVLVTDTAVHAMIGDRFERREEFLANLAEGVKITSGFNLCDLFPSSRLARLVSGTERRARENHRRQSELMDHAIKQHEQRREAAMVQSADGTVEKEEDLIDVLLRIQREGGLEVPLTMGMIKAVILDLFGAGSETSATTLQWAMSELARNPEVMHKAQAEVREKLQGKPMVAEDNLADLRYTKLIIKETLRLHPVVPLLVPRECRESCKVMGYDVPRGTTVFVNVWAISKDPWHWGADAAAFRPERFEAGTVADFKGADFEFTPFGAGRRMCPGMAFAQASMELALAALLYHFDWEMPGGMLPGELDMTEEMGIAVRRKNDLYLRPVVRVPPHVTP

SEQ ID NO: 11770 - DNA, 1676 bp, Panicum virgatum
  misc_feature: Ceres CLONE 1754197
  misc_feature: Encodes the peptide sequence at SEQ ID NO. 11771
aatcgcccggcgaatccatccggcgccgcgatggaggccgcgcccgccgtgctagacgccttcttcgccgggccgcgccaccaccagctccgtcccgccggagccgggggcggctgcagatccgcgcgcctgcaggcccagccgtgccgcgccgccgcccgcttcgccagcaactccggcggcggcggcggcaccagccccgacgccgccagcggcggcaggcagccggcgccgcgggtgaacgggcagaagccgccgcccgcgctggaggcggcgccggcgccggccccggcggagctggatctggtgcccgtctccaacctgccccggccgctgagcatcagcgacctgtccccggcgccgatgcacgggtcgcagctgcgcgtggcgtaccagggcgtcccgggcgcctacagcgaggcggcggccgccaaggcctacccgggctgcgacgccatcccctgcgaccagttcgaggtcgccttccaggccgtcgagctctggatcgccgaccgcgccgtgctccccgtcgaaaactcgctcggcggcagcatccaccgcaactacgacctcctcctccgccaccgcctccacatcgtcggcgaggtccagctccccgtccaccactgcctgctcgcgctccccggggtgcgccgggagctgctcacgcgcgtcatctcccacccgcaggcgctcgcgcagtgcgagctcacgctcaacgccatgggcctcaacgtcgcccgcgaggccttcgacgacaccgccggcgccgccgagcacatcgccgcggccgggctccgcgacaccgccgccatcgcctccgcccgcgccgccgagctctacggcctccaggtgctcgccgacggcatccaggacgacgccggcaacgtcacccgcttcgtcatgctcgcgcgggagcccatcatcccgcgcaccgacaggcccttcaagaccagcatcgtcttcacgcacgacgccgacggcacctccatcctcttcaaggtgctctccgccttcgccttccgcgacatctcgctcaccaagatcgagagccgcccgcaccgccaccgccccatccgcctcgtcgacgacgccaacgtcggcaccgccaagcacttcgagtacatgttctacatcgacttccaggcctccatggccgacgtccgcgcgcagaacgcgctcgccgagatccaggagttcacctccttcctcagggtgctcggcagctaccccatggacatgacgccatgggaagccgcgccctcctcctggtcctcccgcgtcgacaatagcagcagccagcactagcagagatcgatggtgatcatgctggtcatgaccaatcaaccaaggtagctcgctcgatccactgatcaaccaaccgatcgtgaccaatcagccacgcttctgtttaattagaaagaggaacgcgccagaacatgtttcttggttctttcattctcattcgatttggaggaggattgcattgcatttggtcgatgcttctcctcgatgctcctagcttttgaattctagtgtcgaaaatccgaagaaacggtgaaatgtaggggggctcttgttgtatgctgcgggtgtatgtaattacagtgtattctttcttcttcaaaacttcgaagaaatcaagtgaaacccatcagaaccaaattctttgcatc

SEQ ID NO: 11771 - protein, 425 aa, Panicum virgatum
  misc_feature: Ceres CLONE 1754197
  misc_feature (119)..(298): Pfam Name: PDT Pfam Description: Prephenate dehydratase
  misc_feature: SWISSPROT Homolog: EC 4.2.1.51 Prephenate dehydratase
  misc_feature: Useful for making plants with altered lignin content
MEAAPAVLDAFFAGPRHHQLRPAGAGGGCRSARLQAQPCRAAARFASNSGGGGGTSPDAASGGRQPAPRVNGQKPPPALEAAPAPAPAELDLVPVSNLPRPLSISDLSPAPMHGSQLRVAYQGVPGAYSEAAAAKAYPGCDAIPCDQFEVAFQAVELWIADRAVLPVENSLGGSIHRNYDLLLRHRLHIVGEVQLPVHHCLLALPGVRRELLTRVISHPQALAQCELTLNAMGLNVAREAFDDTAGAAEHIAAAGLRDTAAIASARAAELYGLQVLADGIQDDAGNVTRFVMLAREPIIPRTDRPFKTSIVFTHDADGTSILFKVLSAFAFRDISLTKIESRPHRHRPIRLVDDANVGTAKHFEYMFYIDFQASMADVRAQNALAEIQEFTSFLRVLGSYPMDMTPWEAAPSSWSSRVDNSSSQH

SEQ ID NO: 11772 - DNA, 917 bp, Panicum virgatum
  misc_feature: Ceres CLONE 1754329
  misc_feature: Encodes the peptide sequence at SEQ ID NO. 11773
gtcaggataagagccagttgtgcgctagctccgactccgagtgtcaggataagaaaaccgcgcggccgcacggagcgcgaccgaccgagcgggaggcacagctcctccggcgactgcaagcgccaggctatggcgtccctcgccccttccctccacctcccctgcaattcaagaactggcttccttggaaagacacaagggattcgtcctcgtgttatccctgctggcagagttgggtttgtcagaacagtagtggaatgcaaggaatctagaattggaaagaagcccatcgaagttccatcaaatgttactctcacattagaggagcagtttgtcaaagctaagggtccgctaggggagttatcactgagctatccaggtgaagtgaaagttgtgaaagaagaatctggtaagctgagactttttaagactgcggagaccaagagggcgaaccagatgcacggacttttcagaacattgacagacaacatcattgttggtgtgtccaaaggattcgataagaagcttcaattagtgggtgttggatatcgtgctgcggtggagggcaacgatctcgtgatgaaccttggtttctcacaccctgttcggatggctattcccgaaggcctgaaggtcaaggtggaagagaacaccaggatcattgtgagcggctatgacaagagcgcaatcggtcagtttgctgctaccataaagaagtggaggccacctgagccatacaagggaaagggtatccgatatgctgatgaggttgtaagaaggaaggagggcaaagctgggaagaagaaatagaaaccgtttctttcttttctgcgggtttcacacttcatttatttttccactgtaatgatcatagtgtactaaggttgaccctaagaaaattctcttcttttctgatc

SEQ ID NO: 11773 - protein, 226 aa, Panicum virgatum
  misc_feature: Ceres CLONE 1754329
  misc_feature (136)..(211): Pfam Name: Ribosomal_L6 Pfam Description: Ribosomal protein L6
  misc_feature (56)..(128): Pfam Name: Ribosomal_L6 Pfam Description: Ribosomal protein L6
MASLAPSLHLPCNSRTGFLGKTQGIRPRVIPAGRVGFVRTVVECKESRIGKKPIEVPSNVTLTLEEQFVKAKGPLGELSLSYPGEVKVVKEESGKLRLFKTAETKRANQMHGLFRTLTDNIIVGVSKGFDKKLQLVGVGYRAAVEGNDLVMNLGFSHPVRMAIPEGLKVKVEENTRIIVSGYDKSAIGQFAATIKKWRPPEPYKGKGIRYADEVVRRKEGKAGKKK

SEQ ID NO: 11774 - DNA, 825 bp, Panicum virgatum
  misc_feature: Ceres CLONE 1754726
  misc_feature: Encodes the peptide sequence at SEQ ID NO. 11775
tctccgctgccgccctcctaccaatactccacggccgacgctcgccgccggcatctcgcgtcccgacaatctgccgcagaagaatcggccccagtccccgtctcttctcctcttcctccacctcctcccccattctaccagccgcggccatggccaccgacggcgccgcccccgccgggtccaagagtaagctgctcgtcttcgattccaaggaagacctcgcggtgtctctggcgaagtacaccgcggagctttcgcagaagttcgccaccgagaggggcgccttcaccgccgtgctctccggcggatccctcatcgactcgctcagcaagctgacggagccgccgtacctggaatcggtggactggagcaagtggcacgtcttctgggtggatgagagagtcgtgcccaaggatcatgaggatagcaactacaagctcgccttcgatgggtttctctccaaggtgccgattcctcctgggcaagtttatgctataaatgatgccttgtcagctgagggagcagcggatgattacgaagcttgcttgaagcagcttgttaagaatggtgtgattgccatgtcaacagcaactgggtttcccaggtttgatctccagcttcttggaatgggacctgatggccacattgcctctctcttccctggtcaccctcttgttaatgagaaagagaggtgggttacctacattaaggattctccaaagccgccaccagagaggatcacatttacatttccggtaatcaactcatctgcatatattgcgatggtggtcactggagctgggaaagctggtccagtgcagaaag

SEQ ID NO: 11775 - protein, 274 aa, Panicum virgatum
  misc_feature: Ceres CLONE 1754726
  misc_feature: SWISSPROT Homolog: EC 3.1.1.31 6-phosphogluconolactonase
  misc_feature: Useful for biocontainment applications
  misc_feature: Useful for making plants with modulated flowering time
SAAALLPILHGRRSPPASRVPTICRRRIGPSPRLFSSSSTSSPILPAAAMATDGAAPAGSKSKLLVFDSKEDLAVSLAKYTAELSQKFATERGAFTAVLSGGSLIDSLSKLTEPPYLESVDWSKWHVFWVDERVVPKDHEDSNYKLAFDGFLSKVPIPPGQVYAINDALSAEGAADDYEACLKQLVKNGVIAMSTATGFPRFDLQLLGMGPDGHIASLFPGHPLVNEKERWVTYIKDSPKPPPERITFTFPVINSSAYIAMVVTGAGKAGPVQK

SEQ ID NO: 11776 - DNA, 820 bp, Panicum virgatum
  misc_feature: Ceres CLONE 1754727
  misc_feature: Encodes the peptide sequence at SEQ ID NO. 11777
ctgagcgatcgaggaaggagcagcaggaagggcagccatggcgaagcccatctccatcgaggtgtggaatcccagcggcaagtaccgcgtggtgagcaccaagtccatgccgggaacgcggtggatccgcctgctcaccgacaacgactgccgcctggagatatgcaccgaggccaagaccatcctctccgtcgacgacatcctggcgctcatcggcgaccgctgcgacgccgtcatcgggcagctcaccgaggactggggggaggtgctcttctcggccctcaagcgcgccggcgggacggccttcagcaacatggccgtcggctacaacaacgtcgacgtcgaggctgccaacaggaacggcatcgccgtcggcaacacgccgggcgtcctcaccgagaccacggctgagctcgctgcctccctcacgctggcagcagccaggaggatcgtggaggcggaccagttcatgagggctggcctctacgagggatggctcccgcacctgttcgttggcaacctgctcaagggtcagactgttggggtcatcggagctggtcgcatcggctccgcgtatgcacgcatgatgatcgagggcttcaagatgaacctcatctactacgacctctaccaggccacacgccttgagaagttcgtcacagcatatgggcagttcctcaaagccaacggtgagcagcctgtcacctggaagagggccgccaccatggaggatgtcctcagggaggctgatgtgataagcctgcatccagtgctggacaagaccacttaccatctcataaaccctgagaggctggccatc

SEQ ID NO: 11777 - protein, 260 aa, Panicum virgatum
  misc_feature: Ceres CLONE 1754727
  misc_feature (128)..(260): Pfam Name: 2-Hacid_dh_C Pfam Description: D-isomer specific 2-hydroxyacid dehydrogenase, NAD binding domain
  misc_feature: SWISSPROT Homolog: EC 1.1.1.29 Glycerate dehydrogenase
MAKPISIEVWNPSGKYRVVSTKSMPGTRWIRLLTDNDCRLEICTEAKTILSVDDILALIGDRCDAVIGQLTEDWGEVLFSALKRAGGTAFSNMAVGYNNVDVEAANRNGIAVGNTPGVLTETTAELAASLTLAAARRIVEADQFMRAGLYEGWLPHLFVGNLLKGQTVGVIGAGRIGSAYARMMIEGFKMNLIYYDLYQATRLEKFVTAYGQFLKANGEQPVTWKRAATMEDVLREADVISLHPVLDKTTYHLINPERLA

SEQ ID NO: 11778 - DNA, 830 bp, Panicum virgatum
  misc_feature: Ceres CLONE 1754729
  misc_feature: Encodes the peptide sequence at SEQ ID NO. 11779
accagcgcatcgcattccaatcccatttcccccttgagcaaaaaagaggcagccagagagagcatcaccatgtcgggcatcatccacaagatcgaggagaccctccacatggggggcgaccacaagaaggaggaggagcacaagaaggcggaggcgcacaagaaggccgaggagcaccacaagaaggacggggagcacaaggagggcatcgtcgagaagatcaaggacaagatcaccggcgagcacggcgacaagtccggcgagcacaaggacgacgaggagaccgaagaggagaagaaggctgctgaagagcgtgctgcagctgtcaaggcttctggcaagaagaaagaatctgggaagtcgtcagttttgcttaatgtgaagccatgggatgatgagactgacatggccaagcttgaggaagcagtaaggaatgtcaagatggaaggactgctctggggtgcatccaagcttgtcccagttgggtatggcatcaagaagcttcagatcatgttgactattgttgatgaccttgtctctgttgacactctgatcgaggaccatctgtgcgctgagccagtgaatgagtacgtccagagctgtgacattgttgccttcaacaagatctaaatctgctgagctccggctgtgtggtcagtggacagtgcaccggtccaatttatccagagttttgcatcactatgtctgccccgtgtgtcgactagttattgcctgtgaggtttttggaacctagtcaaaagtgtaccagttactgttaccagggttaatttgccttatttgaaagaccgactggctggatttttcgtttc

SEQ ID NO: 11779 - protein, 186 aa, Panicum virgatum
  misc_feature: Ceres CLONE 1754729
  misc_feature (97)..(186): Pfam Name: EF1_GNE Pfam Description: EF-1 guanine nucleotide exchange domain
  misc_feature (2)..(126): Pfam Name: Dehydrin Pfam Description: Dehydrin
MSGIIHKIEETLHMGGDHKKEEEHKKAEAHKKAEEHHKKDGEHKEGIVEKIKDKITGEHGDKSGEHKDDEETEEEKKAAEERAAAVKASGKKKESGKSSVLLNVKPWDDETDMAKLEEAVRNVKMEGLLWGASKLVPVGYGIKKLQIMLTIVDDLVSVDTLIEDHLCAEPVNEYVQSCDIVAFNKI

SEQ ID NO: 11780 - DNA, 718 bp, Panicum virgatum
  misc_feature: Ceres CLONE 1754883
  misc_feature: Encodes the peptide sequence at SEQ ID NO. 11781
  misc_feature (400)..(400): n is a, c, t, g, unknown, or other
acttctcgtctccgcgcggcggcagcgagcatatcgcgatggcctccacctacgggccgggcggcggcgccaagctgaggtgcgcggcgtcctcgtcggcggcctccccggcgcggcccgtcaaggcgccgcggttcatccagcacaagaaggaggccttctggttctaccgcttcatctccgtcgcctacgacaacgtcttccacccgggccacttcactgagaacatgcgcgacgacgcgctcgagcccgccgacctctacagcagccacctcaaggtcgtcgacgtcggcggcggcacgggcttcaccacgctcgggatcgtcttttttttcgacccggagaacgtcacgctgctcgaccagtccccgcaccagctcttttttcccccccccaaagnggcgctcaagggggtcacaaagagggggggcgacgccgaggacctgcccttccccaccgacaccttcgaccgatacgtctccgccggcagcattgagtattggcctgatccacagagaggaatcaaggaggcatacagggtcctgaagtttggtgggacagcttgtgtgattggcccggtgtacccaaccttctggctgtcccgcttcttcgccgacatgtggatgcttttcccccaggaagaagagtatatcgagtggttcaagaaggctgggtttaaggatgtcaagctgaaaagaattggaccaaagtggtaccg

SEQ ID NO: 11781 - protein, 226 aa, Panicum virgatum
  misc_feature: Ceres CLONE 1754883
  misc_feature (82)..(177): Pfam Name: Methyltransf_11 Pfam Description: Methyltransferase domain
  misc_feature: Useful for making plants with altered tocopherol content
  misc_feature: The sequence is a functional homolog of SEQ ID NO 16 in US patent 7262339
  misc_feature (121)..(121): Xaa is any aa, unknown, or other
MASTYGPGGGAKLRCAASSSAASPARPVKAPRFIQHKKEAFWFYRFISVAYDNVFHPGHFTENMRDDALEPADLYSSHLKVVDVGGGTGFTTLGIVFFFDPENVTLLDQSPHQLFFPPPKXALKGVTKRGGDAEDLPFPTDTFDRYVSAGSIEYWPDPQRGIKEAYRVLKFGGTACVIGPVYPTFWLSRFFADMWMLFPQEEEYIEWFKKAGFKDVKLKRIGPKWY

SEQ ID NO: 11782 - DNA, 1823 bp, Panicum virgatum
  misc_feature: Ceres CLONE 1754920
  misc_feature: Encodes the peptide sequence at SEQ ID NO. 11783
aaccccaaaagcccgcagccaaattccccagcccacacaactcctccactctccaggttagggtttcgggatgtcggaccggcagccgtcggaggagccggaggagcaggtggacctggagggcgacgacgacggcatggacgacgacgacgggtaccgccgccgcggaagccgggacgactcggaggagcccgaggatgaggactacaatgaggagcgccagcccgagggcgacgacggggacgccaggatggcggcggaaccggctgctggagggggcaccggcggcgacgacatggacaaggagggcgccggcgacggccccgaggacgacgaggagaagaggaagtgggacgagctgctcgcgctgccgccccacggctccgaggtcttcatcggcggcctgccccgcgacatcaccgaggaggacctccgcgagctgtgcgagccgttggaggaaatctatgaggtgaggttgaccaaggatagggagacaaaggagaacaaggggttcgcctttgtcaccttcacagacaaggacgccgcgctgcgtgcgatcgaggatgtgcaagaaagggagtacaaggggaggactttgcggtgctcattgtcgcaggcaaagcacaggctatttgttgggaatgtgcccaaggggctgagtgaggacgagctgaggaacattatcaaagggaaggggccaggtgttgtcaacattgagatgtttaaggatcagcatgacccgaaccgtaaccgtggcttcctctttgttgagtattataaccacgcctgcgctgaatatgccaagcagaaactttcatcaccaaacttcaaggttgatggaagccaattgactgtcagctgggcagaacctaagggttcaacagatgcttcatctgcggctgctcaggtgaagactatatatgtgaagaacctacctgagaatgtttcgaaagagaagattaaggaactgtttgataagcatggagaggtcacaaaaatcgttctgccacctgccaaggctgggcataagagggattttggatttgttcattttgctgaaagatcaagtgcactcaaggcggttagaggaagtgaaaaatatgaaattgatggtcaagtactggaagtatccatggccaaacctttggcagataagaaacctgatcattcacacaggcctggaggagggcctagttatcctcttcctccttatggtggcggctacatgggagatccatatggtgcatatggtggtggtggtcctgcatacaaccagccaatgatatatggtagagggccagcaccggcgggaatgaggatggtaccaatggtgcttcccgacggccgtcttggctatgtcctgcaacagcctggtggaatgccgcctccacccccacctcggaggggtggtgaccgtagggatggtggaagaggcggtgaagggagccacagccggcgatatcgcccttactagcttttcccttgggtgctcgacttcatcgcagtgtgtgatggatttgttaacccgtgagataggagcctgcgttcttgttccagtataaggcctgcaatggcatggggcttgtaccatcatctgtttttttggttaacttatttctgtgatgcaatggatgtgactcgtaagctttgctttagctttgtatcactttctgccttcgggcacctgtagcggtgaactgagtatctatggactcccgtttggagttttcttggcttagaatgcatgttttcctgtcttgataaacctgtcgggataaactgatagagcaagcatctgtattctgtggggatactgttggagc

SEQ ID NO: 11783 - protein, 467 aa, Panicum virgatum
  misc_feature: Ceres CLONE 1754920
  misc_feature (107)..(178): Pfam Name: RRM_1 Pfam Description: RNA recognition motif. (a.k.a. RRM, RBD, or RNP domain)
  misc_feature (283)..(353): Pfam Name: RRM_1 Pfam Description: RNA recognition motif. (a.k.a. RRM, RBD, or RNP domain)
  misc_feature (187)..(262): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSDRQPSEEPEEQVDLEGDDDGMDDDDGYRRRGSRDDSEEPEDEDYNEERQPEGDDGDARMAAEPAAGGGTGGDDMDKEGAGDGPEDDEEKRKWDELLALPPHGSEVFIGGLPRDITEEDLRELCEPLEEIYEVRLTKDRETKENKGFAFVTFTDKDAALRAIEDVQEREYKGRTLRCSLSQAKHRLFVGNVPKGLSEDELRNIIKGKGPGVVNIEMFKDQHDPNRNRGFLFVEYYNHACAEYAKQKLSSPNFKVDGSQLTVSWAEPKGSTDASSAAAQVKTIYVKNLPENVSKEKIKELFDKHGEVTKIVLPPAKAGHKRDFGFVHFAERSSALKAVRGSEKYEIDGQVLEVSMAKPLADKKPDHSHRPGGGPSYPLPPYGGGYMGDPYGAYGGGGPAYNQPMIYGRGPAPAGMRMVPMVLPDGRLGYVLQQPGGMPPPPPPRRGGDRRDGGRGGEGSHSRRYRPY

SEQ ID NO: 11784 - DNA, 744 bp, Panicum virgatum
  misc_feature: Ceres CLONE 1754927
  misc_feature: Encodes the peptide sequence at SEQ ID NO. 11785
accatcgattctctcccccttttctctgagtcacagctgaggagaaaaaagaaaaagatttcaggaaaaaagggggagaagacaagaggctgcctcccctgcttccaggtccaggctctgtcttgctcccctttctcccacccatggctccgaggtgggccccgcccgccggcctcgtgcttctgatgctgctcctaacgccggcgacggtgcgcggggacaagccactgaggggcgggccgtccggcgcgggcgcggagctggaggcgtcctccgccgtcttcccgctctacggcgacgtctacccgcacggcttgtactacgtggccatgaacatcggcaacccgccgaggccatacttcctggacgtcgacaccggcagcgacctcacctggctgcagtgcgacgcgccctgcatcagctgcaacaaggtgccacacccactctaccgaccaacaaagagcaagctggtgccatgtgtggatcagctgtgtgcatctctccatggtggactaactggcaggcacaagtgtgactcaccgcatcagcaatgtgactatgagattcggtatgctgatcaggggtcatccattggtgtgctcgtcaatgacagctttgctgtgcgccttgcaaacacctccgttgtacaccccagtctagcattcgggtgtggatatgaccaacatgttggcagtagcagtgatgtggcacccactgacggagttcttgggcttggaagtggat

SEQ ID NO: 11785 - protein, 200 aa, Panicum virgatum
  misc_feature: Ceres CLONE 1754927
  misc_feature: SWISSPROT Homolog: EC 3.4.23.12 Nepenthesin
MAPRWAPPAGLVLLMLLLTPATVRGDKPLRGGPSGAGAELEASSAVFPLYGDVYPHGLYYVAMNIGNPPRPYFLDVDTGSDLTWLQCDAPCISCNKVPHPLYRPTKSKLVPCVDQLCASLHGGLTGRHKCDSPHQQCDYEIRYADQGSSIGVLVNDSFAVRLANTSVVHPSLAFGCGYDQHVGSSSDVAPTDGVLGLGSG

SEQ ID NO: 11786 - DNA, 705 bp, Panicum virgatum
  misc_feature: Ceres CLONE 1754960
  misc_feature: Encodes the peptide sequence at SEQ ID NO. 11787
tggagagctaacgagacagctacccctttcaccctcagtcagagacatacaagagaaagagagcttcagagatggcctccagctccaagcagcagctgccccctcctgctctcctcttggtggcatcagctctgctcatcctcgtctgcgctacaagggtccaggcagcaaggccggtaccaggatccaaggaccacatgccacagttcggtgtctccgcgactgtggctggcgacgagaagagtggttcggtgcccgggatggaaatgcatcgagcagagcctgaggcgacggaggagtgcgagggcgaggaaggggaggattttttcatgaggaggacactggtcgctcacaccgactacatctacacccattttttttttccctagtcgctagtgtgcaggctcacgccgaacagtgaggttcagaagaaaagaatttcgcatggtccacgagctagcttatctgaagctctgcagttctgtcagctgtggatcatgtgttttcatatacgtgccctagacccctagtagcccgtgcgatttccatcagcttctcgagcacatgtacggcctggaattgtatccatcatcttggcttgagatgctaaatggaaatcctaggctattatactgtactcactgtaaatactgaatcaccaagtggagtcctgtgcttcagttgcaagaaactctgcttgtttcc

SEQ ID NO: 11787 - protein, 105 aa, Panicum virgatum
  misc_feature: Ceres CLONE 1754960
  misc_feature (22)..(105): Pfam Name: PSK Pfam Description: Phytosulfokine precursor protein (PSK)
MASSSKQQLPPPALLLVASALLILVCATRVQAARPVPGSKDHMPQFGVSATVAGDEKSGSVPGMEMHRAEPEATEECEGEEGEDFFMRRTLVAHTDYIYTHFFFP

SEQ ID NO: 11788 - DNA, 1415 bp, Panicum virgatum
  misc_feature: Ceres CLONE 1754965
  misc_feature: Encodes the peptide sequence at SEQ ID NO. 11789
gaacagctcaagaaaagtagcagcagcagcccgcggcggcgacgagtaaccaaccggaccacgccattgccagtcgcccggccgcctacgagccctgcctcgagcccttgcccggccccggccaccgcgccttcctctccctcccgctgcgggttctctcgcgcagcccgaattcgcggggtggtttctgttctttgaccgcttctgagttctttctcggcgccgcgccatggaggagatggggaagagggtggtgaggaccgtgcgggtgcggaacatctcagatctggcgacggagcgggaggtgcgcgagttcttctccttttccggtgaaatcaagcacgtcgacatcagatttgacggaacggggaggacggcctacgtgacattcaaagatcccaaagccctcgagattgcccttctcctatcgggagcaacaattgtggatcaagttgtgaacataaccccagctgaagattacatctacatccctgttactgaacagcaacttttggtcaatgaggtgacaagtacaagttcagcacctaatgcagaattggagtactctccagaggccaatgccagccccaatagtcatatctatgtgagcaaggcccatgatgtcatgacaaatgtgattgcaaggggttcagcaatgagacaagatgctgtgaacaaggctaaagcatttgatgagaaacatcaattaagagctaatgcatcagcaaggatcaattcctttgataagcgtgttggcctttcgcagaagataaacaatgggatatcagttgtcaatgaaaaggtgaaatcggtagaccaaaggctacatgtttctgacaaaacaatggctgctttgctggctgcagagcgcaagcttaatgatacaggctctgctgtgaaaaccaacaggtatgtgtctgctggaacgagctggctgaatggtgcttttagcaaggtcgccaaggctggtcatgttgctggctcaagaactagagagaagttccaattagcggtgtcaaatctaacagccaaaggccctgccgttgttgcttgagcttgctgtgctggttatggaagctcttcttcccgaggaaaatatattggaagtccttgagcaagcatctccctttgattgcgtggacagcgtggaaagtaactgtatttcacttttgtcttgtccttttttccttgggtgcaggctattgaggaaatcttctgaggtttggtatatagaggagctcaaattttggtatttttagaaccctccattcttttagtgttgatgttaaattgattataggtgatagtgatattgtattgactcagtgtggattcagattgtcatcgattcctattcttacgtgattctcccaaaactgttgctccaactgagaagtttaaactcaacttctggc

SEQ ID NO: 11789 - protein, 274 aa, Panicum virgatum
  misc_feature: Ceres CLONE 1754965
  misc_feature (12)..(78): Pfam Name: RRM_1 Pfam Description: RNA recognition motif. (a.k.a. RRM, RBD, or RNP domain)
  misc_feature: Useful for making plants with modulated biomass
MEEMGKRVVRTVRVRNISDLATEREVREFFSFSGEIKHVDIRFDGTGRTAYVTFKDPKALEIALLLSGATIVDQVVNITPAEDYIYIPVTEQQLLVNEVTSTSSAPNAELEYSPEANASPNSHIYVSKAHDVMTNVIARGSAMRQDAVNKAKAFDEKHQLRANASARINSFDKRVGLSQKINNGISVVNEKVKSVDQRLHVSDKTMAALLAAERKLNDTGSAVKTNRYVSAGTSWLNGAFSKVAKAGHVAGSRTREKFQLAVSNLTAKGPAVVA

SEQ ID NO: 11790 - DNA, 823 bp, Panicum virgatum
  misc_feature: Ceres CLONE 1755032
  misc_feature: Encodes the peptide sequence at SEQ ID NO. 11791
atttgccgcgctcccgccccacacacacacacaccccgaccttccacgcttctccagcctcactcttcctggtcaggtgggagcgcaggagacagggctgggaggatggcgtcggtttccagggctgtctgcggcctgcagatgccgtgcttgaacggcagggaggcgcccgccggccgccaatcggtcgcggcgccgagggcccggaacgccaaacggggcgtcatccgctccgtgtccgcctccgcctccggctccggctccggctccgtctccggccgcggccagcattgcgcgcctgccaacgccgtcgccgacgccgcgccgattacggcgacgaagagggtgttccccttcggcaagggcaagagcgagggcaacaggggcatgaaggacctgctgggcggcaagggcgcgaacctggcggagatgtcgagcatcgggctgtcggtgccgccggggttcacggtgtcgacggaggcgtgccagcagtaccaggaggcggggcggtcgctgcccgcggggctctgggccgagatcctcgacggcctggcgtgggtggaggagtacatgggcgcgcgcctcggcgacccgcagcgcccgctcctgctctccgtccgctccggcgccgcggtgtcgatgcccggcatgatggacacggtgctcaacctggggctcaacgacgaggtggccgccggcctggccgccaagagcggcgagcgcttcgcctacgactcgtaccgccgcttcctcgacatgttcggcaacgtcgtcatggacattccccatgcactgttcgaggagaagcttgagcacatgaagg

SEQ ID NO: 11791 - protein, 239 aa, Panicum virgatum
  misc_feature: Ceres CLONE 1755032
  misc_feature (80)..(234): Pfam Name: PPDK_N Pfam Description: Pyruvate phosphate dikinase, PEP/pyruvate binding domain
  misc_feature: SWISSPROT Homolog: EC 2.7.9.1 Pyruvate, phosphate dikinase
MASVSRAVCGLQMPCLNGREAPAGRQSVAAPRARNAKRGVIRSVSASASGSGSGSVSGRGQHCAPANAVADAAPITATKRVFPFGKGKSEGNRGMKDLLGGKGANLAEMSSIGLSVPPGFTVSTEACQQYQEAGRSLPAGLWAEILDGLAWVEEYMGARLGDPQRPLLLSVRSGAAVSMPGMMDTVLNLGLNDEVAAGLAAKSGERFAYDSYRRFLDMFGNVVMDIPHALFEEKLEHMK

SEQ ID NO: 11792 - DNA, 1082 bp, Panicum virgatum
  misc_feature: Ceres CLONE 1755505
  misc_feature: Encodes the peptide sequence at SEQ ID NO. 11793
accacactgatcgttgcgtggcaagccagtcacgactcgcaaggagtagccatgcagggggccatgcggagactcgtgcgcgtcctcgtggcgctcggcgtggtcgccgcggcggcggcgcagcaggccccgacggcggcgccggccacgccgacgcccacgccggcgacccccgcggcgccggcgccggcggccgcgtcgagcaacatcacgggcgtgctggccaagggcgggcagttcaacaccttcatccggctgctcaagtccacgggcgtggcgtcgcagatcgacaaccaggtctccaacggcggcaacgggatcacggtgttcgcgcccacggacaacgccttcacgtcgctgccctccggcacgctcaactcgctctccgaccaggacaagaacgcgctcgtccagtaccacgtcgtctccaccgccatcccccagtcgcagttcgacaccgtcagcaacccgctccggacgcaggccggcagcagctcgccgggggagtacccgctcaacgtcaccgccgtgggcggccagcaggtgaacatctccacgggggtcgtcaacgccaccgtcgacaacaccctctacaccggcgacagcctcgtcgtctaccaggtcaacaaggtgctgctgccggcgaagctcttcggcacggctgaggcccccgcgcccgcgccgctcgcgccggccaagaagaagggcaagacgccggcgtccgtcgcggactcgcccgaggccgaggcgtccccggacgccaccacgtcgctcgccgcggcgagggtgacgggaggtggcctcgcggcggctcttgcgctggccgccgtgtggtgggggctgtagtgacggcgatgagagtgtgagagatccccgtgacgtcatccgtgccatctttttgtatactttctttttttcccgcaggtcttgttggtcttttctttttcccttttggccatttttggatgaattattattccttgccattgcagttgctaggagtattattgtcatgtaatgtaatgttgtcgtccgatttttatgtaattctgctaaataatatgagctgtgtatattgcagt

SEQ ID NO: 11793 - protein, 264 aa, Panicum virgatum
  misc_feature: Ceres CLONE 1755505
  misc_feature (62)..(197): Pfam Name: Fasciclin Pfam Description: Fasciclin domain
  misc_feature: Useful for making plants with altered carbohydrate content
  misc_feature: Useful for making plants with altered cell wall content and/or composition
MQGAMRRLVRVLVALGVVAAAAAQQAPTAAPATPTPTPATPAAPAPAAASSNITGVLAKGGQFNTFIRLLKSTGVASQIDNQVSNGGNGITVFAPTDNAFTSLPSGTLNSLSDQDKNALVQYHVVSTAIPQSQFDTVSNPLRTQAGSSSPGEYPLNVTAVGGQQVNISTGVVNATVDNTLYTGDSLVVYQVNKVLLPAKLFGTAEAPAPAPLAPAKKKGKTPASVADSPEAEASPDATTSLAAARVTGGGLAAALALAAVWWGL

SEQ ID NO: 11794 - DNA, 1016 bp, Panicum virgatum
  misc_feature: Ceres CLONE 1755518
  misc_feature: Encodes the peptide sequence at SEQ ID NO. 11795
acacacacacggcgtctttgtgtgagcacaccgcgcggcgagcgaagaaagggggaagaagcagccaacgagctttttgcttttgggtttctcatccgagcagcggcggcagcgtcggcgaagagagaagagcgggggcggcatggctgagcacaaggaggagtcggtgatggataagatctccgacaagttccacggcggggactcctcgtcgtccgactcggacgacgagaagaagaaggggtcctcgtcggcggcggcgtcggcggaggccgtgaaggccaagatctaccgcctcttcggccgcgagagacccgtccactccgtcctcggtggcggcaagcctgctgatcttgtcctatggaggaacaagaagatctctggcggtgtccttgctggtgccactaccatctggctcctgttcgaggtcatggagtaccatctcctcaccttggtgtgccactgcctcatcctctcgctggccatccttttcctgtggtccaatgcctccactttcatcaacaagtctccaccaaacattcctgaggtgaaaatcccagaggatgcggccgttaacgttgctctcacactgagatatgagatcaacaggggcttcgctaccttgagggagattggacatggccgtgatcttaagaaattcctaattgttatagcaagtctctggcttctttcagttcttgggagctgctgcaatttcctgacattatcttacattgtcttcatggtgctgtacactgtcccagtagtgtatgagaagtatgaggacaagattgatgcttttggtgagaaggctatgattgaacttaagaagtactatgccatcttcgacgagaaatgcctatcgaagattcctaagggtcctctgaaagataagaagcactagatttgtagtaaggctcttgctatgaatatgataaatgactaccaatcaccttctgttatggaaggatggcttttggtccaagtcagttgatagtatatatatctgtatgggc

SEQ ID NO: 11795 - protein, 253 aa, Panicum virgatum
  misc_feature: Ceres CLONE 1755518
  misc_feature (68)..(251): Pfam Name: Reticulon Pfam Description: Reticulon
MAEHKEESVMDKISDKFHGGDSSSSDSDDEKKKGSSSAAASAEAVKAKIYRLFGRERPVHSVLGGGKPADLVLWRNKKISGGVLAGATTIWLLFEVMEYHLLTLVCHCLILSLAILFLWSNASTFINKSPPNIPEVKIPEDAAVNVALTLRYEINRGFATLREIGHGRDLKKFLIVIASLWLLSVLGSCCNFLTLSYIVFMVLYTVPVVYEKYEDKIDAFGEKAMIELKKYYAIFDEKCLSKIPKGPLKDKKH

SEQ ID NO: 11796 - DNA, 1394 bp, Panicum virgatum
  misc_feature: Ceres CLONE 1755561
  misc_feature: Encodes the peptide sequence at SEQ ID NO. 11797
acgcacgggcgcgcgcgtgcgggagctgcggccaggaccagcagaagagcatggagctgaggcagccctgccgccgccttcaccgcgccctctaggcatccggccggccggccaacccagcctcgtcggctcccgccatggcagccaccgtcctcgtcccgccggcgcactgccatcaccgcgcaacggcggcgacgacgagccggagaggagggggaggaggcgccatctcgcattgcgccctctctcacgcgcgccggcgccggggatcgcgcgccgtgagggcggccgcgcctcccgagcagagcagcgtgtccctcgcgggagcctccgggcacgggagcgcgggcgatgccaaggccgcgctgcgccgagctctggaaggcgtggacagagggatattcgggatgacgtccgcccagcggtcggaggtccaccgcctggtggagctgctcgaggcccggaatcccacgccggagcccaccgccgagctgcgggagaaggtgaacgggtgctggaagctcatctacagcaccatctccatcctggggaagaagaggaccaagctggggctcagggatttcatcagcctaggggacttcctccagataattgacgtcaaagaggaaaaggcggtaaatgtgataaaattcagcgcgagagcactgaagatattgtcggggaagctcactgtcgaagcttcgtacagtgtcactagtaaaacgagagtggatatcaaacttgagagttccactatcaccccagaacagctaatgaatatatttcagaagaactacgacatgctcctggccatattcaacccagagggttggctagagataacatatgtcgacgaaaccttgcggatcggaagagacgacaaggaaaacatctttgttctagagagagctgatccatcagaggtttaatataacaaaccagcgacgcttattcgtaactttctgacaaggagcatggcacttcctagaagattactgcctgcacatcctacggcggcacacacacacacacacacacatggttattaccagctcagtgcagaagtcagaggctgcacaacgttcttgccgaattttgatgagaatagaacagcatatccatccgttctctgagaaagagttgtgcaagctgggcatcttctatgttcctctacatagagacttgcgaaatggtcagccttacaggaggcagacagtacagctgctggataaattgtttcctcttctttgtcaatcctatactcctacatcctagttcaagtattcttccttgtaacatcgcagaaaaaacaatagaaccattcttccttgcaacacacacaatgtaatgagtgtacagctcgaaaacacacattaatcaagtacgtttttggt

SEQ ID NO: 11797 - protein, 263 aa, Panicum virgatum
  misc_feature: Ceres CLONE 1755561
  misc_feature (71)..(256): Pfam Name: PAP_fibrillin Pfam Description: PAP_fibrillin
MAATVLVPPAHCHHRATAATTSRRGGGGGAISHCALSHARRRRGSRAVRAAAPPEQSSVSLAGASGHGSAGDAKAALRRALEGVDRGIFGMTSAQRSEVHRLVELLEARNPTPEPTAELREKVNGCWKLIYSTISILGKKRTKLGLRDFISLGDFLQIIDVKEEKAVNVIKFSARALKILSGKLTVEASYSVTSKTRVDIKLESSTITPEQLMNIFQKNYDMLLAIFNPEGWLEITYVDETLRIGRDDKENIFVLERADPSEV

SEQ ID NO: 11798 - DNA, 1071 bp, Panicum virgatum
  misc_feature: Ceres CLONE 1755564
  misc_feature: Encodes the peptide sequence at SEQ ID NO. 11799
aaccaacaatccagcaacaccgccgccgccggtgaccggcgccggcgatcccgatgggcgcgtcggcctccgtcctctcgctcccaacggccgccgcgctccccgcagccgccaccgccgtcgccggggccgcaggctgcttcgcgctgggctacctcctcgccctcacccgccacgccgcggccgtcagccccgagggcggctccgatgacgattccgaggacgactcggaagaagatgatgacgaaaactccggccgcagccgtgctgcgaagcgagcgggcggtcagaagaggaccggtctccggctgctcttctgggcgcggaacgtggtgactaagtccgactccgccagggaggcgaagagagcccaggctcaggctgccgccagccccctggagatcgagaatctcgccaatattatagaagatttcaagatggtgctggtcgtcaggaatgatttgaagatggggaaggggaaaatcgctgcacaatgcagccatgcaactcttggcctgttcaaaaaactccaacagagagcaccaaaatcactaagaaggtgggaacggtgtgggcaagttaaagtagttgtgaaaatagagagcgaggaagatatgcttgttttacaagggagagcaaagtctttgaatctgccaactcacataaccatagatgctggaagaacacagattgctccaaattcaagaacagtcatggccattcttgggccagcagatatggtcgatgatgtcactggtggtctgaagctattgtaaactcaccttatcggcattctcaagcactcaacatggatgttaggtgtgcatgaatttacaatccacattggactcgcacttcactaatctgctgcggaagaacgaatctcgacctcagtgattgactaaaccttgttgtctgtggatttattcaaaaggaggttgcttctttttttacttgtatcatcaagtgttgtctttggagctctgatttctattctgttttggtgtcgagaacatatagaccattgtttcttctgtaacatagagataaaaaaaaggttcggcttgtctc

SEQ ID NO: 11799 - protein, 240 aa, Panicum virgatum
  misc_feature: Ceres CLONE 1755564
  misc_feature (136)..(228): Pfam Name: PTH2 Pfam Description: Peptidyl-tRNA hydrolase PTH2
  misc_feature: SWISSPROT Homolog: EC 3.1.1.29 Aminoacyl-tRNA hydrolase
MGASASVLSLPTAAALPAAATAVAGAAGCFALGYLLALTRHAAAVSPEGGSDDDSEDDSEEDDDENSGRSRAAKRAGGQKRTGLRLLFWARNVVTKSDSAREAKRAQAQAAASPLEIENLANIIEDFKMVLVVRNDLKMGKGKIAAQCSHATLGLFKKLQQRAPKSLRRWERCGQVKVVVKIESEEDMLVLQGRAKSLNLPTHITIDAGRTQIAPNSRTVMAILGPADMVDDVTGGLKLL

SEQ ID NO: 11800 - DNA, 692 bp, Panicum virgatum
  misc_feature: Ceres CLONE 1755578
  misc_feature: Encodes the peptide sequence at SEQ ID NO. 11801
ctgccgctgggccatgctcgccgtgccagggatcttggtgccggaggcgctggggcttggcaactgggtgaaggcgcaggagtgggcggccgtgcccggcggccaggccacgtacctgggcaacccggtgccgtggggcacgctgcccaccatcctggtgatcgagttcgtggccatcgccttcgccgagcaccagcgcaccatggagaaggaccccgagaagaagaagtaccccggcggcgccttcgacccgctcggcttctccaaggaccccgtcaagttcgaggagtacaagctcaaggagatcaagaacggccggctggcgatgttggcgttcgtggggttctgcgtgcagcagtcggcgtacccgggcacggggccgctggagaacctggccacccacctcgccgacccgtggcacaacaacatcggcgacatcatcatccccagaacgatctacccttgagctcagctgagacgacggcggcgaagaacgaagatgaggcgaggcgaggcgacgggcagacgggctgcgctgggagagtgtactggatagatcgatggtgttttctgtgtgtggattactgggcactgcctgcgtgcgtgcagcaactgtacaacgaccgacggcggcgacgactttccggccggccgggaaccacttgtccttgtgtaatgtaaagcttgttgat

SEQ ID NO: 11801 - protein, 154 aa, Panicum virgatum
  misc_feature: Ceres CLONE 1755578
  misc_feature (1)..(120): Pfam Name: Chloroa_b-bind Pfam Description: Chlorophyll A-B binding protein
CRWAMLAVPGILVPEALGLGNWVKAQEWAAVPGGQATYLGNPVPWGTLPTILVIEFVAIAFAEHQRTMEKDPEKKKYPGGAFDPLGFSKDPVKFEEYKLKEIKNGRLAMLAFVGFCVQQSAYPGTGPLENLATHLADPWHNNIGDIIIPRTIYP

SEQ ID NO: 11802 - DNA, 1160 bp, Panicum virgatum
  misc_feature: Ceres CLONE 1755684
  misc_feature: Encodes the peptide sequence at SEQ ID NO. 11803
atccttatttcgcggatccatccagtttcgaggagtgtggaggcaggaagaagcttgctatttagcttgattaattagtaggattcgtgaggggttttaatcttttggtagctaggttgattatcaggggtgtggttgaagatgttggcggtgttcagcggcgaggtggtggaggtgccggcggagctggtggcggcaggaagccggacgccgtcacccaagacgagggcgtcggagctggtgacccgcttcctggggagctcggagccggccgtgtccgtgcagctcgccggcctcggccacctcgcctactcccacaccaaccaggccctcctccgcccaaggttgttcgcggcgaaggacgagatcttctgcctgttcgagggtgtgctggacaacctggggcggctgagccagcagtacgggctgtccaagggcaccaacgaggtggtcctcgtcatcgaggcctacaagacgctgcgggaccgggcgccatacccggccagcttcatgctctcgcagctcaccggcagctacgccttcgtgctcttcgacaagtccaccaactccctgctcgtcgcatctgatcccgagggcaaggtgccgctcttctgggggatcaccgccgatggctgcgtcgccttctctgacgacattggcatgctcaaaggatcctgtggcaagtcacttgcacctttcccgcaaggttgcttctactctaacgctcttggaggcttgaagtgctacgagaaccccaagaacaaggtgactgctgtccctgcagacgaagaagaaatctgcggtgcaactttcaaggtggagggttccacagccctcacatcgttgggaggagaccttcgcgtctgagagggcgtggacgggagtgagagcgaggaccatgcaagcaaaaaaccgtgtacatggtggtgtaacatagtggcaaggcgtgcagctgatctatccgtctcatcatcttccatgaaaaaagaggagtaaagaagtgctgctgccagcagcgtgatgggcaacaagaacttggtcagtgttgttggtcgtgtgtgttgtgtatgtgctgtgcatgtgtgtacccctagcagcagctgttcagagcctacaaggctacaatcctacatggaagaattgaagttgcattgagagtc

SEQ ID NO: 11803 - protein, 241 aa, Panicum virgatum
  misc_feature: Ceres CLONE 1755684
  misc_feature: SWISSPROT Homolog: EC 6.3.5.4 Asparagine synthase (glutamine-hydrolyzing)
MLAVFSGEVVEVPAELVAAGSRTPSPKTRASELVTRFLGSSEPAVSVQLAGLGHLAYSHTNQALLRPRLFAAKDEIFCLFEGVLDNLGRLSQQYGLSKGTNEVVLVIEAYKTLRDRAPYPASFMLSQLTGSYAFVLFDKSTNSLLVASDPEGKVPLFWGITADGCVAFSDDIGMLKGSCGKSLAPFPQGCFYSNALGGLKCYENPKNKVTAVPADEEEICGATFKVEGSTALTSLGGDLRV

SEQ ID NO: 11804 - DNA, 1202 bp, Panicum virgatum
  misc_feature: Ceres CLONE 1755770
  misc_feature: Encodes the peptide sequence at SEQ ID NO. 11805
gcaaaccctatcgccagtttcgcgccgccgtcgaacgcatccccccgtcgccgccgcactcctccacgcctccgtctgtcttcccaggagcacacgcccagcctcccagagcgcagagcctcccgccgctcttgccccagccgcccgctcgcggcacccacagcctcaatcatgcaggtcgtctctgtccttctcgtcagcatctgaggcctccagtccgaggcatcttccctccccccaagatttgaagaaaggatgtggttgaaggaagaagaggttttgcagctactctttttttttttacttaaaacattgtcagatattgaggtgtattgctgaaagatgttgttgatctcaaatgctgtcatctatccggagttgtagtttaattcagcatcatcctgccgccgcgcgccccagcttcgaagccgccgccagctcctccaagagctagtaattaagccgatggccatggccacgcaagcctccgccgcgacgcgccacctgctggcggcggcctggtcgccggcgaaggcgccgcggtcgtcgcagctcgcgctcccgtcgccctcccgcgggccggccccgctccgcgcggccgccggggagcccgcggcggcgaccgaggaggcgcccaaggggttcgtgcccccgcagctggaccccaacacgccgtccccgatcttcggcggcagcacggggggcctgctccgcaaggcgcaggtggaggagttctacgtgatcacgtggacgtcccccaaggagcaggtgttcgagatgccgacgggcggcgccgccatcatgcgggacggccccaacctcctgaagctggcgcgcaaggagcagtgcctggcgctgggcaccaggctgcgctccaagtacaagatcaactaccagttctaccgcgtcttccccaacggcgaggtccagtacctgcaccccaaggacggcgtctacccggagaaggtcaacgccggcaggcagggcgtcggccagaacttccgcagcatcggcaagaacgtcagccccatcgaggtcaagttcaccggcaagaacaccttcgagctgtgatgtgtcgtcgttactattaactgttgccccggtggttgatggatatgtaattttactatcaagcttcccttggtgattgtggagaggtgtggtatggaatcccttaattatatgtacatgtttatttggtg

SEQ ID NO: 11805 - protein, 199 aa, Panicum virgatum
  misc_feature: Ceres CLONE 1755770
  misc_feature (61)..(198): Pfam Name: PsaD Pfam Description: PsaD
MATQASAATRHLLAAAWSPAKAPRSSQLALPSPSRGPAPLRAAAGEPAAATEEAPKGFVPPQLDPNTPSPIFGGSTGGLLRKAQVEEFYVITWTSPKEQVFEMPTGGAAIMRDGPNLLKLARKEQCLALGTRLRSKYKINYQFYRVFPNGEVQYLHPKDGVYPEKVNAGRQGVGQNFRSIGKNVSPIEVKFTGKNTFEL

SEQ ID NO: 11806 - DNA, 1081 bp, Panicum virgatum
  misc_feature: Ceres CLONE 1755800
  misc_feature: Encodes the peptide sequence at SEQ ID NO. 11807
gacaagcgggtcccaccccagctcgatgcctcctctgccgcctctcctcctgctccgttccgcggcgccgcccagcgccgtcccccggcggaggctgaggcggcgccggagtgccgccccggtacgggcgtcgtggcaggagctggcgggcgtgctggtgttctccgccatccccttcaccgccgtcaaggccctcgccaacagccccctgggcgcccgcctccgccgccgcctcgaggccaggaaggccgcagcggccgccgaggcagccgcgctccgagccgccgcgcgcgacgcccgcgacaacagcttttggtacggcggggatcggccgcggtggcttggccccgtgccttacgactaccctgagcatttgacgggagagtacccgggagattacgggttcgatgtagcaggtctgggcagggatcccgttgctttcgcaaactactttaactttgaaatcttgcattgtcggtgggccatgcttgcagctctcggtgttgttattcctgagctattagatctatttgggttagttcattttgttgagcctgtctggtggaaagttggttatgcaaaacttcagggtgatacccttgattaccttgggattcctggattccgaattgctggaggtcaaggtgtcattgtaattgctatctgtcaagccctcttgatggttgggcctgaatatgcgaggtactgtgggattgaagcactggaaccattgggaatatatcttcctggtgacataaactacccgggaggagcacttttcgatcccttgggcctgtccaaagatccggtggcattcgaagagctcaaggtgaaggagatcaagaatggtcgcctggccatggtagcatggctcggattctacattcaggcagctgtgaccggcaagggccctgttgagaacctcgtagaacacttgtccaaccccatccataataacatcttatcctccttccattgagaaaatttgacagtgtggcatgaatatctgttgtcaaaacatatgtatatagtgtttacagttttgcactgatgggtgtgcaatattagctattaattattg

SEQ ID NO: 11807 - protein, 317 aa, Panicum virgatum
  misc_feature: Ceres CLONE 1755800
  misc_feature (112)..(290): Pfam Name: Chloroa_b-bind Pfam Description: Chlorophyll A-B binding protein
MPPLPPLLLLRSAAPPSAVPRRRLRRRRSAAPVRASWQELAGVLVFSAIPFTAVKALANSPLGARLRRRLEARKAAAAAEAAALRAAARDARDNSFWYGGDRPRWLGPVPYDYPEHLTGEYPGDYGFDVAGLGRDPVAFANYFNFEILHCRWAMLAALGVVIPELLDLFGLVHFVEPVWWKVGYAKLQGDTLDYLGIPGFRIAGGQGVIVIAICQALLMVGPEYARYCGIEALEPLGIYLPGDINYPGGALFDPLGLSKDPVAFEELKVKEIKNGRLAMVAWLGFYIQAAVTGKGPVENLVEHLSNPIHNNILSSFH

SEQ ID NO: 11808 - DNA, 1174 bp, Panicum virgatum
  misc_feature: Ceres CLONE 1755829
  misc_feature: Encodes the peptide sequence at SEQ ID NO. 11809
aaccagagaacccgactcgccggccctttgctcgcgtgcgaactgaccctcctctctccctttcgcactcgataggcggcggcggcggcggcggcggaggccgatggcggtatggcgggcggcgggtgctcgcgccgttcttcggcggctcggcgccgcagcggagacggcggggagatgtgatggcggtgtgctcccggccatctgtagcagcagcggaaatgcgacatccggcttaggtcaatatgcaaatctattcagggcacaagcctttgcctcaaggagtattccagtaaattttcatcagttgattcacaatgctggaatatcaactacaaggaacttgcttgcagatgatgctatggttcctatttcttctcctttgacgcctccactgggtgacagtgaagagactgacaaaaagggggctgtcgtcaagcgattgaaggtccatgccataaaaaaggatatcagacagagcccaaagaaggtgaatctagtagcaaagctggtccgaggtatgcgtgtggaagatgccttgttgcagctgcaagtgacagttaaaagggctgccaaaactgtttaccaggtgatccattctgctcgcgccaatgcagctcacaaccatggattggatcctgataagctcattgttgaggaggcctttgtgggaaagggactttacctgaagaggctatcttaccatgccaaggggaggtgcggtgtcatggtgcgaccaaggtgcagattgacagtggtggttagagaagctacagctgaggaagaggcaaagattgccaaactcagggtgagcaactacaagaagctaaccagaaaggagcggcaacttatgccgcatcggctcattgaggttagcccgaggtgggctcgcaagaggaaagaagaagctggtgctacggcatagcgctagtttctgtatgtggtgtcccagtgtttgccatcattcaccctattgtgcttggagacactaaaatttgccgaagaaagatgatgtctcttacatgagataattcagggtctgtttgctgatccagccttgttctatttgtttgtttcatccgcatgaaaactgtcaagacatgctactttgactgtaggacagtgttttaccagcagtgctcttatacaatgaataatttacatgtgatgtttt

SEQ ID NO: 11809 - protein, 273 aa, Panicum virgatum
  misc_feature: Ceres CLONE 1755829
  misc_feature (118)..(222): Pfam Name: Ribosomal_L22 Pfam Description: Ribosomal protein L22p/L17e
MAVWRAAGARAVLRRLGAAAETAGRCDGGVLPAICSSSGNATSGLGQYANLFRAQAFASRSIPVNFHQLIHNAGISTTRNLLADDAMVPISSPLTPPLGDSEETDKKGAVVKRLKVHAIKKDIRQSPKKVNLVAKLVRGMRVEDALLQLQVTVKRAAKTVYQVIHSARANAAHNHGLDPDKLIVEEAFVGKGLYLKRLSYHAKGRCGVMVRPRCRLTVVVREATAEEEAKIAKLRVSNYKKLTRKERQLMPHRLIEVSPRWARKRKEEAGATA

SEQ ID NO: 11810 - DNA, 1932 bp, Panicum virgatum
  misc_feature: Ceres CLONE 1755912
  misc_feature: Encodes the peptide sequence at SEQ ID NO. 11811
atacaaagctccaaacaatggcgcatcaaagcttgactgcaaatggcaacagcagccagcagctggtcaacagagtccaaagagcatgggcccgaagcctcactgaccgagctcaccaccagctgtggaccatggccgtcggtctcgtcgatgctgccggcagcggcggcggcgatgatcggcagtacggcgggaggatcaccttgttcgtggtgctgtcctgtgtcacggcggccttgggcggcgccatcttcggctacgacctcgggacctcaggcggcgtgtcatccatggggccgttcctcagggagttcttcccggacgtgtaccggcggatgcacggcgacgtgcgcgtcagcaactactgcaagttcgacagccagctgttgacgctcttcacctcgtcgctgtacatcgccggcctgctcaccgcgatgctcctctcgtcgtggttcacggccaggcgcgggcgccggccgtccatgatcgtcggcggggtggcgttcctcgccggcgcggcggtcagcggcggcgccgtgaacgtatacatggccatcctcggcagggcgctgctcggcgtcggtcttggcttcgccaatcaggcagtgcttttgtacctgtctgaaatggcccctgcacgattccgaggagcattcagcaacggcttccagctcaccctgtgtctgggatctctcgccgcgaacgtcatcaactacggcgccgacaagctcaccggcggctggggctggaggctgtcgctgggcctggccggcgtccccgccgcgttcttcacgctgggcgccgtcttcctgccggagacgcccaacagcctcgtgcagcagggcgcggaccgcggcaaggtgcgagcgctgctgcagaggatcagaggcaccgacgccgtcgacgccgaactcgacgacatcgtcgcggcgagcggcgccagcggcgatggcctccggctgatcctctcgcagccaaggtaccggccgcagctcgcgatcgccgtgctgatgccggcgttcacgcagctcaccgggatcaacgccgtcgggttctacgcgccggtgctgctccgcacggtcggcatgggcgagagcctggccctgctctcgacgatcatcacggtggcgatctacacggcgtcgacggtggtgttcatgttcgccatcgaccggttcgggcggcgcacgctgctcatcgccggcagcctccagatgctggcctccgagctgctgatcggcgccatcttggcggtggagctcggcgacgagggcggcatgagccggggctacgcggcggcgctgttcgtgctcatcggcgtgtacgtggcaggctacagctggtcgtggggccccatgacgtggctggtgcccaccgaggtgttcccgctggagatccggtcggcaggccagagcgtgacggtggcgtccgggttcgtgttcaccatcttcgtcgcgcaggggttcctcgccatgctgtgccggatgagggcgtggctcttcttcttcttcgccggctggatcgtggtgatgacgggcttcgtgtacctgttcttgccggagacgaaggggatgcccatcgagcaggtcggcaaggtgtggagggagcactggttctgggggagggttgtgggtgtggatgaatcgcaggcaagcgacaagctgtgaaaaaaactctagctagatgagcagtacaaactctgggctgtgcaaattcatctgggttgtagatcggagggccaggaaagagctaatgcattctggtgttcatctcacatgaagaattcattaagctcttacagaaactgcatgagttgtccaactagccacaagaatctgctgattgtagtattcaaactggatatatagacagagatatcataatgcatcatcaaaggctagaccaacaaaacatgatcttctatattcagac

SEQ ID NO: 11811 - protein, 511 aa, Panicum virgatum
  misc_feature: Ceres CLONE 1755912
  misc_feature (30)..(490): Pfam Name: Sugar_tr Pfam Description: Sugar (and other) transporter
MAVGLVDAAGSGGGDDRQYGGRITLFVVLSCVTAALGGAIFGYDLGTSGGVSSMGPFLREFFPDVYRRMHGDVRVSNYCKFDSQLLTLFTSSLYIAGLLTAMLLSSWFTARRGRRPSMIVGGVAFLAGAAVSGGAVNVYMAILGRALLGVGLGFANQAVLLYLSEMAPARFRGAFSNGFQLTLCLGSLAANVINYGADKLTGGWGWRLSLGLAGVPAAFFTLGAVFLPETPNSLVQQGADRGKVRALLQRIRGTDAVDAELDDIVAASGASGDGLRLILSQPRYRPQLAIAVLMPAFTQLTGINAVGFYAPVLLRTVGMGESLALLSTIITVAIYTASTVVFMFAIDRFGRRTLLIAGSLQMLASELLIGAILAVELGDEGGMSRGYAAALFVLIGVYVAGYSWSWGPMTWLVPTEVFPLEIRSAGQSVTVASGFVFTIFVAQGFLAMLCRMRAWLFFFFAGWIVVMTGFVYLFLPETKGMPIEQVGKVWREHWFWGRVVGVDESQASDKL

SEQ ID NO: 11812 - DNA, 692 bp, Panicum virgatum
  misc_feature: Ceres CLONE 1755963
  misc_feature: Encodes the peptide sequence at SEQ ID NO. 11813
aacaaccacccgagcgcctctccttccccgcctccggccggtgcctcccccgtccccggctgcgtcgccggcgatctcaccgcgaatcggatccgccgaaaaggtgagccttcgcccttcccacccaccagctcttccccgtggaggatcgctcctctgcgtccgagatctaggcgaatgttctcttctcctcgtgcgtttgcgcgcgcgtggctgtctgtagatccgcctggcggatctcgtgtcgggtcgttggattcgcgagctgcggtggaaggttcagcggttgctcgttcccgaggtggatctgggtgccgtgcgcgtagatctagcggcctgagcccgtgggagggacgggcgatggattgatcattctgattttgagttcgacgctgcaggcgagagggaagagatggggctcacgttcaccaagctgttcagtcggctgttcgccaagaaggagatgcggatcctcatggtggggctcgacgccgccggaaagaccaccatcctctacaagctcaagctcggcgagatcgtgaccaccatccccaccatcggtaagcttcagcctatgtgagcatcgcgtcgtaaatatatgtttggattaaggttggttgtggactgcagtattgcaattcaggacaaaccttccaaataacgattgcgtaatcccaccgccacttagtttg

SEQ ID NO: 11813 - protein, 55 aa, Panicum virgatum
  misc_feature: Ceres CLONE 1755963
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with altered terpenoid content
MGLTFTKLFSRLFAKKEMRILMVGLDAAGKTTILYKLKLGEIVTTIPTIGKLQPM

SEQ ID NO: 11814 - DNA, 652 bp, Panicum virgatum
  misc_feature: Ceres CLONE 1755963-R
tgcctctttttcgctatgaaaaatacagtataccttcctctgttttatcttcctcaattttattttaaaattggttagttgtatttctctcaactattaaattttaattcacatcgcctgaaaacagatcaggccgctgtggaggcattacttccagaacacacagggtctcatcttcgttgtggacagcaacgatagggaccgtgttgttgaagccagggatgagctccaccgaatgctgaatgaggatgagttacgcgatgctgttttacttgtgtttgctaacaagcaagatcttccaaatgctatgaacgctgctgagattactgataagcttggactgcattcacttcgccagcgtcactggtacattcaaagcacctgtgctacaactggtgagggattgtatgaaggcctggactggctgtccagcaacattgccagcaagtcctaagttgtcaagaggtttggatcatctaggagcttttggatgatatttctggatattaggttgggttgctattcccgtatgtaaggtgtatgccctgagctcaatagttattgagctttgattaagatttaacagttaaattgtttttgtgtaatttgggtcttgagatgtttcgaaccaaacagctaaaagagttccgtt

SEQ ID NO: 11815 - DNA, 1690 bp, Panicum virgatum
  misc_feature: Ceres CLONE 1755975
  misc_feature: Encodes the peptide sequence at SEQ ID NO. 11816
aactcgaacagcccagccgcaaagccaccccgggtttccagcagctccggcacgatcgccttcgcccagtgattgagggtcagggaaaaaaaatccccccgtcgcatccgccgcgccgggagaggaatctctcgccgccacggtgctcctcggcaggtacgagctcggcgacctcctcggccgcggcgcgtccgccaaggtgtaccgcgcgcgggacctcctcaccggccactccgtcgcgatcaagtcattccccaacccccgcgccggcgccgaggaggggcgccgcctcgtggccatcgagcgcgaggcggccatcctccgccgcctgcgccaccgccacgtggtgcacctccacgagatcctagccacgcgcaagaaggtccatttcgtcctcgacctcgccgccggcggcgagctcttctcgctcgtcgacgcctccggccgcatgacggaggacctcgccaggcactacttccggcagctcatctccgccgtgcgctactgccacgcgcgcggcgtgttccaccgcgacatcaagccggagaacctactcctggacgaggccagcgagctcaaagtcgccgactttggcctcggcgccgtggccgacgacggcgacctccgccacacgctctgcggcaccccggcgtacgtggcgccggagatcctgtcgaggagagggtacgacccagccaaggtggacatctggtcctgcggcgtggtcctgttcgtgctcgccgccgggtacctccccttcaacgacgccagcctcgtgaacatgtaccgcaagatctacgcgggcaggttccggtgcccgagctggttctcgccgtcgctgcgcgacctgctgcgccgcgtgctggacccgaacccggacgcccgcatcgacgcggacgacatcgtgggccacccgtggttctgccacggcgccggcgacgaggagctggcccgcctcatgcgcggccacgaggaggagccctggttcaagcccgagttcaaggaggaggacatggcgagggagatgaccgcgttcgacatcctgagcttctccgccgggtccgacctgtcggcgctcttcggcgccgggcatggcaaggagcgggtgttcgtcagcgaggccggcgctgccgtgctgagccgcgtggaggcggccgggcggaaggaagggtaccgcgtgaggagggaagggaagcggggcaccgggccggtctacctggaggaggagagcggcggtggcatcgtggcgaaggtgagcgtcttcaagctcgccgacgcggtgtcagtggtggaggttgtgaagggcgacggcgcggaggccgcgctgttctggaccgagcggctcgagccggccgtgaagcccccggtgctgtcgtgctgagctgagcagagctgatcaggccgccgccgagggtttcctggcttcctgctcctggtcctgggaggcgcctccgccgcttgccgggactgggatccgtttcctttggttgtgatggttcctcaaaaattcatttggttgtttggccgtgtgtgtgttgtgtggtgcctgtcacgctcggcgagcatcagagcactaagcgagcgaggtttggtgccgggtcggccaaaatcatcatcatcatgatcgtcatcatctgtataatattcctattccgacgaggcaagcaagaatccttgcgatgttgagacg

SEQ ID NO: 11816 - protein, 310 aa, Panicum virgatum
  misc_feature: Ceres CLONE 1755975
  misc_feature (1)..(158): Pfam Name: Pkinase Pfam Description: Protein kinase domain
  misc_feature (189)..(246): Pfam Name: NAF Pfam Description: NAF domain
  misc_feature: SWISSPROT Homolog: EC 2.7.11.1 Non-specific serine/threonine protein kinase
MTEDLARHYFRQLISAVRYCHARGVFHRDIKPENLLLDEASELKVADFGLGAVADDGDLRHTLCGTPAYVAPEILSRRGYDPAKVDIWSCGVVLFVLAAGYLPFNDASLVNMYRKIYAGRFRCPSWFSPSLRDLLRRVLDPNPDARIDADDIVGHPWFCHGAGDEELARLMRGHEEEPWFKPEFKEEDMAREMTAFDILSFSAGSDLSALFGAGHGKERVFVSEAGAAVLSRVEAAGRKEGYRVRREGKRGTGPVYLEEESGGGIVAKVSVFKLADAVSVVEVVKGDGAEAALFWTERLEPAVKPPVLSC

SEQ ID NO: 11817 - DNA, 995 bp, Panicum virgatum
  misc_feature: Ceres CLONE 1756232
  misc_feature: Encodes the peptide sequence at SEQ ID NO. 11818
agacagagaggggatctggggatgggctgctgcagcagcaggagctccgattcgccggctagccgcgcgacgcggtggcgctccacgggcatcgtcgccctccgcgacgccaggttgaaggaagtgccaaatgaagttctgcaagtgggaaattccttgagaactctggatttgacaaacaacaaactggttgagattccccaggatgttggcagacttgtgaatatgcaaagacttgttttggctggtaatttgattgaaatcattccagctaacattggacacctgcggaatcttaaaatcctcacccttgacagaaataggatctctatcttgcctgaagaattgggttctctgtcaaaccttcagcaactttctatttctcagaattctttactatccctgcctaagagtgtaggagatttgcgcaatatgtcaatactcaacgtatctgataacaaactaaaggaacttccggaatcaattggaggttgcaattccctggaagaattgcaggcaaatgggaattcaattgaagatgtgccctcatcaatttgcaaccttgtttgccttaaatccttatcactgaatggcaacaaaattcgtcagcttccgcaaaacttactgaaagactgcacggctcttcagagtatatcgctccacgacaacccaatcacaatggaccagttccaacaaatgaatggattcaatgagtttgaggcgcgcagacggaagaaatttgacaagcagatcgattcgcgtgtcatgatgggctccacggccctggatgaaggggttgatttccactgattgcacagctcaagtggcttccattttttctaattggtcagggccaattgtagatttgtatatatcaatttcttatcccgtaaggagggcacataaatgagccaaaaattcctgatttttgcttgaacatttgcagtaagtgagattgcacatcttatgttcctatatggaaacatattgattgc

SEQ ID NO: 11818 - protein, 262 aa, Panicum virgatum
  misc_feature: Ceres CLONE 1756232
  misc_feature: SWISSPROT Homolog: EC 2.7.11.1 Non-specific serine/threonine protein kinase
MGCCSSRSSDSPASRATRWRSTGIVALRDARLKEVPNEVLQVGNSLRTLDLTNNKLVEIPQDVGRLVNMQRLVLAGNLIEIIPANIGHLRNLKILTLDRNRISILPEELGSLSNLQQLSISQNSLLSLPKSVGDLRNMSILNVSDNKLKELPESIGGCNSLEELQANGNSIEDVPSSICNLVCLKSLSLNGNKIRQLPQNLLKDCTALQSISLHDNPITMDQFQQMNGFNEFEARRRKKFDKQIDSRVMMGSTALDEGVDFH

SEQ ID NO: 11819 - DNA, 685 bp, Panicum virgatum
  misc_feature: Ceres CLONE 1756249
  misc_feature: Encodes the peptide sequence at SEQ ID NO. 11820
ctctcctcctcccgaaccgcacgccgacaccacagaccgcagggcaccccgtgtcggcagcggagcagaagcagcgagcgatccctggcggccccggctctcctctccgggcggcagctgctcggcccccccgtgcagtccgccctctcccggtcctcgtcggccaggaaggcgcccttcgtcgtcagggccagctcccgcccgccggccaagcaaggcgccgaccggcagctgtggttcgcgtccaagcagtccctctcctacctcgatggcacgctgcccggcgactacggcttcgacccgctggggctgtcggacccggagggcaccggggggttcatcgagcccaagtggctggcctacggcgaggtgatcaacggccggttcgccatgctgggcgcggcaggcgccatcgccccggagatcttcggcaagctgggcatcatcccggcggagacggcgctgccgtggttcaagacgggggtcatcccgcccgcgggcacctacaactactgggccgactcgtacacgctcttcgtcttcaacatggcgctcatgggcttcgccgagcaccgccgcctccaggactggtacaacccgggctccatgggcaagcagtacttcctcgggcttgagaagttcctcggcggctccggcgacccctcctacccggggggcccgctct

SEQ ID NO: 11820 - protein, 228 aa, Panicum virgatum
  misc_feature: Ceres CLONE 1756249
  misc_feature (84)..(228): Pfam Name: Chloroa_b-bind Pfam Description: Chlorophyll A-B binding protein
LSSSRTARRHHRPQGTPCRQRSRSSERSLAAPALLSGRQLLGPPVQSALSRSSSARKAPFVVRASSRPPAKQGADRQLWFASKQSLSYLDGTLPGDYGFDPLGLSDPEGTGGFIEPKWLAYGEVINGRFAMLGAAGAIAPEIFGKLGIIPAETALPWFKTGVIPPAGTYNYWADSYTLFVFNMALMGFAEHRRLQDWYNPGSMGKQYFLGLEKFLGGSGDPSYPGGPL

SEQ ID NO: 11821 - DNA, 1113 bp, Panicum virgatum
  misc_feature: Ceres CLONE 1756269
  misc_feature: Encodes the peptide sequence at SEQ ID NO. 11822
atccggaactcctgcttcgccccgctggatatccgcgcatcttttggaaggacgaagagcagaggttgtggtgtttgttggagtgttgaaggtgctgattggcgtggagttgaagtttggagtttagaggaaagatttcgtgatgagcagccgcagcccgcagccgaaggaccgcaggatgcgtaccgagcgcacctcataccgtgacgcaccatatcggagggacagccgccgtggtccgagcaggtttcataatgatttgtgcaacaactgtaagcgtcccgggcattttgctagagagtgtcctagcgtggctgtctgccatacctgtgggcttcctgggcacattgcagctgagtgttcttccaaaggtatctgctggaactgcaaagagcctggccacatggctaacagctgcccaaatgaagggatatgccgtaactgcggcaagtctggccacattgcaagagactgcactgctccgccattgccacctggagaagtgatcatttgcagcaactgctacaaaccaggtcattttcgtgaggaatgcaccaatgagaaggcctgcaacaactgtcggcagagtggccatcttgcccgcaactgcaccaatgatcctgtttgcaacctgtgcaatgttgctggtcatttggcccgtcagtgccccaagtctgatacattgggtgagcggggtttgccacctcccttccgtggagctggcgctcccttccgtggcagcttcagtgacgtcatctgtcgcgcctgcaaccaggttggccatatgagccgtgactgcatggctggtgccttcatgatctgccacaactgtggtggccgtggccacatggcttatgagtgcccctctgtgaatctcatggaccgcttccccccgcgtcatttctgaaggacgttcaagggcaattcagatgacttatggccctctacgtcaagaacaattttacttttaatttgttttttatttctaaactataacgacttctagctatgtcaaatgcgatctttagttgtaattctgggatatgctatttagctgtgatgttctgttgaggataatatttgtggatgggaatacttatgaatactgaattc

SEQ ID NO: 11822 - protein, 254 aa, Panicum virgatum
  misc_feature: Ceres CLONE 1756269
  misc_feature (96)..(113): Pfam Name: zf-CCHC Pfam Description: Zinc knuckle
  misc_feature (39)..(56): Pfam Name: zf-CCHC Pfam Description: Zinc knuckle
  misc_feature (77)..(94): Pfam Name: zf-CCHC Pfam Description: Zinc knuckle
  misc_feature (141)..(158): Pfam Name: zf-CCHC Pfam Description: Zinc knuckle
  misc_feature (225)..(242): Pfam Name: zf-CCHC Pfam Description: Zinc knuckle
  misc_feature (204)..(221): Pfam Name: zf-CCHC Pfam Description: Zinc knuckle
  misc_feature (58)..(75): Pfam Name: zf-CCHC Pfam Description: Zinc knuckle
  misc_feature (160)..(177): Pfam Name: zf-CCHC Pfam Description: Zinc knuckle
MSSRSPQPKDRRMRTERTSYRDAPYRRDSRRGPSRFHNDLCNNCKRPGHFARECPSVAVCHTCGLPGHIAAECSSKGICWNCKEPGHMANSCPNEGICRNCGKSGHIARDCTAPPLPPGEVIICSNCYKPGHFREECTNEKACNNCRQSGHLARNCTNDPVCNLCNVAGHLARQCPKSDTLGERGLPPPFRGAGAPFRGSFSDVICRACNQVGHMSRDCMAGAFMICHNCGGRGHMAYECPSVNLMDRFPPRHF

SEQ ID NO: 11823 - DNA, 1310 bp, Panicum virgatum
  misc_feature: Ceres CLONE 1756290
  misc_feature: Encodes the peptide sequence at SEQ ID NO. 11824
aatactctactgctaccacgccgccgccgacgacgggcagcaagcagtagctactgtagtagctagcgagcgcgccgccatgggtgacacgggcgcgaacatggcccactgggccgggctctactgcggcgggaacggcgcgccggcggcgacggaggcgaccgtggtaacggccgcggcggcggggacggtgtcgagcccgacgtccggcgggtcgattggcagtccgacccgcgcgcagccgggggtggagggcgggcgggtcgcgaagcccgcgcggcggcggtcccgcgcgtcccgccgcgcgcccgtcacgctgctcaacacggacacctccaacttccgcgccatggtgcagcagttcaccggcatcccgcccggcccctacggccctgccggcggcgcggccggcgggcccgtgatcagcttcggctccggcggggactacggcggcggcgccgcgctggtgcgcccgtcgccgacgtcggccgtcatgtcgttcgaccacctggcggcggcgtcgcagcagcagcagccgcaccaccggcccgcgtcgctgcagggccagctcttcaggccgcagcagcagtacgccgacgtcggctacggcatgcacggcggcggcggggacatgccgccgccgttcctgcacgggttcgagtcgtcggcggaggaccggctgctgctgcagagtatccaggcggcgcagatgatgcccacccgcccgtcctcgacgactagcaacagccatggctacaacttcggctgatcgctccatcgatctgccacctaccagctcaaccaaggtaacaacaacaataatagagccaaggtcacttgatcggatccaggggagatcaagaagccattagtttgatttgtgatcatggtgcatggtcgccgtagatcacgagctgatgatgatgtgttcttgcttgtcgctgatgctcaagcattatttcgttttatttttgttggccttgctgtgtgatcaaaggccaattaaggtttgcgcaattagcagtttagcacacagtaattagcactactagtagtagccttgctgctttataaggagttaagctaggtgctagatgtgaaacgaagtgcggagaaaagaggcatgtaaatatagttggtagtaaaaagttgggcgcgcgtgcgctttcggtgtgtagtagagcagctgatagtgaggaatctttctagagagagagattgccttggctcggaagcaaagtccgagagggctactacatgcttgtactgctgatcaattatgaagccccgccgctaactgattgcacctt

SEQ ID NO: 11824 - protein, 229 aa, Panicum virgatum
  misc_feature: Ceres CLONE 1756290
  misc_feature (74)..(104): Pfam Name: VQ Pfam Description: VQ motif
MGDTGANMAHWAGLYCGGNGAPAATEATVVTAAAAGTVSSPTSGGSIGSPTRAQPGVEGGRVAKPARRRSRASRRAPVTLLNTDTSNFRAMVQQFTGIPPGPYGPAGGAAGGPVISFGSGGDYGGGAALVRPSPTSAVMSFDHLAAASQQQQPHHRPASLQGQLFRPQQQYADVGYGMHGGGGDMPPPFLHGFESSAEDRLLLQSIQAAQMMPTRPSSTTSNSHGYNFG

SEQ ID NO: 11825 - DNA, 591 bp, Panicum virgatum
  misc_feature: Ceres CLONE 1756333-R
  misc_feature: Encodes the peptide sequence at SEQ ID NO. 11826
gctcggcgacgacagcatcgcctccgccgagctcacgcagggcgccaagattgagaagcaggggatcaccaggatgcagattcccttcagcttcaggcccaaggacttcggatccgcggtctgggacatgatcaggggcagggggacaggctacaccttcaagggcaagattgatgtcgacactccctttgggaacatgaagctgcccataagcaaagagggtggaaccacccgcatcaagaaggacgaggacgacgacgacgacgacgataactgaggactgaagtgctgctgttaccaaacacagatgacagtgaagtggagaggatgctgtaaggggtgcagtcagtctgcctggcacccttaacgctagttgagctctgcattgtcttagtagcttcttgtgtctgtcgatctgcattgtctgaacatcctcagttagtgtggactcgtctgtgctgtgaattccttctccaaacttttgtggttggaacgtgagaaataagttcccatcacccctggttctttgtggggctggtggggagtgttcttcagatcctgaaatgttgtgccgcagcgattgttggtacc

SEQ ID NO: 11826 - protein, 91 aa, Panicum virgatum
  misc_feature: Ceres CLONE 1756333-R
  misc_feature: Useful for making plants with altered alkaloid content
LGDDSIASAELTQGAKIEKQGITRMQIPFSFRPKDFGSAVWDMIRGRGTGYTFKGKIDVDTPFGNMKLPISKEGGTTRIKKDEDDDDDDDN

SEQ ID NO: 11827 - DNA, 151 bp, Panicum virgatum
  misc_feature: Ceres CLONE 1756333
acattgcccacccgcctccggtctctgatcttcttttgttcttggttactgggaaaaccctggcgttaccatgtttatctccgagaagcccatccccacttagcccggtggcgaggacggcaacaaggaggacggcaacgacattgacggc

SEQ ID NO: 11828 - DNA, 1372 bp, Panicum virgatum
  misc_feature: Ceres CLONE 1756480
  misc_feature: Encodes the peptide sequence at SEQ ID NO. 11829
actcttccacacactcgagactcgagagccagccaaagccagcttccagcagcgcacgagctgggctgagcctgagagccgccgccagcccgccgccaccaccagagggataggatggcgcccaccgcctcatccttcctcgccgtcttgctgctcgtcgcggcggccgcgtcgacgccggcgcggtcgtgcgcgccgagcgacctgcgcgcgctgctgagcgtgaagcaggtgctgggcaacccggcgacgctgtcgtcgtggagcccgtcgtcgcccaactgctgcgcgtgggaccacctccggtgcgacgacgccgggcgcgtgaacaacgtcttcatcgacggcgccgacgacgtgcacgggcagatcccgtcggcggtggcggggctgacggcgctcatgtcgctgtccctgttccgcctgccggggctcacgggcgccatcccggcctgcctcgcggggctctccaacctgcagttcctcaccatctcccacaccaacgtctccggccccatcccggaggccctggcgcggctccgcaccctggactcggtcgacctctccagcaaccggctgagcggccgcatcccggcgtcgttcgccgacctgcccaacctccggtcgctggacctccagcacaaccagctgacgggccccatcccggcggggctcgtgcaggggcagttccgctcgctgatcctgtcctacaaccagctgaccgggccgatcccgcgcgacgacgcgcaggacgagatcaacacggtggacctctcccacaacaagctcaccggcgacccctcccacctgttcgtccccgggcggcccatcgggaaggtggacctgtcctggaactacctcgacttcgacctcagcaagctggtgttcccgccggagctgacgtacctggacctgtcccacaaccgcatccggggcaccgtgccggcgtcgctggagcgcctgtccacgctgcagaagctggacctcagctacaacaacctgtgcgggccgctccccagggggcacggcgtcatcaagcacgggtgcaagccgtacgcgcacaaccagtgccgccacgggacgccgctcgccggctgccgggacctgtcgtgagcgcgccccggtcgtggtgtgtggtgagctgatctgagcacggcgacggtgcttggtgttcttcttagctatagacaagagtgcgctgcgtggcggcaatgccgatctcgagcagttaaaagcgtgtacgtacgaaacgacagcggtggacgtgtgctgtactggagcgtgtgttatgtactgtgtatttggtatggatccgatcggccccatgtatcaaaagaatgttactaaatggtaattatgtttgtttggcttc

SEQ ID NO: 11829 - protein, 332 aa, Panicum virgatum
  misc_feature: Ceres CLONE 1756480
  misc_feature (27)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MAPTASSFLAVLLLVAAAASTPARSCAPSDLRALLSVKQVLGNPATLSSWSPSSPNCCAWDHLRCDDAGRVNNVFIDGADDVHGQIPSAVAGLTALMSLSLFRLPGLTGAIPACLAGLSNLQFLTISHTNVSGPIPEALARLRTLDSVDLSSNRLSGRIPASFADLPNLRSLDLQHNQLTGPIPAGLVQGQFRSLILSYNQLTGPIPRDDAQDEINTVDLSHNKLTGDPSHLFVPGRPIGKVDLSWNYLDFDLSKLVFPPELTYLDLSHNRIRGTVPASLERLSTLQKLDLSYNNLCGPLPRGHGVIKHGCKPYAHNQCRHGTPLAGCRDLS

SEQ ID NO: 11830 - DNA, 1263 bp, Panicum virgatum
  misc_feature: Ceres CLONE 1756487
  misc_feature: Encodes the peptide sequence at SEQ ID NO. 11831
aagctcaccggagagcaaccgagctcatagaaagcctctgaaatctgaattgcgaactccgccgagctcacgagcggcagcaatggcgaagctttgcacattgctgctggcagcggtgctcgtgctctcgctcctcgtgagccccattgcctgcacccgcaagctcagcaagcccaagcacaaggcaaaggcaaagccggtcagccacaggacggcgcctgctgcggcggccaagcccaagccacacccagtgagctacaagccggcgcctgctgcggccaagcctcacagcagcaaccacaccgctaagcactcgccgccgatcgtctacggcggcgcctggctgtccggcgccggcgccacgtactacggcgcgcccaacggcgacggcagcgacggtggcgcgtgcgggtaccagaccgccgtcgggacgcagccgttcgactcgatgatcgccgccgggagcacgccgctgtacatggacggcgagggctgcggcgcctgctacgaggttaaatgcacgaccaacgcggcgtgctccggccagccggcgaccattgtgatcaccgaccggtcccccggcgacctgttccccggcgaggtggtccacttcgacatgagcggcaccgccatgggcgccatggcgaagcccggtatggccgacaagctccgcgccggcggcgtcctgcggatcctgtaccgtagggtgccgtgcaagtaccccggcgtgaacgtcgcgttcaaggtggaccagggcgccaaccccttctacttcaacgtgctcatcgagttcgaggacgacgacggcgacctcaaggccgtcgacctgatggaggccggcagcaacgtgtgggcgcccatggcgcacaactggggcgcaacgtggcggctcaacaacggcaggaggctcaacgcgccgttcggcctccggctcacctccgactccggcagggtgctcgtcgccaacaacgccattcccgccgcgtggaagcccgggaagacgtaccgctccctcgtcaactacccctgaaaagagggattcggaggagtccatggcgggtagtctgcgtccgggtgttgcgagaggcggcgatgtcagaagtctgaagaggaggcggaggttgaagaagagaatggcgttcttccctccctccacggtctctgtatcactgtatgcagtccccaagtgatgtgtgactgtgtgagccatgtctgtaatttcattttttttcatctcgatttgggaagagagaagctttgtcc

SEQ ID NO: 11831 - protein, 315 aa, Panicum virgatum
  misc_feature: Ceres CLONE 1756487
  misc_feature (218)..(299): Pfam Name: Pollen_allerg_1 Pfam Description: Pollen allergen
  misc_feature (124)..(206): Pfam Name: DPBB_1 Pfam Description: Rare lipoprotein A (RlpA)-like double-psi beta-barrel
  misc_feature: Useful for making plants with altered carbohydrate content
  misc_feature: Useful for making plants with altered cell wall content and/or composition
MAKLCTLLLAAVLVLSLLVSPIACTRKLSKPKHKAKAKPVSHRTAPAAAAKPKPHPVSYKPAPAAAKPHSSNHTAKHSPPIVYGGAWLSGAGATYYGAPNGDGSDGGACGYQTAVGTQPFDSMIAAGSTPLYMDGEGCGACYEVKCTTNAACSGQPATIVITDRSPGDLFPGEVVHFDMSGTAMGAMAKPGMADKLRAGGVLRILYRRVPCKYPGVNVAFKVDQGANPFYFNVLIEFEDDDGDLKAVDLMEAGSNVWAPMAHNWGATWRLNNGRRLNAPFGLRLTSDSGRVLVANNAIPAAWKPGKTYRSLVNYP

SEQ ID NO: 11832 - DNA, 1029 bp, Panicum virgatum
  misc_feature: Ceres CLONE 1756546
  misc_feature: Encodes the peptide sequence at SEQ ID NO. 11833
aaaccgcaggcattcctctcgtctcgtcccccaccagagccagagcatgcgcgtagccgcgacgcgagtcgccgccgctcccgctcccgctccgcgccccctcctcgtcctgctgctggtcctcctcgtctccgcgcccctcgcgaccggagcagcggccatggccggccacgtcctcggcggcgtgaaggagaaccccgccgccgccaacagcgccgagtccgacgggctcggccgcttcgccgtcgaggagcacaacaaacgccagaacgcgctgctggagttcgtgcgcgtggtggaggccaaggagcaggtggtggccggcacgctgcaccacctcacgctcgaggccattgaggccgggaggaagaaggtctacgaggccaaggtctgggtcaagccgtggctcgacttcaaggagctccaggagttcgtccacaagggggacgctaccaccttcaccagcgccgacctcggcgccaagaaaggtggacatgagcctgattggcgtgaggtgcctgtggaggatcctgctgtcaaagatgctgcacaccatgctgtgaaatcaatccaagagaggtctaactccctgtttccctatgaacttcttgagatcgttcgtgccaaggcacaggttgtggaaggcttcacgaaatttgacattctgatgacgctgaagagaggcagcaaggaggagaagatcaaagccgaggtccataagaatctggaaggggccttcgtgctgaaccagcatcagccagcagagcacgatgagtctagcagccagtgagcttctgacgtaacgaaaactgtggtaatgtagcgtgcgctctaaaataaggagacgtgatccactccgggtttttatctggatatatgttgtgtggtcgttactggcttccgaacggggcaggcagaggcagcctagtgctgttcctagcttgtcggaatgttattgctggcatccgaacttgtgaactacccgaacttgtgaactaccaaagctaatcgtggtcatattgtactgtt

SEQ ID NO: 11833 - protein, 247 aa, Panicum virgatum
  misc_feature: Ceres CLONE 1756546
  misc_feature (45)..(133): Pfam Name: Cystatin Pfam Description: Cystatin domain
  misc_feature (152)..(240): Pfam Name: Cystatin Pfam Description: Cystatin domain
MRVAATRVAAAPAPAPRPLLVLLLVLLVSAPLATGAAAMAGHVLGGVKENPAAANSAESDGLGRFAVEEHNKRQNALLEFVRVVEAKEQVVAGTLHHLTLEAIEAGRKKVYEAKVWVKPWLDFKELQEFVHKGDATTFTSADLGAKKGGHEPDWREVPVEDPAVKDAAHHAVKSIQERSNSLFPYELLEIVRAKAQVVEGFTKFDILMTLKRGSKEEKIKAEVHKNLEGAFVLNQHQPAEHDESSSQ

SEQ ID NO: 11834 - DNA, 1197 bp, Panicum virgatum
  misc_feature: Ceres CLONE 1756614
  misc_feature: Encodes the peptide sequence at SEQ ID NO. 11835
attcgtcccatcggccggcggcttaaaccctaggctcctccatcgccgcgtcttcatcgcagccgccgccgctttctccgtcgcgccgatggagttctggggtcttgaagtaaagcctggaaccactgttaagtgtgatcctagcgatggctacatccttcacctttcccaggctgctcttggggaatcaaagaaaagcgacaatgcattgatgtatgtcaaagttgatgatcaaaagctggcccttggtaccctctcacatgacaagtaccctcaaatccaatttgatttggtctttgacaaagagtttgagctgtcacacacctcaaaagctgccagtgtgttcttctctggatacaaggcggagcaacccggtgttgaagatgaaatggattttggtcctgaagaagatgaagatgaagaggaagagctgaacattcctgtaatcaaggaaaatggccaagctcaagggaaggaggagcagaaaagcaaggcggcgcctgcggcttcaaattcaagtcctgctgtaaaggatgttgaaaagaaaagcaaggacgaggatgacagtgacgaggatgaaactgatgatgattctgatgatgatgatctatcttctgaggaaggcgatgctgattcaagtgacgaggttgattccagtgaggatgatgaggacagtgaggatgatgaggatgaagaaacaccaactcccaagaagccagaggtaggcaagaagagagcagcggaaaatgctccaaagactcctgtttctgataagaaagcgaaagtttccacaccatctggccataagacaggtggtaacaagggcactgcccatgtggcaactccgcacccagcaaagaaggtgagcaagacccctgcaaacaatgacaagtcaaaggagaagtccccgaaatctggtgggtcagtctcgtgcaagtcgtgcagcaagacgttcaacagtgacatgtctctgcaggctcactcgaaggccaaacatggtgggaagtgagggactctctgcggtggaagttggtgcctttttacagtccgggaagaaatgtgggtgttaggccttattttgggacgagacgtgtcttagcggttgttatgtgatttttgcgttcgtggagactctaatgctgcagtgaacttatattctgggttcggatggtagttatgaattgttgaatctgcctc

SEQ ID NO: 11835 - protein, 306 aa, Panicum virgatum
  misc_feature: Ceres CLONE 1756614
  misc_feature: Useful for making plants with altered lignin content
  misc_feature: Useful for making plants with modulated drought sensitivity
MEFWGLEVKPGTTVKCDPSDGYILHLSQAALGESKKSDNALMYVKVDDQKLALGTLSHDKYPQIQFDLVFDKEFELSHTSKAASVFFSGYKAEQPGVEDEMDFGPEEDEDEEEELNIPVIKENGQAQGKEEQKSKAAPAASNSSPAVKDVEKKSKDEDDSDEDETDDDSDDDDLSSEEGDADSSDEVDSSEDDEDSEDDEDEETPTPKKPEVGKKRAAENAPKTPVSDKKAKVSTPSGHKTGGNKGTAHVATPHPAKKVSKTPANNDKSKEKSPKSGGSVSCKSCSKTFNSDMSLQAHSKAKHGGK

SEQ ID NO: 11836 - DNA, 986 bp, Panicum virgatum
  misc_feature: Ceres CLONE 1756655
  misc_feature: Encodes the peptide sequence at SEQ ID NO. 11837
ctcacccagcgacactcaacgaccatcacaattattcaatcctcgcatttgcagcgcccacaaacccgcgaagaaaggaaggaagagaagctgctcccgatggagaacgccgatgcccctcccgccgccgtgaagccgtcgctgtccaagaagccctcgccgtcgttccgcctccggaacggcagcctcaacgcgctgcggctgcgccgcgtgttcgacctcttcgaccgcaacggggacggcgagatcaccctcgacgagatggcctcggcgctcgacgcgctcggcctcggcgccgaccgcgccggcctggaggccgccgtcggggcgtacatcccggccggcgccgcggggctccgcttcggcgacttcgagtccctccaccgcgcgctcgggaacgcgctgttcggccccatcccggaggcggtgcccgaggaggacgaggagggggacatgaaggaggcgttccgcgtgttcgacgaggacggcgacggctacatctcggccgccgagctccaggccgtgctcaagaagctcggcctgcccgaggcgcggaacctcgccacggtgcaggagatgatatgcaacgtcgacagcgaccgcgacggccgcgtcgacttcggcgagttcaagaacatgatgcaggggatcaccgtgtggggcgcctagctgcagcgcccctgcgttgccagccctctactgcgtgttgacatgttctgcagcacctaaagactggaggaggagcaaccacaacatcagtaacttgtgccacgttttaaagtactaagggttgtgttagtttggtagcttgggaatagtcatggtgtgtatcgtcagaatccagttgatgacttgtgatttcagtgtgttctaagttctaactgtggtggtcacgtccaccactgatgtaggtactgtgcttctctcgtgtctgatgtctcccttgctctaataaaccatctgaacattagacattcagtttattt

SEQ ID NO: 11837 - protein, 189 aa, Panicum virgatum
  misc_feature: Ceres CLONE 1756655
  misc_feature (118)..(146): Pfam Name: efhand Pfam Description: EF hand
  misc_feature (34)..(62): Pfam Name: efhand Pfam Description: EF hand
  misc_feature (156)..(184): Pfam Name: efhand Pfam Description: EF hand
  misc_feature: SWISSPROT Homolog: EC 2.7.11.1 Non-specific serine/threonine protein kinase
MENADAPPAAVKPSLSKKPSPSFRLRNGSLNALRLRRVFDLFDRNGDGEITLDEMASALDALGLGADRAGLEAAVGAYIPAGAAGLRFGDFESLHRALGNALFGPIPEAVPEEDEEGDMKEAFRVFDEDGDGYISAAELQAVLKKLGLPEARNLATVQEMICNVDSDRDGRVDFGEFKNMMQGITVWGA

SEQ ID NO: 11838 - DNA, 1098 bp, Panicum virgatum
  misc_feature: Ceres CLONE 1756661
  misc_feature: Encodes the peptide sequence at SEQ ID NO. 11839
aaacatacagctttacttttgtggaggaatgtgcctggcctaacatctagaaactcatctcttgccgacaatggcgaaaaaaggacacatctactgatctacgggctttctcccacgcaaaaattctccagatggcatgaccaaactggaacgagtccgagccagcccatatctgaccagatcaagtcctgcatcacagcttcaatctggtttggaaaacttctcaccatttctgtatcctaccccctatatatataaacagccacgcacaagcagatatgatcgcagcaagaagcagcaggcagcaccagcacacgtcaagatgaagcttcacgccgccgtggccgcttccctcctggccctggccgcggccgcgtcggcggccggcgccgtcacgttcgacgcgacgaacacggcgtccggcacccccggcgggcggcgcttcgaccaggccgtcggcctcggctacgccaagcgggtcctctccgacgcgtccgccttcatctggcgcaccttcgaccagcgcagcgccgccgcccgcaagcccgtggccgcggtcaccctcgtcgtcgaggacatcggcggcgtggccttcacgagcggcgacgccatccacctcagcgcccggtacgtcggcggctacccatccgacggcgacgtcagggccgaggtgaccggcgtgctgtaccacgaggcgacgcacgtgtggcagtgggacgggcggggggcggcgaacggcggcctcgtcgagggcatcgccgactacgtccggctcaaggccgggtacgcgccggcgcactgggtgaagccggggcagggcgaccggtgggaccaggggtacgacgtcacggcgaggttcctggattactgcgcctcgctcaagccggggttcgtggcgcagctcaacgccaagatgaaggacgggtacagcgacgacttcttcgcgcagatcacggggaagagcgtgcagcagctgtggcaggactacaagaagaagtatgggggctgatgggggataggtaggtggtcaggatactgttgcttactatgctgaataataataatgttcaaaatggcttgatgccagtttgtgatgtg

SEQ ID NO: 11839 - protein, 228 aa, Panicum virgatum
  misc_feature: Ceres CLONE 1756661
  misc_feature (21)..(222): Pfam Name: BSP Pfam Description: Plant Basic Secretory Protein
MKLHAAVAASLLALAAAASAAGAVTFDATNTASGTPGGRRFDQAVGLGYAKRVLSDASAFIWRTFDQRSAAARKPVAAVTLVVEDIGGVAFTSGDAIHLSARYVGGYPSDGDVRAEVTGVLYHEATHVWQWDGRGAANGGLVEGIADYVRLKAGYAPAHWVKPGQGDRWDQGYDVTARFLDYCASLKPGFVAQLNAKMKDGYSDDFFAQITGKSVQQLWQDYKKKYGG

SEQ ID NO: 11840 - DNA, 394 bp, Panicum virgatum
  misc_feature: Ceres CLONE 1756686
  misc_feature: Encodes the peptide sequence at SEQ ID NO. 11841
gcgaagatgtggggcgaccgcgagcgcatggtggccgaggcgaagatgtggggcgagaactggcgtgacaagcggcgagcggagaatgggcaggggagcctggattcgccaaccaggaacagctagggtgcaagattaaaggagagagaagacgacggcagaggttttcatccatccacccatgcattatctgtttatttccaggtcgatttgcgttccggtggcggagggaggacagggagggttagatgtacattcctagggcgggatcgcggggaaaacacggtggtgttgtactggacagtggatgcatgtggttgtacttgtaaattctcagaaaattttgtgagaatgaaaggacattttgagttccacttgtaaaatgttacgtgtc

SEQ ID NO: 11841 - protein, 41 aa, Panicum virgatum
  misc_feature: Ceres CLONE 1756686
  misc_feature: SWISSPROT Homolog: EC 2.7.11.1 Non-specific serine/threonine protein kinase
AKMWGDRERMVAEAKMWGENWRDKRRAENGQGSLDSPTRNS

SEQ ID NO: 11842 - DNA, 1108 bp, Panicum virgatum
  misc_feature: Ceres CLONE 1756877
  misc_feature: Encodes the peptide sequence at SEQ ID NO. 11843
atttggcgccgcgcctcccacctcctcctccgcaacgccgccgccgccgccgcccggcgatgccacccacagccgcttctggccccaccgccgccgcttcccctcgcaccgccatggctcgcctccacgtcctcctacgccacccaggcagcggcggccgcggcgaagcccctccggacggtgggctccttgctgcggctcaacgacctgcgggacaacccgagagcgacgaagcagaagacgcgcaagggacgcgggatcggctccggcaagggcaagacggccggccgcgggcacaagggacagaaggcgcgtggcacctccaggttaggcttcgagggcggacagaccccgctccgccgccgcctgccccgacgcggattcaagaaccgcttctccctcacattccagccctgtggactggggaaaattgcaaagctcatcaatgctggaaaaattgactcctctgaactgatcacgatgaagacactgaaggaaacaggtgcgattgggaagcaaataaaggatggtatccgtttaatgggccgtggagcagaagaaatcaaatggcctattcaccttgaggcatcaagggcgactgcaagggcaaaagctgccgttgaagcagctggtggaacagcaagactggtgtattacaacaagcttggatttcgggcgctccttaaacccgagttgtttgagaagaagggtcgccttctgccaaaggcggcacggcctccacccaagcagaaagataaggttgatagcattggccgcctgcctgcaccaacaaagccacttcccttcacggcagaggagttggagttcgcagtgaagcgagacgctgctcgtgtgactgcataagatgacagcacgttggaggcacattttctgttttgcacaacaaagaaaacatgccccactgaatgtgtgtcacaattacctttagcagggcatgtataagaatggagtttataccttcttttttttcggcaagggatggactgtaataaatcaaagatccattccttgtgggatgagcccccttgcgtgtagtctctatctgaactttagattgtcgtttggactgatgaatgccatctttctg

SEQ ID NO: 11843 - protein, 287 aa, Panicum virgatum
  misc_feature: Ceres CLONE 1756877
  misc_feature (65)..(164): Pfam Name: Ribosomal_L15 Pfam Description: Ribosomal protein L15 amino terminal region
  misc_feature (179)..(212): Pfam Name: L15 Pfam Description: Ribosomal protein L15
IWRRASHLLLRNAAAAAARRCHPQPLLAPPPPLPLAPPWLASTSSYATQAAAAAAKPLRTVGSLLRLNDLRDNPRATKQKTRKGRGIGSGKGKTAGRGHKGQKARGTSRLGFEGGQTPLRRRLPRRGFKNRFSLTFQPCGLGKIAKLINAGKIDSSELITMKTLKETGAIGKQIKDGIRLMGRGAEEIKWPIHLEASRATARAKAAVEAAGGTARLVYYNKLGFRALLKPELFEKKGRLLPKAARPPPKQKDKVDSIGRLPAPTKPLPFTAEELEFAVKRDAARVTA

SEQ ID NO: 11844 - DNA, 1104 bp, Panicum virgatum
  misc_feature: Ceres CLONE 1756953
  misc_feature: Encodes the peptide sequence at SEQ ID NO. 11845
aactgaacagcagcctccatacctgctcctgtagagctagtttggaaacgagagagctaacccagggaggtacgccctggaaagtgaattctgcggcaaatgctctcatcgtctctttcctaggtaacgacttcaaccaagttttccgttcactcgaaaacttggagaaaggtacatcggatcaaaaaggaaacacaccacttttttaccatatttctgggttgccaaaatcatactacaacaggctattacccagagaaagtgtccatctctttcactcctcttccagccttcactggcggtcgcaggtacctgaggtactggaagcaagtagagatgccttgctaaacaaagataacatttacatctcagaggccagtacatcatttgtagtaaagtgcttcagagagcagtttaataaggacttctctaccttcctaaagctgcgtcatgaagaacttgtgtatggagggaaaatggttctaacattttgtggaaggaaggatgaaaatgtatacaatggagatctcaacaaactttttggattacttgctatgtcactgcaatctcttatcacaaagggtcttgtggagagcgaaaagctagactccttcaatttaccattttatgggccatcaatttctgaagtgaagtatatagtaatgcaaagccacatgtttgaattggatcatatcaaactatttgaaataaactgggatccttatgatgatacagaaggtgatgatgttcatgacagtgtctgcagtggcatcaatgtttctaagtttattagagcagcgctggaacctatgattgcacgccattttggggaaaccatacttgacacattgttcacggagtatgcatttttttgtctccaagcacctccagaaggagaagacgaagtttgcgataatcaccatgtccttgacgaaggtgtagtaggaacaaattaatgggatcaatcagattgcactcttccagataccatattgtgacgtcttgctatacatattttattttcattagtgtgtgtctacgggttaattgtcgtcagagtgtctatatctctttgctgtatgcatcctggttgtcgtgagtgac

SEQ ID NO: 11845 - protein, 317 aa, Panicum virgatum
  misc_feature: Ceres CLONE 1756953
  misc_feature (1)..(312): Pfam Name: Methyltransf_7 Pfam Description: SAM dependent carboxyl methyltransferase
  misc_feature: SWISSPROT Homolog: EC 2.1.1.141 Jasmonate O-methyltransferase
LNSSLHTCSCRASLETRELTQGGTPWKVNSAANALIVSFLGNDFNQVFRSLENLEKGTSDQKGNTPLFYHISGLPKSYYNRLLPRESVHLFHSSSSLHWRSQVPEVLEASRDALLNKDNIYISEASTSFVVKCFREQFNKDFSTFLKLRHEELVYGGKMVLTFCGRKDENVYNGDLNKLFGLLAMSLQSLITKGLVESEKLDSFNLPFYGPSISEVKYIVMQSHMFELDHIKLFEINWDPYDDTEGDDVHDSVCSGINVSKFIRAALEPMIARHFGETILDTLFTEYAFFCLQAPPEGEDEVCDNHHVLDEGVVGTN

SEQ ID NO: 11846 - DNA, 1516 bp, Panicum virgatum
  misc_feature: Ceres CLONE 1757023
  misc_feature: Encodes the peptide sequence at SEQ ID NO. 11847
atcgccacggtctcctctcccccactgccccgcttccagaagcttcggcgctccgccatgcgtcccgccgtcctcgcagcgctcctcgtcgccgccgcggccgcctccccggccgccgcgctctactcggcgggctccgccgtcctccagctcaaccccaacaacttcaaatccaaggtgctgaactcgaacggggtggtgctggttgagttcttcgcgccgtggtgcgggcactgcaagcagctggcccccgcctgggagaaggccgccggcgtgctcaagggcgttgcgacggtcgccgccctcgacgccgacgcgcaccaggctctcgcgcaggaatatggaatcaggggatttccaactaaggtgtttgtccctggtaaacctccagttgattatcaaggagcaagagatgtaaagccaattgtagaatttgctttgtctcaggtcaaggcccttcttagagatagattgaatggtaaggcatcaggagggtcaagtggcaaggcatctggaggttcaagcgagaaaaatgaaccaagtgcatcagtagaactaaattcacgtaattttgatgaacttgtcgtcaaaagcaaggacctttggattgtggaattctatgcaccatggtgtgggcactgtaagaaattagcacctgaatggaaaaaggctgcgaagaagttgaagggccaagtgaagctagggcatgttgattgtgatgctgaaaagtccttgatgagcaagtacaaggttgaaggcttcccgactattttggtatttggtgctgataagaagagcccattcccgtaccagggggctagagttgcatctgccattgagtcctttgcattggaacagttggaagccaactctggtccagctgaagtttctgagttgactggcccggatgtcatgggggagaagtgcgcttctgctgccatttgctttgtatcattccttccagacatcctggattcaaaggcagaaggaagaaacaagtaccttgagctccttctttctgttgctgagaagttcaaaaagagtccatacagttttgtctggacagctgctaccaagcaacctgatctcgagaaccaggttggagttggtggctatggctatcccgccatggttgctctcaacgtgaagaaaggcgcatacgcaccactccgtagtgccttccagcatgatgaaatcatcgagtttgtgaaggaagcagggcgtggtggaaagggaaatcttcctctcaacggtgccccgacagtagtaccgtcggagccatgggacggcaacgatggagaggaaattgtggaggatgaattctcccttgacgagctcatgggcgatagctccccagtaaacgatgagttgtgattctaatgatttttgtaaatgatctgtcatgagcgtgccgattagccaggctgtaaatctgaggaactctgattacttgtttccggtgaacggcacagttttagtgtgcttattttcagtttttggatgctagaatggtttt

SEQ ID NO: 11847 - protein, 438 aa, Panicum virgatum
  misc_feature: Ceres CLONE 1757023
  misc_feature (163)..(267): Pfam Name: Thioredoxin Pfam Description: Thioredoxin
  misc_feature (28)..(130): Pfam Name: Thioredoxin Pfam Description: Thioredoxin
  misc_feature: SWISSPROT Homolog: EC 5.3.4.1 Protein disulfide-isomerase
MRPAVLAALLVAAAAASPAAALYSAGSAVLQLNPNNFKSKVLNSNGVVLVEFFAPWCGHCKQLAPAWEKAAGVLKGVATVAALDADAHQALAQEYGIRGFPTKVFVPGKPPVDYQGARDVKPIVEFALSQVKALLRDRLNGKASGGSSGKASGGSSEKNEPSASVELNSRNFDELVVKSKDLWIVEFYAPWCGHCKKLAPEWKKAAKKLKGQVKLGHVDCDAEKSLMSKYKVEGFPTILVFGADKKSPFPYQGARVASAIESFALEQLEANSGPAEVSELTGPDVMGEKCASAAICFVSFLPDILDSKAEGRNKYLELLLSVAEKFKKSPYSFVWTAATKQPDLENQVGVGGYGYPAMVALNVKKGAYAPLRSAFQHDEIIEFVKEAGRGGKGNLPLNGAPTVVPSEPWDGNDGEEIVEDEFSLDELMGDSSPVNDEL

SEQ ID NO: 11848 - DNA, 502 bp, Panicum virgatum
  misc_feature: Ceres CLONE 1757045
  misc_feature: Encodes the peptide sequence at SEQ ID NO. 11849
aagagttcttctgctgctacccgctccggtcgcgggccgcggcggcggcgggttcttctgctgctacctgctccggtccctgtgcccccgcagcaggagccccccctacctcgggttcccggtgaacccgcggcggcggatcccccagcacaacggcgagatcgccagcggcgcgtggcggacccgccgcggccggccctgggagatggttctctgcatccacggcttcccctcccacgtcgccgcgctccagttcgagtgggcgtggcaacatcccatagaatccctcgccgtgcgcaaggccgccgccgagttcaagtcgctcggcggcatcggcaacaaggtcaagctcgcctacaccatgctcaacctcccctcatgggagaacttgaacctgacggtgaatttcttctccccgaagaacatcaagttcaccgctggctgcctgtcgctgccgacccagatgaagaccgtcgtctgcgcgatggaggatctgcagtgc

SEQ ID NO: 11849 - protein, 166 aa, Panicum virgatum
  misc_feature: Ceres CLONE 1757045
  misc_feature (18)..(103): Pfam Name: GIY-YIG Pfam Description: GIY-YIG catalytic domain
RVLLLLPAPVAGRGGGGFFCCYLLRSLCPRSRSPPYLGFPVNPRRRIPQHNGEIASGAWRTRRGRPWEMVLCIHGFPSHVAALQFEWAWQHPIESLAVRKAAAEFKSLGGIGNKVKLAYTMLNLPSWENLNLTVNFFSPKNIKFTAGCLSLPTQMKTVVCAMEDLQ

SEQ ID NO: 11850 - DNA, 1125 bp, Panicum virgatum
  misc_feature: Ceres CLONE 1757061
  misc_feature: Encodes the peptide sequence at SEQ ID NO. 11851
gaaaaataaataacgaggaaaaataataataagaaaacactccccgtgttcttcgaccggaggtggtggtggtgcgaacgcgaggcgaccgaggagggaagacgcgatgagggggacgaagcggccgctcggcgcggtgacgtcgtggatgcggcggcagccgcccaaggtgaaggccttcctggccgtggtcaccggcatggctgcgctcgtcttcatccgcttcatcgtccacgaccacgacaacctcttcgtcgccgccgaggccgcgcacgcgctcggcatcggcgtccttatctacaagctcaccaaggagaagacctgcgccggactatccctcaagtctcaggatttaactgctttgttcctagctgttagactgtactgcagctttgtcatggagtatgacatccatacaattctggacactgccacacttgtagccacactgtttgttatttacatgatacggtttaaactgaggtcaacttatatggtggacaaggataattttgcattgtactatgtggtggtaccttgtgctgcactggcactacttattcatccttcgacatcacacaacattgtgaaccgggtctcctgggcattctgtgtttacttggaagctgtttccgtgctgccacaattacgcttgatgcaaaatactaagattgttgaaccgtttacagctcattatgtatttgcgttgggggtcgcaaggtttcttagctgtgcccactgggttctacaggttttggacacgcgtggccgtctgttgacagctctcggctatggtttgtggccatctatggtgcttctgtcagaaatcgtgcagacattcatccttgcggatttctgctactactatgtgaagagtctggttggtgggcaactggtgctacggcttccctcgggggtggtataaggagttgagcaggctacaaaacttcgtggttcacccattcttatgtaccctgaaaaacagttatgctctagcccccgacctgtgtctcgtatctaatgtgagaccggagcctcttttagttgatgttacaggttgtgactatttatgacaaaaattgctgcgagggtcctcttaaaagataggctgcaattgagactgtt

SEQ ID NO: 11851 - protein, 272 aa, Panicum virgatum
  misc_feature: Ceres CLONE 1757061
  misc_feature (47)..(258): Pfam Name: ER_lumen_recept Pfam Description: ER lumen protein retaining receptor
MRGTKRPLGAVTSWMRRQPPKVKAFLAVVTGMAALVFIRFIVHDHDNLFVAAEAAHALGIGVLIYKLTKEKTCAGLSLKSQDLTALFLAVRLYCSFVMEYDIHTILDTATLVATLFVIYMIRFKLRSTYMVDKDNFALYYVVVPCAALALLIHPSTSHNIVNRVSWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 11852 - DNA, 1172 bp, Panicum virgatum
  misc_feature: Ceres CLONE 1757067
  misc_feature: Encodes the peptide sequence at SEQ ID NO. 11853
gctagtttttagctcattaatttcgattcccttcgttccctgggtacatagatagatagatctgaacatatcaaacaattttccgccgctcgctttcagccgaaaacaaccatggctgctgctgtcaagcagaagcaggccgcctccgtggcgctagtcttcctcctcgccgtgttggtcgcgccgcctccggccgccgtggtagcggcggacggcgacggcacgacgcacctgagcttcttcatgcacgacatcgtgtcgggcagcgacccgactagggtgcaggtgatcaagggccccgggtcggcagtgacggccccggcgctgggcatgtccttcggcgacacggccgtgatggacgacgcgctgacggagacctcgtcgccgggctcggcggcgctggggcggatgcagggcatctacatgctgtcgtcgcagtcgggcgcggcgctgatggtgtgcgccaacctggtgctgacctcgggcgaccacaacggcagcaccatcgccgtgctggggcgcgacgacacggccgccgacgtgcgggagctcgccgtcgtgggcggcaccggcaagtacaggatggccaacgggtacgtgctgtggaagacgaccagcatgaagggcgccgacgccaccacccagctcgacgtctacctcaccaccggcaacgccaccaccatcgacgccgcggcgcccgtctcgcccgctggcggcggcggcgggtcctctgggtccaagtcgagctcgggtgctggcgcgaggagggccggcggcgggtgggtgagggcgtgcgccgtcgccgtggtggttgcggtggttagatcgtcctggggttggtgagcagcggatggattgacaacggacgagtggtggacattgctttgcttgcgttgcgttagtgggtgagtgtgtggaaggaaagttgggtgagatgccgtccgtgcagtgggggttggtcgaggagtgagatgcttgttgccacctgcctgcatgtgctttgcacgctgctgcatcatgacctgcctgcctagctcatttcttttcccctacccccttactatactaccccaccacgatgcacgcatgtggattattcttgctttctactgatcgatgaggctttctttctttctttctttctttctttggatggaatcggttgataatcc

SEQ ID NO: 11853 - protein, 243 aa, Panicum virgatum
  misc_feature: Ceres CLONE 1757067
  misc_feature (13)..(185): Pfam Name: Dirigent Pfam Description: Dirigent-like protein
MAAAVKQKQAASVALVFLLAVLVAPPPAAVVAADGDGTTHLSFFMHDIVSGSDPTRVQVIKGPGSAVTAPALGMSFGDTAVMDDALTETSSPGSAALGRMQGIYMLSSQSGAALMVCANLVLTSGDHNGSTIAVLGRDDTAADVRELAVVGGTGKYRMANGYVLWKTTSMKGADATTQLDVYLTTGNATTIDAAAPVSPAGGGGGSSGSKSSSGAGARRAGGGWVRACAVAVVVAVVRSSWGW

SEQ ID NO: 11854 - DNA, 1062 bp, Panicum virgatum
  misc_feature: Ceres CLONE 1757198
  misc_feature: Encodes the peptide sequence at SEQ ID NO. 11855
atctggccgctatccttctccacgaacgatggcagtcgcccaggccgcagcggtcgccgcgccggtggtggctgcggcgtcagcgcacgccgccgcctgcgtttccgccgcgtgccgccggggcacctcgcgctgggcattgccgtcccggccgccggtcgggacgacggccgggttcaggtggctatggcggcgcgcgccgacccgggcacagccgcggcgcgcgtcgcgggccaccggccgcggccgcggccgcggccacgtggtcggggccgagttcggcgggacgtacgaggacggattcgaggacgtgcacaagaacatcatcaactacttcacctacaaggccacgcacactgtcctccatcagctctacgagatgaacccgccgtcctacacttggctctacaactacgttctcgtcaacgatccattagatggcgattatttccttcgtctgctcgcgaaggagaggcgggacctggccgagagagtgatgatcacacgccttcacctgtatggcaaatggatcaagaagtgcgaccatgcgatgatgtacgagcggatctccaaagagaacctggatatcatgcgccagatactgctggagacggtggtctggccgaccgatgacaccagcgccggcgagtccaagggttaacggcgagattggagctcgcgccgagcaacgagtatgactgcttcactcgacagggtgttgtgttcattctcttcaggggttggatttgacctgcgcatttctgtatactacagccctgccctgcatggatacaacagaacaccgatgtatattctcttctaggggtttgtggtttagtcattagtggagtggaccctttttgtcctcacaacacaactcagcaaagcatcttccaggggtttatggtttagtcattagtggaatggaccatttttgtcctcacaatacaactcagcaaagcatcgtaacaatgggtatttctttgttttttctttttctttttgaagacctggatattttgtcttgtgcctagatttcaagatgaaggtacaagttccccc

SEQ ID NO: 11855 - protein, 210 aa, Panicum virgatum
  misc_feature: Ceres CLONE 1757198
  misc_feature (97)..(210): Pfam Name: RcbX Pfam Description: RbcX protein
MAVAQAAAVAAPVVAAASAHAAACVSAACRRGTSRWALPSRPPVGTTAGFRWLWRRAPTRAQPRRASRATGRGRGRGHVVGAEFGGTYEDGFEDVHKNIINYFTYKATHTVLHQLYEMNPPSYTWLYNYVLVNDPLDGDYFLRLLAKERRDLAERVMITRLHLYGKWIKKCDHAMMYERISKENLDIMRQILLETVVWPTDDTSAGESKG

SEQ ID NO: 11856 - DNA, 1011 bp, Panicum virgatum
  misc_feature: Ceres CLONE 1757212
  misc_feature: Encodes the peptide sequence at SEQ ID NO. 11857
gaaatctccagcctgcgccgcctgatcccagagctcgtcgcctctttctcctcagctccacacctcgctcgccctcgcgcgcgccggacgcaccagccgcagagatggccgccctcgccgcctcctccacggccgccttcgccgccaagccgtgcctgccccgcacgcgcctctccgtggcctgctccgcgaccggcagccccggcagcagcagcagcagcaatgtctcgctcgcctcctccgtcaagaccttctcggccgcgctggcgctgtcgtcggtgctcctctcctcggccgccacctcccctccgcccgcggccgccgacatcgccggcctcaccccgtgtaaggagtccaaggcgttcgccaagcgcgagaagaactcgatcaagaagctcaccgcctctctcaacaagtacgcccccgacagcgcccccgcgctcgccatcaacgccaccatcgagaagaccaagcgccgcttcgagaactacggcaagttcggcctgctctgcggcgccgacggcctgccacacctcatcgtcagcggcgaccagcggcactggggcgagttcatcaccccgggcctgctcttcctctacatcgccgggtggatcgggtgggtcggcaggagctacctcatcgccatcagcggcgagaagaagcccgccatgagggagatcatcatcgacgtcgagctcgccacaaggctcctccccagggggttcatctggcccgtcgcagcctaccgcgagctcatcaacggagacctcgtcgtcgacgacaaggacatcggctactactaagctagcgcacctgcatggctgctggcgaccggcgagttgggcagcgactgcgtcggggaagatggcttgtggtgtaggagctgataggatgatgggggaatggaagctctgctgtacttaagaaactggacgaagccttgtataactgtacctctcgatctcttgtgtgtattcaccttcttgaaaattcttgagaacgatttcattc

SEQ ID NO: 11857 - protein, 232 aa, Panicum virgatum
  misc_feature: Ceres CLONE 1757212
  misc_feature (49)..(227): Pfam Name: PSI_PsaF Pfam Description: Photosystem I reaction centre subunit III
MAALAASSTAAFAAKPCLPRTRLSVACSATGSPGSSSSSNVSLASSVKTFSAALALSSVLLSSAATSPPPAAADIAGLTPCKESKAFAKREKNSIKKLTASLNKYAPDSAPALAINATIEKTKRRFENYGKFGLLCGADGLPHLIVSGDQRHWGEFITPGLLFLYIAGWIGWVGRSYLIAISGEKKPAMREIIIDVELATRLLPRGFIWPVAAYRELINGDLVVDDKDIGYY

SEQ ID NO: 11858 - DNA, 1038 bp, Panicum virgatum
  misc_feature: Ceres CLONE 1757266
  misc_feature: Encodes the peptide sequence at SEQ ID NO. 11859
acgcggaaaacaacaagactcggggggtaaagcgagggaggggaggcgacgcggacgaggcccgattccgatccccggtctcccgatccgcgcgtccggttcaagcagcaatggcatcatcttcggacccatgggtgaaagagtacaatgaagcatccaggcttgctgatgacatcagttccatgattgctgatagaggatctcttccgcaatcaggcccagaaattatgcggcatacttcagccatccggagaaaaataactattcttgggactagactggatagcttggagtcattgctggccagaattcctccaaagtcaatcactgacaaggagatgcataagcgccaagacatgctttccaatttgaagtctaaagcaaaacagatggcgacaagtttcaacatgtcaaactttgctaacagggaggatcttcttggacagagtaaaaaggcagatgatataagcagagttgctggcttagacaaccaaggaattgttggccttcagagacaaattatgaaagagcaagatgagggccttgagaagctggaagagacagtgctgagcacaaagcatattgccttagcagtcaatgaagaacttaccctgcacacacgattgatagatgaccttgaagatcatgttgatgttacaaactcgcgtcttcagcgtgtgcaaaagagacttgcaattctgaacaagcgcaccaaaggtggctgctcgtgcatgtgcctgctgttgtcggttgttgccattgtgatcctcgtggtcattgcttggcttatcgtcaagtacgcgtaaataaaagaaagaagctgccaggtaccctgcggccttcgcctggaatgcccccttgtgtgttactcgatcgaaatgtgcagtgtttgaaaaaatatatatacggtggtttcagtcggttgtttcctttcatgagttaagcaacatgtacattacatcgaatgaggctcagtcacgatcattaatctgtgtatgagattgccacatcctatgtgtgtggcgtttgtcagtttgc

SEQ ID NO: 11859 - protein, 231 aa, Panicum virgatum
  misc_feature: Ceres CLONE 1757266
  misc_feature (140)..(202): Pfam Name: SNARE Pfam Description: SNARE domain
MASSSDPWVKEYNEASRLADDISSMIADRGSLPQSGPEIMRHTSAIRRKITILGTRLDSLESLLARIPPKSITDKEMHKRQDMLSNLKSKAKQMATSFNMSNFANREDLLGQSKKADDISRVAGLDNQGIVGLQRQIMKEQDEGLEKLEETVLSTKHIALAVNEELTLHTRLIDDLEDHVDVTNSRLQRVQKRLAILNKRTKGGCSCMCLLLSVVAIVILVVIAWLIVKYA

SEQ ID NO: 11860 - DNA, 1208 bp, Panicum virgatum
  misc_feature: Ceres CLONE 1757308
  misc_feature: Encodes the peptide sequence at SEQ ID NO. 11861
aaaaacctcaggctccaatccctcccttccttatcccctcccccatccctgccgctcctcccctcgccatggccaccaccaccatgtcgctccgctccctcgccatggccatggccgacgccgcgctcccgccggcgcacaagctgctccccgccgtccccctcccgctgctctcctcctccacccgcgccgcgccgctcctcctccgcgccacccgccgcctgccgctcgcgccgctcgtcgcctcctccgacgccgtcgaggcgggcgtcgagtgggccaacgacgaggaggaggtggtgggagaggccttcgacgaggaggttgtggaggccgaggacgaggtgctggcctcgggcgacgaggaggaggagggtggggacggcgagggggagtacgccgcggtcgagccgcccgaggaggccaaggtctacgtcgggaacctcccctacgacgtcgacagcgagggcctcgcccagctctttgaccaggccggcgtcgtcgaggtcgccgaggtcatctacaacagagagtctggccagagccgtgggtttggtttcgttaccatgagcaccattgaagaagctgacaaggccattgaaatgttcaaccgctatgacattagtgggaggcttctgaatgtaaacagggcatctcctaggggcactcgcatggagagacctcctagacaatttgcatctgctttcagagcttatgttggcaacctgccatggcaagtcgatgactctaggctggtgcagttgttcagtgagcatggagaagttgttaatgctacagttgtctatgatagagaaactggacgctcacgaggatttggttttgtaaccatggcaacaaaggatgaacttgacgatgccatttccgccctcgacgggcaggaattggatggccgcccacttcgggtgaatgttgcagcggagcggccccagaggggcttttgatgctgcgatatgagagagatggctgcttgttagtaatgagcatggagatacaacagaggagcaatgggacgcttttgcgggagctgatgccaagttgctagatatcctccctttgcttcctgttgtttggttcttgccacacggcttttgatgctgctatttgctgctgatgttaatgtcttaatatttgttgacaccactagttatatttttcaagtaggctactatcctgatgtggtgatgcat

SEQ ID NO: 11861 - protein, 297 aa, Panicum virgatum
  misc_feature: Ceres CLONE 1757308
  misc_feature (215)..(286): Pfam Name: RRM_1 Pfam Description: RNA recognition motif. (a.k.a. RRM, RBD, or RNP domain)
  misc_feature (121)..(192): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 22 in US patent 7244875
  misc_feature: Useful for making plants with altered alkaloid content
MATTTMSLRSLAMAMADAALPPAHKLLPAVPLPLLSSSTRAAPLLLRATRRLPLAPLVASSDAVEAGVEWANDEEEVVGEAFDEEVVEAEDEVLASGDEEEEGGDGEGEYAAVEPPEEAKVYVGNLPYDVDSEGLAQLFDQAGVVEVAEVIYNRESGQSRGFGFVTMSTIEEADKAIEMFNRYDISGRLLNVNRASPRGTRMERPPRQFASAFRAYVGNLPWQVDDSRLVQLFSEHGEVVNATVVYDRETGRSRGFGFVTMATKDELDDAISALDGQELDGRPLRVNVAAERPQRGF

SEQ ID NO: 11862 - DNA, 1411 bp, Panicum virgatum
  misc_feature: Ceres CLONE 1757389
  misc_feature: Encodes the peptide sequence at SEQ ID NO. 11863
cacacaaggtaggaactttgctctctctctctctctctctctctctctctctcaccgcacatgcgcgtcgggccgcgtcgccaccaccccagccgcccgccgacacccgagatggccgccgccgccgcccacgcgccgccggggcgccggggcgcactccttgtcctgctcgccgccgcgctcgtcgcggcgatgccggccacctgcgccgcggccaggagcaggaagtcgtaccgggccatcttcagcttcggcgactcgctctccgacgccggcaacctcatcgtcaacggcacgcccaaggcgctcaccaccgcgcgcccgccctacgggatgaccttcttccgcaagcccaccggccgctgctccaacggccgcctcgtcgtcgacttcctcgccgagcacttcgggctgccgctgccgccgccgtcgcaggcgcaggggaaggacttcaggaagggcgccaacttcgccatcaccggcgcgacggctctggagtactccttcttcaaggcgcacggcatcgaccagcgcatctggaacactggttccatcaacactcagatcgggtggctccagaacatgaagccgtcactctgcaaatcggagaaagactgcaaggactacctcagcaagtccctgtttgtggtgggggagtttgggggcaatgactacaacgcgccgctcttctccggtgtcccattttctgatgtcaagacttatgtgccccttgtggccaaggccatcgccaatggcgttgagaaattgatcgagcttggggcaacagatttgttggtgccaggcattctaccgatcggttgcttcccgttgtacctcacgttatacaacaccagcaggaaatcagactacaacgcccgcactgggtgcctccggaggtataaccgcctcgccttccaccacaacagggagctgaagcagcagcttgatgagctacagaagaagtaccccaatacaaaaatcatgtatggggattacttcaaggcagcaatgcagtttgtcgtctaccctggaaaatttggtttcagcacagctttgcaagcttgctgcggcgctggaggtcagggcaactacaacttcaacctgaagaagaagtgcggtgagcaaggtgcaagtgtgtgctctaacccatcatcatacgtgagctgggacggcatccacatgaccgaagccgcatacaaaagggtcgctgatggctggttgaatggcccctacgctgatcccccaattctgaagtcataattgagataattaaactgtatgtaacacaattgtggctgccgccgctgctagagagatatatggagtccttcaggcatagatatgttccgattctaaagtcataattaagttatgggtaaagctttttagtttgttcattgaagatttgtat

SEQ ID NO: 11863 - protein, 382 aa, Panicum virgatum
  misc_feature: Ceres CLONE 1757389
  misc_feature (44)..(369): Pfam Name: Lipase_GDSL Pfam Description: GDSL-like Lipase/Acylhydrolase
  misc_feature: SWISSPROT Homolog: EC 3.2.1.51 Alpha-L-fucosidase
MAAAAAHAPPGRRGALLVLLAAALVAAMPATCAAARSRKSYRAIFSFGDSLSDAGNLIVNGTPKALTTARPPYGMTFFRKPTGRCSNGRLVVDFLAEHFGLPLPPPSQAQGKDFRKGANFAITGATALEYSFFKAHGIDQRIWNTGSINTQIGWLQNMKPSLCKSEKDCKDYLSKSLFVVGEFGGNDYNAPLFSGVPFSDVKTYVPLVAKAIANGVEKLIELGATDLLVPGILPIGCFPLYLTLYNTSRKSDYNARTGCLRRYNRLAFHHNRELKQQLDELQKKYPNTKIMYGDYFKAAMQFVVYPGKFGFSTALQACCGAGGQGNYNFNLKKKCGEQGASVCSNPSSYVSWDGIHMTEAAYKRVADGWLNGPYADPPILKS

SEQ ID NO: 11864 - DNA, 1164 bp, Panicum virgatum
  misc_feature: Ceres CLONE 1757402
  misc_feature: Encodes the peptide sequence at SEQ ID NO. 11865
agcccggaccacacaagcctcaccgcacctggcgtggtaactggtaacttgcctcatggcgatctccggcgaggagaggcacgcgcccgctggaggcgactccggcggcgggaagctctggaacctctgccgtatgcccttccggcaggcgggcggggcgccggcgccggcgacaccgcagtcgtcctcgtccgggatccaccactccgctggccggtacggccacgaggcgcccgtcgctggggacggaggcgcgcagggggcgtcggcgggatcgatctcgtccgtggccaagtcgctgctgcctgcccgccgccgcctcaggctcgatccggccaataagctctacttcccatatgaaccaggaaagcaggtcaaaagtgcaattaggataaagaatacaagcaagtctcatgtagcatttaagtttcaaacaactgcacccaagagttgcttcatgcgccctcctggagctgtcctcgcccccggggagactgttatagcaactgtttttaagtttgtggagcacccagagaataatgagaatattctacagaagtgcaaggtcaaattcaagattttgagcttgaaggtgaagggacaaatggaatatgcaccagaactgtttgatgaacagaaggatcaagctgttgttgagaagatcctgaaggttgttttcttggatataaacggtcaaagccctcaactggaaaagctcaataaccaattagctgaggcagaagctgcacttgaggcacggaagaaacctccagaagaaaatggcccaaaaattgttggtgaagggcttgtcattgatgaatggaaaaagcggagggaaagatacctcgcgcaacagcaggttgaagtagtcgattcggtgtaaattgtaccctctgctgctccgcaacctatgcacatggcttcgacaaggcctgtgacattctgtaaactcttaggttttgctgtagtgtagtgtatgttgtagtctagggttgtgcttgcaggatcagtcccaaaggacaagctaacctccagtgttatcggtacttctcatgtaattgtgttaacaaatgtgttgggtgctagtgctggatgcgtttgtttgtcggaacaaaataaagcttataattgttggcatcagaacatgttggagtgccatgttgg

SEQ ID NO: 11865 - protein, 275 aa, Panicum virgatum
  misc_feature: Ceres CLONE 1757402
  misc_feature (88)..(200): Pfam Name: Motile_Sperm Pfam Description: MSP (Major sperm protein) domain
MAISGEERHAPAGGDSGGGKLWNLCRMPFRQAGGAPAPATPQSSSSGIHHSAGRYGHEAPVAGDGGAQGASAGSISSVAKSLLPARRRLRLDPANKLYFPYEPGKQVKSAIRIKNTSKSHVAFKFQTTAPKSCFMRPPGAVLAPGETVIATVFKFVEHPENNENILQKCKVKFKILSLKVKGQMEYAPELFDEQKDQAVVEKILKVVFLDINGQSPQLEKLNNQLAEAEAALEARKKPPEENGPKIVGEGLVIDEWKKRRERYLAQQQVEVVDSV

SEQ ID NO: 11866 - DNA, 1185 bp, Panicum virgatum
  misc_feature: Ceres CLONE 1757403
  misc_feature: Encodes the peptide sequence at SEQ ID NO. 11867
aaacacttgtccgctaagaacttgctgtgttccgaaggaagctccagaaacagttcattacctgctgctgaaagtgcttaaactgttaatgatgatgtgttgatgtgccgtggagtgccgacggcctgacgtggcgcccgccacgctggatgacacctggcgccacgtcacccgcacgcgaacccgggccgctgctctgctcctataaatattctttgtccgctgccccttgcctgcacgctgcatttctcgaacccattaaacaaagacaaaggccaagcctccgcgtccctccagatctcagatccgaagagctccggcccttctccaatggcggtcaaggtctacgtcgtgttctactccacttacgggcatgttgccaagctatctgaggagatcaagaaaggtgctgcctctgtcgaaggcgtggaggtgaagatatggcaggtccctgagattctgtccgatgaggtgcttggcaagatgggcgcgcccccgaagacggacgcgccgatcatcacgccgcaggagctcgcggaggcggacgggatcctcttcgggttccccacgcgcttcggcatgatggccgcgcagatgaaggccttcttcgacgccaccggcggcctgtggcgggagcagagcctggcgggcaagcccgccggcatcttctacagcaccggcacccagggcggcgggcaggagaccacgccgctgacagcggtgacgcagctgacgcaccacgggatggtgttcgtgccggtggggtacacgttcggcgccaagatgttcggcatggacagcgtgcagggcggcagcccgtacggcgccggcacgttcgccggggacggctcgcggtggcccacggaggcggagctggagcacgccttccaccagggcaagtacttcgccggcatcgccaagaggctcaagggcggctccgcctgatctcgctcgcgcgccatccatcatcaccggcggcggcgtggcgaaccggcgatcgccatgcgtggccgtgcccatgctcgcgcgtagctgcgcctacatagttacacatcctgtgcggctgtgcccccatctacaaatagcttgttcttgtggatctcgttcgccactctataggacagcgtgtgatttgccggtcttattgtggtcttgactgctcgtggattggatttggtgggatcg

SEQ ID NO: 11867 - protein, 204 aa, Panicum virgatum
  misc_feature: Ceres CLONE 1757403
  misc_feature (7)..(138): Pfam Name: Flavodoxin_1 Pfam Description: Flavodoxin
MAVKVYVVFYSTYGHVAKLSEEIKKGAASVEGVEVKIWQVPEILSDEVLGKMGAPPKTDAPIITPQELAEADGILFGFPTRFGMMAAQMKAFFDATGGLWREQSLAGKPAGIFYSTGTQGGGQETTPLTAVTQLTHHGMVFVPVGYTFGAKMFGMDSVQGGSPYGAGTFAGDGSRWPTEAELEHAFHQGKYFAGIAKRLKGGSA

SEQ ID NO: 11868 - DNA, 1306 bp, Panicum virgatum
  misc_feature: Ceres CLONE 1757415
  misc_feature: Encodes the peptide sequence at SEQ ID NO. 11869
accaagcattagctagcgacgcgcgaaaaagaagaaaaaaaaattggactgctgcagccgcagccgcagccgccgcccgaggaagcataagcaaggacgagcggaggcaaggcaaaggcaaaggcagaaggagatggaagcgcgaggaggaaggggatcgtcgccggcgggcggggcagcgcggctgcgggtggctctggtgtgggtgctgctgctggcggcggcggcggggtcgcgggcgcagctgcaggtggggttctacgacacgctgtgcccggcggcggagatcatcgtgcaggaggaggtcagcaaggcggtgtccgggaaccccggcgtcgccgccagcctcgtccgcctccacttccacgactgcttcgtcaggggctgcgacgcgtccgttctgctggactcgacgccgggcaacacggcggagaaggacgcgcccccgaacacgagcctccgcggcttcgaggtcatcgacagcgccaagacgcggctggagcaggcctgcttcggcgtcgtctcctgcgccgacgtgctcgccttcgccgccagggacgccctcgcgctggtcggaggcaacgcgtaccaggtgccctcggggcgacgggacggcaacgtctcggtggcgcaggaaaccaacggcaacctgcctcccccgacggcgagcgtgagccagctgaaccagatcttcggcagcaagggcctgagccaggcggacatggtgaccctctccggcgcgcacaccatcgggagcgcgcactgcagctcgttcgacagccggctctactcgtacgggcccaacgccgcggggcaggaccccagcatggaccccgtgacgcccaccgccttggacaccaactactacgcctccatcgtggccaagcgcggcctgctggcctccgaccaggcgctcctcgccgaccccaccaccgccgcgcaggtggtcgcgtacaccaacagccccgacacgttccagaccgacttcgccgccgccatggtcaagatgggcgccatcggcgtgctcaccggcaccgccggcaccatccgggccaactgccgggtcgccaactgatctatccctgatccgtccgaccatcggtggtcacttgattgggtggccgggctgtgtgattaagatgtatgtaacgacgacgtagagtgttggtctgctgctgctgctgctgatgattcaatggtgttagttgtgtaagaagagtaagacgtagagtgttgagctcctcttttttttatttacatttttttgttctcttcttttttatactttttatttatggttttgatg

SEQ ID NO: 11869 - protein, 313 aa, Panicum virgatum
  misc_feature: Ceres CLONE 1757415
  misc_feature (54)..(277): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MEARGGRGSSPAGGAARLRVALVWVLLLAAAAGSRAQLQVGFYDTLCPAAEIIVQEEVSKAVSGNPGVAASLVRLHFHDCFVRGCDASVLLDSTPGNTAEKDAPPNTSLRGFEVIDSAKTRLEQACFGVVSCADVLAFAARDALALVGGNAYQVPSGRRDGNVSVAQETNGNLPPPTASVSQLNQIFGSKGLSQADMVTLSGAHTIGSAHCSSFDSRLYSYGPNAAGQDPSMDPVTPTALDTNYYASIVAKRGLLASDQALLADPTTAAQVVAYTNSPDTFQTDFAAAMVKMGAIGVLTGTAGTIRANCRVAN

SEQ ID NO: 11870 - DNA, 840 bp, Panicum virgatum
  misc_feature: Ceres CLONE 1757482
  misc_feature: Encodes the peptide sequence at SEQ ID NO. 11871
gcgcttgcttcatatcgtcctcgtctgctagctccgtccatccagccgtctcggggcagccacgagatcgcgagcggcgtagatctacgcgtcaggggatgaagattaccgcgcttctggtgctgaagccgtcgacctccggcgccgggagctcctcgtcaggcggcgggtcgggcccggaggcggtggtgctcgcgaacgcgacggacgtgagccacttcggctacttccagcgcggcgccgcccgcgagttcatcgtcttcgtcgcccgaaccgtcgcgcagcgcacccagcctggccagcgtcagtccgtccagcacgaagaatataaggtccattcacacaacagaaatggtctttgtgcggtggcattcatggacgatcactatcctgtacggagtgcattttctcttctgaataaggttcttgatgagtaccagaaggattttggggactcctggaaatctgctactgcagatggaactcaacagtggcctttcctcacggatgctttgacaaaatttcaggaccctgcagaagctgacaaattaatgaaaatccagagggacttggatgaaacaaaaatcatcctacataaaactattgagagtgtccttgccaggggagagagactggatagcttggttgagaaaagctctgacctgagcgctgcttcacagatgttctacaagcaggcaaagaagacaaaccagtgttgcactatactttgaactccgccgcatgtatcgttgttgcaaagtgccagcaatctcttttattccttctatttttcagagacaaaaggatctatattgtacgaatttactgtgagttaatttc

SEQ ID NO: 11871 - protein, 210 aa, Panicum virgatum
  misc_feature: Ceres CLONE 1757482
  misc_feature (114)..(200): Pfam Name: Synaptobrevin Pfam Description: Synaptobrevin
MKITALLVLKPSTSGAGSSSSGGGSGPEAVVLANATDVSHFGYFQRGAAREFIVFVARTVAQRTQPGQRQSVQHEEYKVHSHNRNGLCAVAFMDDHYPVRSAFSLLNKVLDEYQKDFGDSWKSATADGTQQWPFLTDALTKFQDPAEADKLMKIQRDLDETKIILHKTIESVLARGERLDSLVEKSSDLSAASQMFYKQAKKTNQCCTIL

SEQ ID NO: 11872 - DNA, 1447 bp, Panicum virgatum
  misc_feature: Ceres CLONE 1757621
  misc_feature: Encodes the peptide sequence at SEQ ID NO. 11873
aaccgccgccgcccctccgcttcccaccaaaaaccctagccattcccggtcgcatcgccgccgcccgccaccgacgatgcctcccaaggcgaagaaggacgccgcgccggccgagcgccccatcctcggccgcttctcctcccacctcaagatcgggatcgttgggttgccgaatgttggcaaatcaactttcttcaacatagtaacaaagctcgcaatcccagctgagaacttccctttctgtaccattgaaccaaatgaggcacgtgtgaatgttccagatgagcgatttgactggctttgccaactttacaagccaaagagtgaggtgcctgcatatctggaaataactgacatagctgggcttattagaggagctcatgcaggggatggtttgggcaatgcgtttctgtcccatatacgtgctgttgatggaatctttcatgtcttgagggcatttgaagactcagaaattactcatgttgatgacacagtagatcctgttagagatttggaaactattagtgaagagctcagactaaaggatatagatttcatgaataagaaaattgaggaccttgagaagtcaatgaagaggagcaatgataagcagctcaaaattgaacatgaattatgtgagagggtcataaaacatctccaggatgggaaagatgtccgcttaggcgattggaaagctgctgacattgagatcttgaataccttccagctacttaccgcaaagccagttgtctacttggtgaatatgagtgagaaggacttccagaggaaaaagaacaagtttctacccaagatacatgcttgggtgcaggaacatggtggtgaaaccatacttcctttcagctgtgcttttgaacaaaaactagtggatatgccagaagacgaagctgccaaatattgtgctgaaaaccaactaacaagcatgatcccaaaaattatcaagactggttttgcagcaattcatctgatatactttttcactgctggtcctgatgaggtcaagtgttggcagatcagacgtcaaactaaggcccctcaagctgctggtgcaattcactctgatttcgaaaggggcttcatatgtgctgaggtaatgaagtttgatgatcttaaagagttgggcagtgaatctgctgtcaaggctgctggaaaatacaagcaggaggggaagacttgcgtggtgcaggacggggacattatcttcttcaagttcaacgtgtctggtggtgggaagaagtgaaaacgtcaggagatggtagcgtttgatagtgtgttacatcttaccctgggttcctacatttttgaggccactagccagtagccaaggtaccagagtgcatgtttaagattgtacaatgaggctttaaacagttggaaagattgtattcaaataacatgtacggttgtatatcatgaggtgctcactgtt

SEQ ID NO: 11873 - protein, 393 aa, Panicum virgatum
  misc_feature: Ceres CLONE 1757621
  misc_feature (24)..(183): Pfam Name: MMR_HSR1 Pfam Description: GTPase of unknown function
MPPKAKKDAAPAERPILGRFSSHLKIGIVGLPNVGKSTFFNIVTKLAIPAENFPFCTIEPNEARVNVPDERFDWLCQLYKPKSEVPAYLEITDIAGLIRGAHAGDGLGNAFLSHIRAVDGIFHVLRAFEDSEITHVDDTVDPVRDLETISEELRLKDIDFMNKKIEDLEKSMKRSNDKQLKIEHELCERVIKHLQDGKDVRLGDWKAADIEILNTFQLLTAKPVVYLVNMSEKDFQRKKNKFLPKIHAWVQEHGGETILPFSCAFEQKLVDMPEDEAAKYCAENQLTSMIPKIIKTGFAAIHLIYFFTAGPDEVKCWQIRRQTKAPQAAGAIHSDFERGFICAEVMKFDDLKELGSESAVKAAGKYKQEGKTCVVQDGDIIFFKFNVSGGGKK

SEQ ID NO: 11874 - DNA, 902 bp, Panicum virgatum
  misc_feature: Ceres CLONE 1757782
  misc_feature: Encodes the peptide sequence at SEQ ID NO. 11875
agaacgggaagggacggagaagagaaggctctcggccataggtacagccacagggcagcagcaaccaacacaggcctcacctggaagctccatccgccatggcattctcgcccgccacggcctgctgcaacccctcgctgccggtggcgccccgggcgccgcagcgcggctcgtcggcccgcgcgcaggcgctcctctgcgcgccctccacctccgcgttccgcggcgtactcgtccggccgcccgcggccgccgcgccggccccgcggtggcgccgcgccgccgcgtccacgggcatcgtctgcggcaaggtgaccaagggcagcgtgccgcccaacttcaccctcaaggaccagaacgggaggcccgtgtcgctgaacaagttcaagggcaagcccgtggtggtctacttctaccccgccgacgagacgcccggatgcaccaaacaggcgtgcgcgttccgcgactcttacgagaagttcaagaaggccggcgcggaggtgctgggcatcagcggcgacgacacggcgtcgcacaaggcgttcgcgcagaagtaccggctgccgttcacgctgctgagcgacgaggggaaccgggtgcgcaaggagtggggcgtgccgggggacctgttcgggacgctcccggggcggcagacctacgtgctggacaagaacggcgtcgtccagtacatctacaacaaccagttccagcccgagaagcacatcggcgagaccctcaagatcctgcagggcctctgagccaggtccgcatccatcgctgtactgtataaacgaaccgaaactgtatgtgatgagtgaagagctgattgttttttcagcgattattcagtctaatcagactcactcaacccatttgatggttgaccagagcctgttcgtgct

SEQ ID NO: 11875 - protein, 219 aa, Panicum virgatum
  misc_feature: Ceres CLONE 1757782
  misc_feature (74)..(198): Pfam Name: AhpC-TSA Pfam Description: AhpC/TSA family
  misc_feature: SWISSPROT Homolog: EC 1.11.1.15 Peroxiredoxin
MAFSPATACCNPSLPVAPRAPQRGSSARAQALLCAPSTSAFRGVLVRPPAAAAPAPRWRRAAASTGIVCGKVTKGSVPPNFTLKDQNGRPVSLNKFKGKPVVVYFYPADETPGCTKQACAFRDSYEKFKKAGAEVLGISGDDTASHKAFAQKYRLPFTLLSDEGNRVRKEWGVPGDLFGTLPGRQTYVLDKNGVVQYIYNNQFQPEKHIGETLKILQGL

SEQ ID NO: 11876 - DNA, 472 bp, Panicum virgatum
  misc_feature: Ceres CLONE 1757796
  misc_feature: Encodes the peptide sequence at SEQ ID NO. 11877
  misc_feature (103)..(103): n is a, c, t, g, unknown, or other
  misc_feature (154)..(154): n is a, c, t, g, unknown, or other
  misc_feature (199)..(199): n is a, c, t, g, unknown, or other
  misc_feature (202)..(202): n is a, c, t, g, unknown, or other
  misc_feature (207)..(207): n is a, c, t, g, unknown, or other
  misc_feature (216)..(216): n is a, c, t, g, unknown, or other
  misc_feature (217)..(217): n is a, c, t, g, unknown, or other
  misc_feature (219)..(219): n is a, c, t, g, unknown, or other
  misc_feature (238)..(238): n is a, c, t, g, unknown, or other
  misc_feature (241)..(241): n is a, c, t, g, unknown, or other
cccccacggcgcaggccagcagcgccaccaccacccggcggcgcccccccgccccgcgcaccggcggcagcggcggcggggggcggcgccccccccgcgagcnccgcagccgcaacgacacgggccgcaacacgcagaagaccaccgaggccangaagcgcgcggccgccgccaagggccggcgcgcgcaggaggccgncgncccgncccgccccnncncggtttttttggtcgaggngcnccacaacatgaaccaggagatccagacggaggacttttttctgcccccgacccgcacccgccccgtgaagaaggacgcccgggtggtcctcaccggcgagcgcggcctctgcggcagcttcaacaacaacgtgctgaagaaggcggacacccgcatcgaggagctcaagcagctggggctcgagtacaccgtcatcagcgtggggaagaagggcaacgcctacttcacgcg

SEQ ID NO: 11877 - protein, 156 aa, Panicum virgatum
  misc_feature: Ceres CLONE 1757796
  misc_feature (32)..(156): Pfam Name: ATP-synt Pfam Description: ATP synthase
  misc_feature: SWISSPROT Homolog: EC 3.6.3.14 H(+)-transporting two-sector ATPase
  misc_feature (34)..(34): Xaa is any aa, unknown, or other
  misc_feature (51)..(51): Xaa is any aa, unknown, or other
  misc_feature (66)..(66): Xaa is any aa, unknown, or other
  misc_feature (67)..(67): Xaa is any aa, unknown, or other
  misc_feature (69)..(69): Xaa is any aa, unknown, or other
  misc_feature (72)..(72): Xaa is any aa, unknown, or other
  misc_feature (73)..(73): Xaa is any aa, unknown, or other
  misc_feature (79)..(79): Xaa is any aa, unknown, or other
  misc_feature (80)..(80): Xaa is any aa, unknown, or other
PTAQASSATTTRRRPPAPRTGGSGGGGRRPPREXRSRNDTGRNTQKTTEAXKRAAAAKGRRAQEAXXPXRPXXVFLVEXXHNMNQEIQTEDFFLPPTRTRPVKKDARVVLTGERGLCGSFNNNVLKKADTRIEELKQLGLEYTVISVGKKGNAYFT

SEQ ID NO: 11878 - DNA, 923 bp, Panicum virgatum
  misc_feature: Ceres CLONE 1757803
  misc_feature: Encodes the peptide sequence at SEQ ID NO. 11879
acgagagagagaagagaagaggggagagaaagaggcggggggaggggagagagtgcgcgcgcttggatcgtcgatggatgtcggagcgaaggtgccgaggaaggccgcggcgggccgtcgcggcggcggcgggcccaagaagaagccggtctcccgctccgtgaaggccggcctccagttccccgtcggccgtatcggccgctacctcaagcagggccgctactccaagcgcatcggcaccggcgcccccgtctacctcgccgccgtcctcgagtacctcgccgccgaggtcctcgagcttgcggggaacgcggcgcgggacaacaagaggaaccggatcatcccgcggcacgtgctgctggcgatccgcaacgacgaggagctcgggaagctgctggccggcgtcaccatcgcgcacggcggggtgctgcccaacatcaaccccgtgctcctccccaagaagtccgcctctgccgcctccaaggaaggcaaggagggtaaggagacgaaatcacccaagaaggccgccaccaagtcgcccaagaaggcggccgccgcgtaggtccgggcaaatggtggtgccctgtctctcgctatctccctgtccgctctgaactgaaacgctcctagctgtcgtcgtcatcatgatcttcgctgcttgtcgtggttgtttgtgtgtaattgcgtgccttttgctaaatcatcatgcactgtgtaggttgacactggtctagttcgatctgaaaaccacctgtttaggttcggaggagtgtgagctgtgaagggcaatggaggcgtgggaactgtgaatcattaggtgttgtttgtaatgagattgtgaagatgtgtaaaatgatggacctccattctgtgcttgattgtctggatgtggtttcatgacagtgattatgtttatcttgttc

SEQ ID NO: 11879 - protein, 162 aa, Panicum virgatum
  misc_feature: Ceres CLONE 1757803
  misc_feature (28)..(101): Pfam Name: Histone Pfam Description: Core histone H2A/H2B/H3/H4
MDVGAKVPRKAAAGRRGGGGPKKKPVSRSVKAGLQFPVGRIGRYLKQGRYSKRIGTGAPVYLAAVLEYLAAEVLELAGNAARDNKRNRIIPRHVLLAIRNDEELGKLLAGVTIAHGGVLPNINPVLLPKKSASAASKEGKEGKETKSPKKAATKSPKKAAAA

SEQ ID NO: 11880 - DNA, 443 bp, Panicum virgatum
  misc_feature: Ceres CLONE 1757915
  misc_feature: Encodes the peptide sequence at SEQ ID NO. 11881
  misc_feature (152)..(152): n is a, c, t, g, unknown, or other
  misc_feature (288)..(288): n is a, c, t, g, unknown, or other
cgacacccccagcaaggggggcaccgacggcgagggccgcaacaccaagcgcaagaccgcggccaagcccaagggggcggcggccggcagcccacggcacggccccgaccgcggcaagcaccgcggccccgccgccggcgagcccccgagcnaccgcaccggcgagccccccggcgacaacggcagggacaccgcggggccgcccgccgaccccgagtttttttccaagaaccgcgagctggaggtcatccactcccggtgggccatgctttttttccccccccccgncttccccgagctgctcgctcgcaaggggggggagttcggcgaggccgtctggttcaaggccggctcccagatcttcagcgagggcggcctcgactacctcggcaaccccagcctcatccacgcccagagcatcctcgccatctgggccgtccagg

SEQ ID NO: 11881 - protein, 147 aa, Panicum virgatum
  misc_feature: Ceres CLONE 1757915
  misc_feature (47)..(147): Pfam Name: Chloroa_b-bind Pfam Description: Chlorophyll A-B binding protein
  misc_feature (51)..(51): Xaa is any aa, unknown, or other
  misc_feature (96)..(96): Xaa is any aa, unknown, or other
DTPSKGGTDGEGRNTKRKTAAKPKGAAAGSPRHGPDRGKHRGPAAGEPPSXRTGEPPGDNGRDTAGPPADPEFFSKNRELEVIHSRWAMLFFPPPXFPELLARKGGEFGEAVWFKAGSQIFSEGGLDYLGNPSLIHAQSILAIWAVQ

SEQ ID NO: 11882 - DNA, 1010 bp, Panicum virgatum
  misc_feature: Ceres CLONE 1757952
  misc_feature: Encodes the peptide sequence at SEQ ID NO. 11883
aggagcagaagctgcaaccgccgcccgacgaggaggttggcaagaagtcgccgccgccgccgccggagctggcgtggcggcgcgtggtgaaggacaaccccttcctgatgcgcgaccgcgagagcagcagcaaggccggcaacgcgcctcggtggaagcggcgcgacccgttcgagggctgccccgagcggcggccgccgggcgcggcgggcggcggggtagtgctgtacacgacgacgctccacggcgtgcggcgcaccttcgaggactgcgagcgcgcgcgggaggtggtggaggcctgcgcggaggcggcgggcgtgggggcggtggacgagcgcgacgtctcgctgcacggggagtacctccgcgagctgcgggagctggccggcgatggcgcggcggcgccgccgcggctgttcgtgatgggccgctacgtgggcggcgcggaggagtgcgtcaggctggccgagtccggcaggctgagggagatgatgcggtgggtgaaggcgcgcggcgaggcctgcgccgccaaggacggccgcggctgcgagggatgcggcggcgcgcgcttcgtgccgtgctgggagtgcggcggcagccgccgcaagctggtagtggtggagggaggcggcggcggccatcaggatcaggtggagaggtgcgccaagtgcaacgagaacggactcatgatgtgcccgctctgccactgaatctcaatctgaatctgaatctgaatctgaatcaccactgatcatcatcctaggcctctttcttcaatgtaatcatcaatatgatggatcgcttattagcttgcgttgcatcgatcccttttgttcattcattcaagagatttgaactagtgcactactacatagggtatatgtatgtatatgtagtagcatccactatatgtatattgtacatcgagtatgtatgtatgtatgttggttggagccttagttgtgcacattatatataataaccttgaaaaaactaaagaaattggaggt

SEQ ID NO: 11883 - protein, 235 aa, Panicum virgatum
  misc_feature: Ceres CLONE 1757952
  misc_feature (74)..(145): Pfam Name: Glutaredoxin Pfam Description: Glutaredoxin
EQKLQPPPDEEVGKKSPPPPPELAWRRVVKDNPFLMRDRESSSKAGNAPRWKRRDPFEGCPERRPPGAAGGGVVLYTTTLHGVRRTFEDCERAREVVEACAEAAGVGAVDERDVSLHGEYLRELRELAGDGAAAPPRLFVMGRYVGGAEECVRLAESGRLREMMRWVKARGEACAAKDGRGCEGCGGARFVPCWECGGSRRKLVVVEGGGGGHQDQVERCAKCNENGLMMCPLCH

SEQ ID NO: 11884 - DNA, 739 bp, Panicum virgatum
  misc_feature: Ceres CLONE 1758154
  misc_feature: Encodes the peptide sequence at SEQ ID NO. 11885
ctcttgctcgcggcgctccgatcggcgccccccccccccccccccgcgcggaggagagcagggggcctccggggccctcccgcgcggcgacctcgtggcgctcctgcgcggctgcttctcgttcgggtcggcggggcggaggcggcccaaggcctcgcccttgccctccccgccgcgcctgaccgccccggcggccgcggccgcggcggcagcagacgacggggccaagatgaagggcctcttcaagtcgaagccacggacgcccgtcgacgtcgtgcggcagacgcgcgagaacctcgtccacctcgacctcaactccggctcccgtggcggcgatgccaagcgcgaggagaagatggcagagcttagcaaaaatatcagggaattgaagtctattctatacggcaatggtgaatcagagcctgtaacagaagcgtgtgtgcaactgacccaagaattcttcagggagaacactttacgtctattaatcatacatcttccaaaactaaatctggagactaggaaagatgctactcaagttgtagcaaacttgcaaagacagcaagtatcctcaaagatagttgcgtccgagtaccttgagtcaaataaggatctcttggacatcttaatttcagggtatgaaaatatggacattgctttacattatggtgctatgttgagggaatgtattcgccaccaaagcattgcaaggtatgttttagagtcggaacacatgaag

SEQ ID NO: 11885 - protein, 169 aa, Panicum virgatum
  misc_feature: Ceres CLONE 1758154
  misc_feature (1)..(168): Pfam Name: Mo25 Pfam Description: Mo25-like
MKGLFKSKPRTPVDVVRQTRENLVHLDLNSGSRGGDAKREEKMAELSKNIRELKSILYGNGESEPVTEACVQLTQEFFRENTLRLLIIHLPKLNLETRKDATQVVANLQRQQVSSKIVASEYLESNKDLLDILISGYENMDIALHYGAMLRECIRHQSIARYVLESEHM

SEQ ID NO: 11886 - DNA, 643 bp, Panicum virgatum
  misc_feature: Ceres CLONE 1758154-R
  misc_feature: Encodes the peptide sequence at SEQ ID NO. 11887
atatacagcttccaaattttgacatagcttctgatgcttctgcaacctttaaggaactattgacaaggcataaagcaaccgtggctgaatttctcaccaataattatgattggttctttaaagaattcaacactaggttgctatcgtcgaccaactacataacgaaaaggcaagctatcaagttgttgggagatatgctgctggataggtcaaatgctgcagtcatgatgcactatgttagttccaaagacaatcttatgattctgatgaatctcttaagggattcaagtaaaaatattcaagttgaggcatttcacgtgttcaagctatttgctgcaaataaaaacaaaccggctgaggttgtaaacatactggtcactaataggagcaagcttcttcgcttttttgctgggttcaagattgacaaagaggacgagcaatttgaagcagacaaggagcaggtcattaaagaaatatcggcactttgagtgtctcaggatgtaattagtcattgtaatgaattttcttttgttaagaaagtgcatgtgtaataataaacctctgtgtattattatattggatttagcggaacaatgtgaccaagttggagttggttcttccgtgaaaatgtgataatctcttc

SEQ ID NO: 11887 - protein, 161 aa, Panicum virgatum
  misc_feature: Ceres CLONE 1758154-R
  misc_feature (1)..(161): Pfam Name: Mo25 Pfam Description: Mo25-like
IQLPNFDIASDASATFKELLTRHKATVAEFLTNNYDWFFKEFNTRLLSSTNYITKRQAIKLLGDMLLDRSNAAVMMHYVSSKDNLMILMNLLRDSSKNIQVEAFHVFKLFAANKNKPAEVVNILVTNRSKLLRFFAGFKIDKEDEQFEADKEQVIKEISAL

SEQ ID NO: 11888 - DNA, 1305 bp, Panicum virgatum
  misc_feature: Ceres CLONE 1758185
  misc_feature: Encodes the peptide sequence at SEQ ID NO. 11889
gcttctcctcagaggctcagacgaacaagttgcagagattcccgagctagtcagggcagttcgaacttcgaatcaacacctcgctgcgtgctagcctttgtgtggatctctgcaactgcaagcatccctgcgtttggcatttgcaatccccttttgcatccatggcttgaccggcaatctgcgcgcaggctgatttagatctctccgccgtcggccgtcccgcagcccgatgccgccgccgccggcggtggccgccgccggtccgggcggagcgccgccgcgcctctacctcaagacacacgaggccagggtcgcgaggccgcacctgctcgactgggccgtgctggccgtcctcgccgccctcgacggcgcgctcaacgccatcgagcccttccaccggttcgtcggggaagacgcggtgccgggcctccgctacccgctcaaggacaacaccgtgcccgtctgggccgtgccggtgctcgccgtcgccgcgccggtggccgtcgtcgccgggatgtacgtgaggaggcggaacgtctacgacctgcaccacgccatcctcgggcttctgttctccgtgcttataaccgccgtcctgaccgacgccatcaaggacggcgtcggccggccgcggcccaacttcttctggcgctgctttcctgacggaatgccgaggtacgacaacgtcaccagagaggtcatctgtcacggagacccggccgtgatcaaagaagggtacaagagcttcccaagtggccacacttcatggtctttcgccgggctgggcttcctgtcatggtacctggctggcaagatcaaggcgttcgaccggggaggccatgtcgcgaagctctgcatcgtcgccatgccgctgctcctcgcggccatggtcgccgtgtcgcgggtggacgactactagcaccactggcaggacgtgttcactgctggagtccttggattggtggtcgcgtcgttctgctacctgcagttcttcccaccaccctccggcgaacaaggattctggcctcactcctactttgagcacatgcttacccttgagggcgagatcgaggtgcagtcagcagccggctcgagtcggcacctgtcactgacgcttgactcctctcccggacgtgctggaaacgacatgagaaccagtagccaagcattggacaccatggaatcaggccgtagatcctagtgtctgaagaatgctactggctactgccttttctttttttcattcaagaagactgtatgctaattttagtttaaaaaaaatcaatgtatgctaattttaccggc

SEQ ID NO: 11889 - protein, 229 aa, Panicum virgatum
  misc_feature: Ceres CLONE 1758185
  misc_feature (109)..(229): Pfam Name: PAP2 Pfam Description: PAP2 superfamily
  misc_feature: SWISSPROT Homolog: EC 3.1.3.4 Phosphatidate phosphatase
MPPPPAVAAAGPGGAPPRLYLKTHEARVARPHLLDWAVLAVLAALDGALNAIEPFHRFVGEDAVPGLRYPLKDNTVPVWAVPVLAVAAPVAVVAGMYVRRRNVYDLHHAILGLLFSVLITAVLTDAIKDGVGRPRPNFFWRCFPDGMPRYDNVTREVICHGDPAVIKEGYKSFPSGHTSWSFAGLGFLSWYLAGKIKAFDRGGHVAKLCIVAMPLLLAAMVAVSRVDDY

SEQ ID NO: 11890 - DNA, 1320 bp, Panicum virgatum
  misc_feature: Ceres CLONE 1758211
  misc_feature: Encodes the peptide sequence at SEQ ID NO. 11891
aaccctcggagatagagcgaatcgaaataccaagcagaaaaagggaggaaaaaaaccattccccgtttcgttctcggctagacccccgcccgaatcgatggagattagggctcctccgacgagcctgaggctcgcggcacccccggcctccgccagcttccaccggaccgccctcaggacctccttcctcaacggcagtgtttcacttagagttctgcgcatacggcaatcaaatgtcaacagatttaggtgcaatgccaacctctttgatagactatctagggttgtcaagtcctatgcaaatgctgttttaagtacattcgaagaccccgaaaagatcctagatcaggcggttcttgagatgaatgatgatttaacaaagatgcggcaagccaccgctcaggtcttggcatctcaaaagcggcttgagaacaaatacaaagctgctgaacaagcttctggtgattggtatcggagggctcagctcgctcttcaaaagggagatgaggatcttgcccgtgaagcccttaagcgccgtaaatcgtatgctgataatgcgagctccttaaaggctcaacttgatcagcagaagggtgttgttgaaaatttgatttcaaataccaagcttcttgagagcaagatagcagaggccaagcagaaaaaggataccctaaaagcccgtgctcaatcagccaagacggcaacaaaagtgagtgaaatgttgggtaatgtaaatacaagtagtgccctttcagcatttgagaaaatggaggaaaaagttatggtgatggagtcccaagcagaggcacttggtcagttagcaactgatgatctagaagggaagtttgcattgctggagacttcatctgttgatgatgatcttgcacaaatgaaaagagaactatctggaagttcattgaaaggggagcttcctccgggtagaacagccgtgaacaactcaggtgcagcacggcctttccccgacctggagattgagaatgaactaaatgagctgcggagaaaggccaaggattattaggttgcgccgttcttgtcgattcagcaggcctgacaaaatatcgtcccccggaaaatagtatagccgcagatttctccattgtgttgtcgaaactccagtgcaccctgtttgttaaagagtattgaatcttgcaacattctcggcgttctcccctgcgagtgacatttgtacaggtagctataaattgatgtaaatcacaactcgccctgagcccttttttgcatacaataacatgtataatatgtattactataaagaacaatttttttaaaagcgtttcg

SEQ ID NO: 11891 - protein, 313 aa, Panicum virgatum
  misc_feature: Ceres CLONE 1758211
  misc_feature (55)..(271): Pfam Name: PspA_IM30 Pfam Description: PspA/IM30 family
MEIRAPPTSLRLAAPPASASFHRTALRTSFLNGSVSLRVLRIRQSNVNRFRCNANLFDRLSRVVKSYANAVLSTFEDPEKILDQAVLEMNDDLTKMRQATAQVLASQKRLENKYKAAEQASGDWYRRAQLALQKGDEDLAREALKRRKSYADNASSLKAQLDQQKGVVENLISNTKLLESKIAEAKQKKDTLKARAQSAKTATKVSEMLGNVNTSSALSAFEKMEEKVMVMESQAEALGQLATDDLEGKFALLETSSVDDDLAQMKRELSGSSLKGELPPGRTAVNNSGAARPFPDLEIENELNELRRKAKDY

SEQ ID NO: 11892 - DNA, 1027 bp, Panicum virgatum
  misc_feature: Ceres CLONE 1758241
  misc_feature: Encodes the peptide sequence at SEQ ID NO. 11893
aaacgcccatcaaccatctcctcctgctgcaatcttcctctgaattgtgggtctgtggcaatggcggcgctcgctccatcgaagatccttggcacccagctcaacttcacgggctcctcccggtacgccaccactgcaccgaccgctggggcgcagaagatcgtctccctattcaaaaagaagcctgccccgaagcccaagcccgctgcggtatcatcctcatccccggacatcagcgatgagctcgccaagtggtacggccctgacaggaggatcttcctgccggatggcctcttggaccgctcagaggtcccggagtacctcaccggagaggtccctggagactatggctacgatccttttggcctgggcaagaagccagaggacttcgccaagtaccaggcctacgagctgatccatgccaggtgggccatgctcggcgccgccggtgccgtcatcccggaggcgtgcaacaagttcggcgccaactgtggccctgaggccgtctggttcaagaccggcgccctgctgctgcacggcaacaccctcagctacttcggcaacagcatccccatcaacctggtggtggccgtgatcgccgaggtggtcctcgtcggcggcgccgagtactaccggatcatcaacggcctggacctggaggacaagctgcaccccggcggcccgttcgaccccttgggcctggccagcgaccccgaccaggctgccatcctcaaggtgaaggagatcaagaacggccggctggccatgttctccatgctcgccttcttcatccaggcgtacgtcaccggcgaaggccccgtcgagaacctcgccaagcacctcagcgaccccttcggcaacaacctcctcaccgtcatctccggcgccgccgagaggacgcccagcctgtgagcaacgctgctgctgctgctgcgtttgattttaccgggaaacagagtgtgcgtgagggtctgaagaatgtgccatgcgtgtaaattatcaagatggggaagaaaccatttcgttc

SEQ ID NO: 11893 - protein, 283 aa, Panicum virgatum
  misc_feature: Ceres CLONE 1758241
  misc_feature (83)..(247): Pfam Name: Chloroa_b-bind Pfam Description: Chlorophyll A-B binding protein
MAALAPSKILGTQLNFTGSSRYATTAPTAGAQKIVSLFKKKPAPKPKPAAVSSSSPDISDELAKWYGPDRRIFLPDGLLDRSEVPEYLTGEVPGDYGYDPFGLGKKPEDFAKYQAYELIHARWAMLGAAGAVIPEACNKFGANCGPEAVWFKTGALLLHGNTLSYFGNSIPINLVVAVIAEVVLVGGAEYYRIINGLDLEDKLHPGGPFDPLGLASDPDQAAILKVKEIKNGRLAMFSMLAFFIQAYVTGEGPVENLAKHLSDPFGNNLLTVISGAAERTPSL

SEQ ID NO: 11894 - DNA, 953 bp, Panicum virgatum
  misc_feature: Ceres CLONE 1758301
  misc_feature: Encodes the peptide sequence at SEQ ID NO. 11895
gtacaagagcaacaggtcaaaacgaaacgaaagccggcaatggcgaccaccccagcccacgccgccgccgctgccgccgccggtgaagcggtgatgtcctacggccgagttgggacccgtaggatcccacctcgtcttggcttcctctccaaaccgtcctcccggtgggccgcgatctcggtggctccggcccctcaccacgcggctccggcggcagccgcggccaaggagcgggtcgcggaggaggaggaggggccggcgtgggtggagctggagcccatcgcgagcgagcagcagctggaccgggccctcgcggtggcgcagcagctcgacctccccatcgtcctgctctggatggcaagttggtgcagaaaatgtatatatttgaagcctaagcttgagaagttggctgcagaataccatccaagaatccggttctactgtgtcgatgtcaatgcggttccacaaaagcttgtgaaccgtgctggagtaacaaagatgccttctatacagctgtggattgactcccagaaacaggacgaggtgatcggcggacacaaatcatggctggtaattgacgacgtcaggaggatgatcgagcgggaggaatgatccagtgtgtcatttagcgcaacagttgtgtgtcaatgctcctcaacaaaaaaaagtgtgccaaagaagataatcagtattaccacttgctcaaaggttgagcaatatgtgagtctctgtatcgacgtattaggatcccacggtcagagatgacatgaaatacgattcattgtgcataaacactcagttcagcacattctggtgttggaatcagaagaatgatggaatccagctacctggagtggcctgacattcctgtgatgtccttgatgtatccatgtgtgggtattaactagaacttgctggatcaacaataattcaatacggaaatacttattgcc

SEQ ID NO: 11895 - protein, 190 aa, Panicum virgatum
  misc_feature: Ceres CLONE 1758301
  misc_feature (80)..(182): Pfam Name: Thioredoxin Pfam Description: Thioredoxin
  misc_feature: SWISSPROT Homolog: EC 1.8.1.8 Protein-disulfide reductase
MATTPAHAAAAAAAGEAVMSYGRVGTRRIPPRLGFLSKPSSRWAAISVAPAPHHAAPAAAAAKERVAEEEEGPAWVELEPIASEQQLDRALAVAQQLDLPIVLLWMASWCRKCIYLKPKLEKLAAEYHPRIRFYCVDVNAVPQKLVNRAGVTKMPSIQLWIDSQKQDEVIGGHKSWLVIDDVRRMIEREE

SEQ ID NO: 11896 - DNA, 1067 bp, Panicum virgatum
  misc_feature: Ceres CLONE 1758358
  misc_feature: Encodes the peptide sequence at SEQ ID NO. 11897
aaaacaaacgcaacgcatcgcggccgctcccccagtctctctggtccggtctccctcccctctgcggctctgccctcccaatccccgcccgcgagatcgccgcccccaggggggggcctagatcccgatggcctcgcgccggcgcaccctgctcaaggttatcatcctcggcgacagcggggttgggaagacgtcgttgatgaaccaatacgtgaacaagaagttcagcaaccagtacaaggctacgattggcgcggatttcctcaccaaggaggtgcagttcgaggacaggctcttcactttgcaaatatgggacacagctggtcaggaaaggtttcagagtctcggtgttgcattctaccggggagcagattgttgtgtcctagtctatgatgttaattctatgaagtcatttgataatctgaacaactggcgtgaagagtttctaattcaggctagcccatcagatccggacaacttcccttttgttcttttgggtaacaaagttgatgtagatggtggcaacagccgtgtggtctccgagaaaaaggcaaaggcatggtgcgcctctaaagggaacatcccatactttgagacatctgcgaaggatggaacaaatgtcgaagatgctttccagtgtatcgtaaagaacgctctgaagaatgaaccagaggaagaactgtatgtgccggataccgtggatgtggtgggtggcaaccgggcccagagatcatctggttgctgttaaagcctgacacatcacgaggcgttgcagtcatcagttctgcagtaaccaagcataccttcaccattgctgggtctccaactctccatggttcccaatttcatttgttacctttccagtctcctgttatgtacccaaggccggctgtcccccatgctgtcgattcgtggacgttgtgcagtttcatcagtagcgtcatatcttgtgaatacaattcggcaaaataagagaagtgtaaactaaagttcatccgttgtggtctgtgttatggtctgtgcgcaacagaatatgaattttgtctagctcagaatagccttttgcc

SEQ ID NO: 11897 - protein, 206 aa, Panicum virgatum
  misc_feature: Ceres CLONE 1758358
  misc_feature (10)..(178): Pfam Name: Ras Pfam Description: Ras family
  misc_feature (10)..(128): Pfam Name: Miro Pfam Description: Miro-like protein
  misc_feature: SWISSPROT Homolog: EC 2.7.11.1 Non-specific serine/threonine protein kinase
  misc_feature: Useful for making plants with modulated water use efficiency
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGTNVEDAFQCIVKNALKNEPEEELYVPDTVDVVGGNRAQRSSGCC

SEQ ID NO: 11898 - DNA, 771 bp, Panicum virgatum
  misc_feature: Ceres CLONE 1758465
  misc_feature: Encodes the peptide sequence at SEQ ID NO. 11899
agcgagctcacacacatacacaccaacataccaaagccgctgcttgtctcctcacaacctgcgacggagccagcaactcgctagctagctggaattcttgggggtgacaagcccgcagccggccatggccaagtctcaggaggtgcgcagcgtcgactccttctcgcagctgccgttcacccggccggccccggcgccgacgccgcgggacaccatccggctgttcggctgcgagttctccaacgaccagaaggtgcaggccaagcaggaggccatggccgattccccggacgcggccaacggcagcacggtcacgtccgagagcaacgccaagcagagcgccgccgccgccgcggccgagaggaagttcgagtgccactactgctgccgcaacttcccgacgtcgcaggcgctgggcgggcaccagaacgcgcacaagcgcgagcgccagcacgctaagcgggcccacctccaggcctccctcgccatgcaccgctacgtccccggccccatgtacggcctcttcaactaccaccaccatctcggccgcttcgaccagccgccggcgccgcccccgcccccgccgccggcgcactacccgatgtggacgagcgccagcccgccggggccgtacggcggagggccaggctccttgtcgcagccaattaacggcagcccggtgccggggctatggagggtgccgccgcccatggagaatttcggcatggccggccggcacggcgctgacacggccatcctggtcgatccctg

SEQ ID NO: 11899 - protein, 215 aa, Panicum virgatum
  misc_feature: Ceres CLONE 1758465
  misc_feature: The sequence is a functional homolog of SEQ ID NO 1094 in the 10/412,699 US patent application
  misc_feature: The sequence is a functional homolog of SEQ ID NO 639 in the 10/374,780 US patent application
  misc_feature: The sequence is a functional homolog of SEQ ID NO 763 in the 10/666,642 US patent application
MAKSQEVRSVDSFSQLPFTRPAPAPTPRDTIRLFGCEFSNDQKVQAKQEAMADSPDAANGSTVTSESNAKQSAAAAAAERKFECHYCCRNFPTSQALGGHQNAHKRERQHAKRAHLQASLAMHRYVPGPMYGLFNYHHHLGRFDQPPAPPPPPPPAHYPMWTSASPPGPYGGGPGSLSQPINGSPVPGLWRVPPPMENFGMAGRHGADTAILVDP

SEQ ID NO: 11900 - DNA, 1079 bp, Panicum virgatum
  misc_feature: Ceres CLONE 1758520
  misc_feature: Encodes the peptide sequence at SEQ ID NO. 11901
aaaaaaaaaaaaaaaaaagagccagttgtgcgctagctccgactccgagtgtcaggataagaaaaccgcgcggccgcacggagcgcgaccgaccgagcgggaggcacagctcctccggcgactgcaagcgccaggctatggcgtccctcgccccttccctccacctcccctgcaattcaagaactggcttccttggaaagacacaagggattcgtcctcgtgttatccctgctggcagagttgggtttgtcagaacagtagtggaatgcaaggaatctagaattggaaagaagcccatcgaagttccatcaaatgttactctcacattagaggagcagtttgtcaaagctaagggtccgctaggggagttatcactgagctatccaggtgaagtgaaagttgtgaaagaagaatctggtaagctgagactttttaagactgcggagaccaagagggcgaaccagatgcacggacttttcagaacattgacagacaacatcattgttggtgtgtccaaaggattcgataagaagcttcaattagtgggtgttggatatcgtgctgcggtggagggcaacgatctcgtgatgaaccttggtttctcacaccctgttcggatggctattcccgaaggcctgaaggtcaaggtggaagagaacaccaggatcattgtgagcggctatgacaagagcgcaatcggtcagtttgctgctaccataaagaagtggaggccacctgagccatacaagggaaagggtatccgatatgctgatgaggttgtaagaaggaaggagggcaaagctgggaagaagaaatagaaaccgtttctttcttttctgcgggtttcacacttcatttatttttccactgtaatgatcatagtgtactaaggttgaccctaagaaaattctcttcttttctgatcatggcatgtagatctacactttcaggctatgattctgaatttgggagaggtttaatgattgtgctggctatgattctgaatttggggagcacaaaaagtgcatgaacatggcctcctatcttatcacccaataaatgtgatggattatcctggc

SEQ ID NO: 11901 - protein, 226 aa, Panicum virgatum; identical to SEQ ID NO: 11773
  misc_feature: Ceres CLONE 1758520
  misc_feature (136)..(211): Pfam Name: Ribosomal_L6 Pfam Description: Ribosomal protein L6
  misc_feature (56)..(128): Pfam Name: Ribosomal_L6 Pfam Description: Ribosomal protein L6

SEQ ID NO: 11902 - DNA, 1010 bp, Panicum virgatum
  misc_feature: Ceres CLONE 1758528
  misc_feature: Encodes the peptide sequence at SEQ ID NO. 11903
gctaatcagctctcaccttaagcatcagctaaagcgaaaggccgggccgttgagatggctagcccagtccggtagcgtcgcgctctcagtaggtcataagttcgattctcattagaagcgaatttcaggctgctgagtgaaaaaaaacctctcgttgtgctcgccgtaaggcttggtcctcacgggcatgaaccagggttcggggattctctactcgggtaagccggtgtggctttcttttaatgaaaaaacgatggggccgtttcttctccgggtagagttttttttttagcatcagctaaaacctctagctcgatgcggacgctctatataaaccctccctctgtgctcccatccatcccattcccatccatcgaccttagcgagctcacaattcaatcaggtccggttcggcttcaggccgggctcgtcaccgaggagatggcgctctctcgccgcatggccgcgccggttctcgtcttcctgctcctcctcgtcgccacagagatggggccggcgacggtggcggaggcgaggcactgcctgtcgcagagccaccacttcaagggcctgtgcgtgagcagcagcaactgcgccaacgtctgccggaccgagaacttccccggcggcgagtgcaagacggagggcgccacccgcaagtgcttctgcaagaggatctgctagccgccggcgccgcccggcacgcaatgcgagccgagcactggtcttggttctgttcgtcggttcttcgtcatgcacgctgcgccgtgatgctgcagcgggctgtgttcctgtcgtctcttgttctctttacctggaataaattaaactcggtgctggtgtctggtgatgcctgtgcgtgtggaacatctcactgttgttctgcacccatatgcactccattattagtgtagtaggcaagatgatgtaaggtcctcctttcaacattgatgtaataatgtgatgcagcttcgtgctagttcagcttaattaagtgcgaggttttcttt

SEQ ID NO: 11903 - protein, 80 aa, Panicum virgatum
  misc_feature: Ceres CLONE 1758528
  misc_feature (32)..(80): Pfam Name: Gamma-thionin Pfam Description: Gamma-thionin family
MALSRRMAAPVLVFLLLLVATEMGPATVAEARHCLSQSHHFKGLCVSSSNCANVCRTENFPGGECKTEGATRKCFCKRIC

SEQ ID NO: 11904 - DNA, 1231 bp, Panicum virgatum
  misc_feature: Ceres CLONE 1758612
  misc_feature: Encodes the peptide sequence at SEQ ID NO. 11905
gaccaaacctcccgaagggaagcgacccaagacaaaatttcccaagccgaacagcctagggcatcggacgcgcccaaccgagaagccgctcgaatcctctccaaaattccgaggtgagagccactgatctatcacaaaacccatcaaatttcacaaattcaaatcgccaaaccccacctcccgccaccaattcgtgcgcaccaaatcgagcccataccccctcgcgattagtgagcccccaatcttcctcacgccttgtgcggattgctggatcatttcctccccgattccccaatacccgagccagggtcctaggcccgaaatctcagggagcttcctattggggaaatggggaagccgctgatctacgagatattggagaagccggcgagcagcagcgtcatcggcatctgctccctgatctggtggttcatccagaagcggggcatcgggtacggggacgtcgggctgagctacgaggccgccgtggacggcgggcagtactggcggatcatcacctccgccttctcccacatcagcgtcgtgcacctggtgttcaacatgagcgcgctctggagcctcggcgtcgtcgagcagctgggccagatcgggctcggcgtcgagtactacctgcactacacgctcgtgctcgtcgtgctgtccgggctgctggtcctcggcttctaccacatgatgattcagaggttcaaggtggagtacttcaggagggtgactgctgttgggtactcctgcgttgtgtttggctggatgacaattctggctgccaagcagccgtcatcgaagctgaacatcttcggggttctgtcgctgccgatcagctttgcgccattcgagtcgctgatattcacatcaatcatggtaccgcaggctagcttcattggccacttgtcggggatcattgtcgggtactcaattgcctggggtctgattcatgggatgaataactactgggcaatcaccatgctcggctggattgcgcttgtatttgtcttgagcttgaagcgtacaggttctatggagttgagttttattgagatcgaaccagtgacagacccgtcactgccttctgttggtgtggttgccaccagaaatggtagaactttgcagatggatgtactgcctgaaagaagagttgcagacattgtataatatatgcagaaatgtttgacaaatcttgtttttgttatgaaaattttatcatgttgacacc

SEQ ID NO: 11905 - protein, 273 aa, Panicum virgatum
  misc_feature: Ceres CLONE 1758612
  misc_feature (46)..(205): Pfam Name: Rhomboid Pfam Description: Rhomboid family
MGKPLIYEILEKPASSSVIGICSLIWWFIQKRGIGYGDVGLSYEAAVDGGQYWRIITSAFSHISVVHLVFNMSALWSLGVVEQLGQIGLGVEYYLHYTLVLVVLSGLLVLGFYHMMIQRFKVEYFRRVTAVGYSCVVFGWMTILAAKQPSSKLNIFGVLSLPISFAPFESLIFTSIMVPQASFIGHLSGIIVGYSIAWGLIHGMNNYWAITMLGWIALVFVLSLKRTGSMELSFIEIEPVTDPSLPSVGVVATRNGRTLQMDVLPERRVADIV

SEQ ID NO: 11906 - DNA, 1114 bp, Panicum virgatum
  misc_feature: Ceres CLONE 1758777
  misc_feature: Encodes the peptide sequence at SEQ ID NO. 11907
gagaagaggagcggaaatatgctactggcagttccatctgttcagcatctgacgtggccggcggcatcaggttgtagaagcggccagcggggcggcttcttcctggaagctgctgtgaaccccggcggtgtatcaagtggctcttggctgcggctgcggcagaggctgagactagcaggggccgccgccaccaaccaagccatatctcccaccccggcggcgacctccagcggcgacgaggagttcacggaggtggtggtggtgcggcatggggagacctcctggaacgcctcccgcatcgtccagggacatatggacccagagctaaatcagattggtagagagcaagcccttgtggtggctcatcggctgtcaaaagaagccaaaccagctgccatatactcttccgatttgaagcgtgctgctgagactgcagaaattatagcaaaagtttgcggtgtaacaaatttggtgctgcacaaggcactgagagaaaggcacatgggatatctccaaggcttgaagtgggatgatgctgtaaaaaaaaatccagatgttttcagaggggctgatatttttaaaattactgagggctctgatcctgacagcagaaaccaagaattaccgggtggtggagaaagcctgaatcagttaaatgagcgctgcgtctcttacttgaataagattgcccgagaacacactggggagagggttgtggtggtctcccacggtgcagccatactggagctgtgcaggcacaccgatccacctaacagctccattcgtaggaagattcccaacacttcgctgaacgttttccgtgtctccaccgtcaccgggcagtggatccttaagagttgtggagacgtcagccatctcgatggaaatggctttctggagaactcatttggcggcgacggggcctctgcataactcttgtagtgagtttttggagatggactcggcacaatcatcgtcggagatttaggcacgctctatgttattttcttccgcgcgagtacagcatgtattgttgttttcttcgtgaataaggcgactaagtaattgtgctctagtgtcgtcactctgcaattaactttcgttttcatggttg

SEQ ID NO: 11907 - protein, 310 aa, Panicum virgatum
  misc_feature: Ceres CLONE 1758777
  misc_feature (84)..(250): Pfam Name: PGAM Pfam Description: Phosphoglycerate mutase family
  misc_feature: SWISSPROT Homolog: EC 5.4.2.1 Phosphoglycerate mutase
EKRSGNMLLAVPSVQHLTWPAASGCRSGQRGGFFLEAAVNPGGVSSGSWLRLRQRLRLAGAAATNQAISPTPAATSSGDEEFTEVVVVRHGETSWNASRIVQGHMDPELNQIGREQALVVAHRLSKEAKPAAIYSSDLKRAAETAEIIAKVCGVTNLVLHKALRERHMGYLQGLKWDDAVKKNPDVFRGADIFKITEGSDPDSRNQELPGGGESLNQLNERCVSYLNKIAREHTGERVVVVSHGAAILELCRHTDPPNSSIRRKIPNTSLNVFRVSTVTGQWILKSCGDVSHLDGNGFLENSFGGDGASA

SEQ ID NO: 11908 - DNA, 1081 bp, Panicum virgatum
  misc_feature: Ceres CLONE 1758881
  misc_feature: Encodes the peptide sequence at SEQ ID NO. 11909
atgcccaggtctacttgagccaaaccccgtagaaaccctaggaaagccggttcctctatcagcggcggcgcagcatccgcgaggaacgatggccggctaccgcagccggagtccgagccgaagctatagccctcggaggcgatacagccggagccctcctaggcgcaagcgctacgacgacccccgtgaccgctaccacgggggtgggggcggcggtggcggagcccggcgtgggtacggtcggccgtcggcgcagtccggtctcctcatccgcaacatctccctcacaaccaggccagaagatattcgtgttccatttgaggaattcagccctgtaaaggatgtctatcttccaagaaacttccacaccagagaacttcgtggttttggattcgtgaaattccgataccctgaggatgctgcggtggccaagcaagagatgaatcatcaagttataggtggccgagagatttcaatagtttatgctgaagagaatagaaagacaccccaagaaatgcgcatgagaacaagaataagtggtaggtacatggacaaaaggtacacaaggcgatcactatctagatctccaaggtctcattctcactcttattcacccacaccatctccggataggcatgacttcaggggccgggacagccgtggcaattacttgcctggggtttcgtactctccgcgtcctcagaataacaggcactacaggtcaggtagtcgatctccaagcccagatgtgtgcaaacctcagatgtcaccaatcaccgatgggcatgaaccagctgttgtatccagccccagataatacgatgctgtttgggatgctctggaatgaaggtgagaggatggaaactgcagacaacgccttcttttgatcaatcttccctagaagagatcagtaggtttttagtaaaacgtgcttgtatgggcgatgctttttgttgaaacaagctgttccctttgtgaccggcttttgcgcttttcaaactgatggtaccctaatggaattttgtgatttttttgcttgaatgatatgtcatcaatttggcaaggacattttacctgtcgt

SEQ ID NO: 11909 - protein, 242 aa, Panicum virgatum
  misc_feature: Ceres CLONE 1758881
  misc_feature (59)..(130): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAGYRSRSPSRSYSPRRRYSRSPPRRKRYDDPRDRYHGGGGGGGGARRGYGRPSAQSGLLIRNISLTTRPEDIRVPFEEFSPVKDVYLPRNFHTRELRGFGFVKFRYPEDAAVAKQEMNHQVIGGREISIVYAEENRKTPQEMRMRTRISGRYMDKRYTRRSLSRSPRSHSHSYSPTPSPDRHDFRGRDSRGNYLPGVSYSPRPQNNRHYRSGSRSPSPDVCKPQMSPITDGHEPAVVSSPR

SEQ ID NO: 11910 - DNA, 621 bp, Panicum virgatum
  misc_feature: Ceres CLONE 1758894-R
  misc_feature: Encodes the peptide sequence at SEQ ID NO. 11911
aggccgtctcagggtcacggggtgcctcagctgagagcaaggcccgccaagatgcggtgcggcgcctgcttcaagcagcaggacggcaacggcaaggcgccggcggcggctccggccggcgcgtccctgctggccgcggcgagcgcgatgacggcatcgcccgcgctggcgctggtggacgagcggatgtcgacggagggcaccgggctcagcctggggctgagcaacaacctgctggggtggatcctgctgggcgtcttcggcctcatctggtccctctacaccgtctacacctccacgctcgacgaggacgaggactccggcggcctctccctgtgaaatccttttgatttccagcagtttacttcagccctgacctgtgcaagttcgacgctctgtgggtgcaactggaagtctgcaactgaagacatatggttgtatgcgactgtgattgggttgttgcatcggagatggtaatgacgagtacttagtagttggctttatggtggtttgagattgcacctatgaggctctgatgcatgaaagatgctgggcacacactgtactgtatgaagtttgatagcagtccgatttggttgctgagtgtcatagtgtggcatg

SEQ ID NO: 11911 - protein, 112 aa, Panicum virgatum
  misc_feature: Ceres CLONE 1758894-R
  misc_feature (1)..(112): Pfam Name: PsbW Pfam Description: Photosystem II reaction centre W protein, PsbW
RPSQGHGVPQLRARPAKMRCGACFKQQDGNGKAPAAAPAGASLLAAASAMTASPALALVDERMSTEGTGLSLGLSNNLLGWILLGVFGLIWSLYTVYTSTLDEDEDSGGLSL

SEQ ID NO: 11912 - DNA, 141 bp, Panicum virgatum
  misc_feature: Ceres CLONE 1758894
gggaaggagccgctttggggggggaacggtgatccagcaggcggggaacggcgagcgagcccgacccgacccggaccttccagatcctccccctagccacggatggcgaaaacgacgaagccccgcccccgccgccgcctc

SEQ ID NO: 11913 - DNA, 958 bp, Panicum virgatum
  misc_feature: Ceres CLONE 1758983
  misc_feature: Encodes the peptide sequence at SEQ ID NO. 11914
agccagcggcgaggctctcgatcccccagcgcagcgtccaccaggcggcggtccgctcgcgaggccagcgccgcgccgcctccagcctccccgtccatctcctcgctcctcgtccaagcgctgccgccgtacgccgcccctgcgcctccccgtcggagacgccccttcgtctccccatctcccgcatcccggggctcaagcacgtccgcagcttctcttccgcctcggcgatccttccaccgcttcacggagtgaagctaatatggctgccttgccactgcccactgctgaagtatgtgatgctaatcctcatttgattatgaatggcgagcttcgtgctctccatcccatcttccaaatctacggaaggcgccaagtttttgctggtcctattgtgacgctgaaggtctacgaggacaatgttctgatccgtgagttccttgaggagaaaggccacggcagggtccttgtggttgatggtggtgggagtatgcgctgtgccattctgggtggcaaccctgtccagcaggcacagaacaatgggtgggctggcattgtggtgaacgggtgcatcagggatgttgatgagatcaatggctgcgacattggtgtgcgagctctcaactcccaccctatgaaggcaaacaagaagggcattggtgagaagcatgtccctgtgaccatcgcaggaactaggatttccgatggcgaatggctctatgccgatacagatggcattcttgtctcgaggatggagttgactgtgtagacccattccctctttgtacttgtgcataagaattgggcgcataaaagcagggctgctcttgtccttgcctcttggtgttctgtctgaacttgtaataatggattgtcgttgggtcacacgatttaccaggaatcattgatgttacaaattgttgtctatcaatttttggaatcgcgaactcttattctg

SEQ ID NO: 11914 - protein, 168 aa, Panicum virgatum
  misc_feature: Ceres CLONE 1758983
  misc_feature (4)..(161): Pfam Name: Methyltransf_6 Pfam Description: Demethylmenaquinone methyltransferase
MAALPLPTAEVCDANPHLIMNGELRALHPIFQIYGRRQVFAGPIVTLKVYEDNVLIREFLEEKGHGRVLVVDGGGSMRCAILGGNPVQQAQNNGWAGIVVNGCIRDVDEINGCDIGVRALNSHPMKANKKGIGEKHVPVTIAGTRISDGEWLYADTDGILVSRMELTV

SEQ ID NO: 11915 - DNA, 1076 bp, Panicum virgatum
  misc_feature: Ceres CLONE 1758985
  misc_feature: Encodes the peptide sequence at SEQ ID NO. 11916
aaaacgccactccttctcttctccctctcctctcgtctcggcctcaggatcatcagcggcaaatggcgatggcgtcgtcgagcgggctccggagctgcagcgccgtcggcgtgcccagcctgctggcgccgtcgtcgtcgcgcgccgggcggctgccgttctgcgccagcgccaccacctccggccgcgtcatcatgtcggccgagtggatgcccggccagccccgccccgcccacctcgacggctcctcccccggggacttcggcttcgaccccctcggcctcgccaccgtgccggagaacttcgagcggttcaaggagtcggaggtgtaccactgccgctgggccatgctcgccgtgcccgggatcttggtgccggaggcgctggggctcggcaactgggtgaaggcgcaggagtgggcggcggtgcccggcgggcaggccacgtacctgggcaacccggtgccgtggggcacgctgcccaccatcctggtgatcgagttcgtggccatcgccttcgcggagcaccagcgcaccatggagaaggaccccgagaagaagaagtaccccggcggcgccttcgacccgctcggcttctccaaggaccccgtcaagttcgaggagtacaaactcaaggagatcaagaacggccggctggcgatgctggcgttcgtggggttctgcgtgcagcagtcggcgtacccgggcacggggccgctggagaacctggccacccacctcgccgacccgtggcacaacaacatcggcgacatcatcatccccagaacgatctacccttgagctgatgagaccacggcggcggcgaagaacggagatgagacgagacgacgggcggacggaaagtgtgtactggatggatcaatggtgttttctgtgtgtggattactgctgggcactgcctgcgtgcgtgcagcaactgtacaaccaacgacggcggcggcgactttccggccgtcggccgggaacccattgtccttgtgtaatgtaaagcttacttgttattaaggagtagcggctactcgatcttgtgaatccacgcattttcgcttttgctcc

SEQ ID NO: 11916 - protein, 245 aa, Panicum virgatum
  misc_feature: Ceres CLONE 1758985
  misc_feature (54)..(211): Pfam Name: Chloroa_b-bind Pfam Description: Chlorophyll A-B binding protein
MAMASSSGLRSCSAVGVPSLLAPSSSRAGRLPFCASATTSGRVIMSAEWMPGQPRPAHLDGSSPGDFGFDPLGLATVPENFERFKESEVYHCRWAMLAVPGILVPEALGLGNWVKAQEWAAVPGGQATYLGNPVPWGTLPTILVIEFVAIAFAEHQRTMEKDPEKKKYPGGAFDPLGFSKDPVKFEEYKLKEIKNGRLAMLAFVGFCVQQSAYPGTGPLENLATHLADPWHNNIGDIIIPRTIYP

SEQ ID NO: 11917 - DNA, 973 bp, Panicum virgatum
  misc_feature: Ceres CLONE 1759053
  misc_feature: Encodes the peptide sequence at SEQ ID NO. 11918
actcagtacccgcacactgccagccagtgctcttccgctgctagagcgagcaccgagcagcagcgcgcagcagcgtcgaggggagaggaagtgagctccagcccgctcgctctctccggccggtgcctcgtttccttgccgctgcgcgcctcggcaagctgcagctagtggccatgggtggtggcgcggctaggagggcggccgcggcggcgctggcggtggcggtgctggccggcgtggcgtcggcggccgtgtacgaggtgggcgacaaggccgggtggaccgtcatgggcaaccccaactacgccgcctgggccagctccaagaagttccatgtcaacgacgtcgtcgtgttcacgtacaacaagcagttccacaacgtggtgtcggtgagcaaggcggcctacaagaactgcgacgccagcaagccgatcgccacctggtccacgggcaacgactccgtcgtcctcaagaccgcgggccaccactacttcctctgcggcttcccgggccactgcgccgccggccagaaggtggacatccgcatcgccgcctcctctgatgccccttccgcggctcccacccccgagcccgcagccggcggcggctccaagccctccagtggcgccacggccgcgccggcgccgcaccccaacgccgcgccccaggccctccccgcaggcagctccgtcgccgccaccgtcgccgcgtcgctgctctccctggctgcggccgtgctggcctgagcgtgaccaggggctccgtagggtcggttagggggttggcgccattgtgaattgaattgagcgctctgctgttctctgttgccgtttgagcaggagcgcctggacctgcgttcgttttgctgttttgcccttgtggttcttgctgttttgcccttgtggttctgtggatcctggtctgccttggggatttcttcctgttgtcaattaatttcctcatgctttcatgc

SEQ ID NO: 11918 - protein, 190 aa, Panicum virgatum
  misc_feature: Ceres CLONE 1759053
  misc_feature (36)..(119): Pfam Name: Cu_bind_like Pfam Description: Plastocyanin-like domain
MGGGAARRAAAAALAVAVLAGVASAAVYEVGDKAGWTVMGNPNYAAWASSKKFHVNDVVVFTYNKQFHNVVSVSKAAYKNCDASKPIATWSTGNDSVVLKTAGHHYFLCGFPGHCAAGQKVDIRIAASSDAPSAAPTPEPAAGGGSKPSSGATAAPAPHPNAAPQALPAGSSVAATVAASLLSLAAAVLA

SEQ ID NO: 11919 - DNA, 975 bp, Panicum virgatum
  misc_feature: Ceres CLONE 1759236
  misc_feature: Encodes the peptide sequence at SEQ ID NO. 11920
aaagccatctgcaagtcaagtctcactagtcactcctaatcctaaaccacaagacaccttggtgttagaagtgcaatggcgaccagcaccatggccctctcctctacggccttcgccggcaaggccgtcaacgtgccatcgtctctctttggcgaggcccgcgtgaccatgcgcaagaccgcggcgaagcccaagccggctgcctccggcagcccgtggtacggcccagaccgcgtgctctacctcggcccgctctccggcgagcccccgagctacctgaccggcgagttccccggcgactacggctgggacaccgccgggctctcggccgaccccgagaccttcgccaagaaccgggagctggaggtgatccactcccgctgggccatgctcggcgcgctcggctgcgtcttccccgagctgctcgcccgcaacggcgtcaagttcggcgaggccgtctggttcaaggcgggttcccagatcttcagcgagggcgggcttgactacctcggcaacccaagcctgatccacgcgcagagcatcctcgccatctgggcctgccaggtcgtgctcatgggcgccgtcgaggggtaccgcgttgccggcggcccgctcggcgaggtcgtcgacccgctctaccccggcggcagcttcgacccgctcggcctcgccgacgatcccgaggccttcgccgagctcaaggtcaaggagctcaagaacggccgcctcgccatgttctccatgttcggcttcttcgtgcaggccatagtcaccggcaagggcccgcttgagaacctcgccgaccatctcgccgaccccgtcaacaacaacgcctgggcctacgccaccaacttcgtgcccggcaagtgaggggtcggttcccgaactgttcgatctgtaggaggtccggatgtgagcgcgcattggtttcagtttgtaccatgatataaattactgggttccaacatccaaccg

SEQ ID NO: 11920 - protein, 259 aa, Panicum virgatum; identical to SEQ ID NO: 10184
  misc_feature: Ceres CLONE 1759236
  misc_feature (58)..(226): Pfam Name: Chloroa_b-bind Pfam Description: Chlorophyll A-B binding protein

SEQ ID NO: 11921 - DNA, 929 bp, Panicum virgatum
  misc_feature: Ceres CLONE 1759287
  misc_feature: Encodes the peptide sequence at SEQ ID NO. 11922
cctgtcctcctctcctctacgcgctcgctcgcgccgccgccgccgccgccgccgccgcacttcccgtctggtctcgtctgcgcagcaaaccctagcagcaggtgggtcggttatcgacggacagtagccatgagtaagttgcaaactgaggccctcaaggaggccatctccctggtcgtgtcggaggcaagggagaagaacaggaagttcacagagaccatcgagctccagattggactgaagaactatgatccgcaaaaggacaagcgtttcagtagctccgtcaagctgccccacatccctcgccccaagatgaaggtctgcatgcttggtgatgcccagcacgtggaggaggctgagaagatcggtcttgattacatggatgttgaagctcttaagaagatgaacaagaacaagaagcttgtcaagaagcttgctaagaagtaccatgctttcttagcttctgaggctattatcaagcagattccccgtctccttggtcctggtctcaacaaggcaggcaagttcccaactttggttactcaccaggagtctctggaatcaaaggtgaatgagacgaaagctacagtgaagttccagctcaagaaggttctttgcatgggtgtggctgtgggtaacctgtcgatggaggagaagcagatccagcaaaacatccagatgagcgtcaacttcctggtttcattgctgaagaagaattggcagaacgtgaggtgcctgtacatcaagagcaccatggggaagccaaacagggtgttctaagttgctgcgttcatgcccttttaaaaccaactctagtccgtagtggagtttgttatgggatatatgcttatgcagtaatctatcgtactgttttgcaaattttgtgcctaatttgaacaagagtggcattatgatccactagtttcacc

SEQ ID NO: 11922 - protein, 216 aa, Panicum virgatum
  misc_feature: Ceres CLONE 1759287
  misc_feature (10)..(212): Pfam Name: Ribosomal_L1 Pfam Description: Ribosomal protein L1p/L10e family
MSKLQTEALKEAISLVVSEAREKNRKFTETIELQIGLKNYDPQKDKRFSSSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPNRVF

SEQ ID NO: 11923 - DNA, 882 bp, Panicum virgatum
  misc_feature: Ceres CLONE 1759291
  misc_feature: Encodes the peptide sequence at SEQ ID NO. 11924
cctatgctgtatttaggagagaggagaaaggaaaaaccgagctctaatctccctccccgacggagatcgcctgctcctggagcaaccgccgctccttcccgcaccggcgcggacgccactcccgccagaaccgtatcaacctcggactccctgcagttcttgtgctaggatctgtgccgtggggcgtcaaacagctcgcagatggacggtggcgggggcgacctgcggagcactatcaagaagtggaacgtcttatacccggtctacctcaactccaagaagacggttgctgaaggccgccgcatcgccgccagcaaggcctgccctgaccccacctgcatcgagatagccgactgctgctcgcacctcaagatcccccacgccattgagcttgataaggcgtaccctcgggatttcttccaggtggggagggtcagggtgcagctcaagaaggatgacggctcccctgtcaatcctgctattaaaacaaagaagcagctgatgatccaaatagcagagctagttcccaagcatcatggaaggacaaagaagcaggaatcagcactcagctcttcagctggtggcagttcgaagaacacaaaaggtggaaaaaagaaaaagtgatggcagtataatcttgcatttttctgtccatccccgtactaagtttatgtggaagtgtccttctgaggcctgaaaatcattgtgacttgtgggattttgatccatttgaaaatttccatacacatctttcttgtagtatccagatctagatgtgctaaacctaaaaatatggcagccatgacatgggatccaatttacagatgctgttgtttaatagaactttgtttactaacacagcggagatgctttattcatttc

SEQ ID NO: 11924 - protein, 140 aa, Panicum virgatum
  misc_feature: Ceres CLONE 1759291
  misc_feature (16)..(112): Pfam Name: SRP19 Pfam Description: SRP19 protein
MDGGGGDLRSTIKKWNVLYPVYLNSKKTVAEGRRIAASKACPDPTCIEIADCCSHLKIPHAIELDKAYPRDFFQVGRVRVQLKKDDGSPVNPAIKTKKQLMIQIAELVPKHHGRTKKQESALSSSAGGSSKNTKGGKKKK

SEQ ID NO: 11925 - DNA, 843 bp, Panicum virgatum
  misc_feature: Ceres CLONE 1759292
  misc_feature: Encodes the peptide sequence at SEQ ID NO. 11926
tttggttccacacttccatttttttttctcccaaaaacatgggcgccgatggcagcggcagcggcggccggaagggctcgtcgccggcgaagccatccgagggccggacctcgagcttgctcgctggactcccctcccgcgggaacttcacggagagcgacatcgcttctagcatgggaggcctcaaggtttatatctgccttcacgacacggctcctccagagggacaagttgtgaaaacggacacgaacaatattctaatcagagctctccagttgaacaaacacaaaagtgaggccaaagatgtaagctgtaagacaccaggagaaagcagcagaggaaaaaggaatgctgccagaaatttagatggcaagaatccatcaaaaagacctaacattggtagccctggaggatcttctagccatgaagaatcgtcatctggtttctctgagctgacgcttcagtcatttactgtggaaaagttacgctctcttctaaaagagagggggctctcaccaaaaggcaaaaaggatgaactgattgctcgcttaagagaggcttcacgttgatttgaactgcagcgttgttgatctagtgccaaccacattttgttgggtgtcgctgaagagcagactgaatgaatatcttgctgtcagtaatgctaattgtcatgtctgaaatttctggaatgtaagggaattaccccaagttctatacttggagctatcgagaaagacatgagaagcttatcatttgctgtatgatccatacttcctgcttgtagagattccctgttgctgcagatagtacagaaatggggagtagctgatattttcacattgc

SEQ ID NO: 11926 - protein, 176 aa, Panicum virgatum
  misc_feature: Ceres CLONE 1759292
  misc_feature (141)..(175): Pfam Name: SAP Pfam Description: SAP domain
MGADGSGSGGRKGSSPAKPSEGRTSSLLAGLPSRGNFTESDIASSMGGLKVYICLHDTAPPEGQVVKTDTNNILIRALQLNKHKSEAKDVSCKTPGESSRGKRNAARNLDGKNPSKRPNIGSPGGSSSHEESSSGFSELTLQSFTVEKLRSLLKERGLSPKGKKDELIARLREASR

SEQ ID NO: 11927 - DNA, 800 bp, Panicum virgatum
  misc_feature: Ceres CLONE 1759341
  misc_feature: Encodes the peptide sequence at SEQ ID NO. 11928
agcatccggccacgtgtgccctcaccacacagcgcgagagggcagcaggcgtacgtgcacaataaccgttccactttggtcgcatcgcacgccacagcaacgagagagcgagcgagcggaaaaaaggagaggccgagaacgaagccgagctagctggtgctccggcgtgatggcggccacggcgtactccgtggcgctcctcggcggcgcgcgcctccccgccgccccgcgctccgccctcctcccgcgccgcagcgcctgccagctccgcctccagcaagatgcgccgaggctctccctgctccgcgtgaaggccgcctccgaggacacctcctcggcctccgccgacgagctcatcgaggacctcaaagccaagtgggacgccgttgaggacaagcccaccgtgctcttgtacggcggcggcgccatcgtcgccctctggctgacctccgtggtcgtcggcgccatcaacgccgtgccgctgctgcccaagatcatggagctcgttggcctcggctacaccggctggttcgtctaccgctacctcctcttcaaggaaagtcggaaagacttggctagcgacattgagaccttgaagaagaagatcaccggaacagaataaacacacgctcttggagagttttgagtggttctttcatcttggggggaaaatatgtaatgggagaaccgtctgcttgagtactactgccgatttgtgctatatatctggatacaaaggaagctttgttatgttgtgcagtaacattgtagtttgaatatatcgcactaccagtttgttt

SEQ ID NO: 11928 - protein, 150 aa, Panicum virgatum
  misc_feature: Ceres CLONE 1759341
  misc_feature: SWISSPROT Homolog: EC 6.1.1.9 Valine--tRNA ligase
MAATAYSVALLGGARLPAAPRSALLPRRSACQLRLQQDAPRLSLLRVKAASEDTSSASADELIEDLKAKWDAVEDKPTVLLYGGGAIVALWLTSVVVGAINAVPLLPKIMELVGLGYTGWFVYRYLLFKESRKDLASDIETLKKKITGTE

SEQ ID NO: 11929 - DNA, 1200 bp, Panicum virgatum
  misc_feature: Ceres CLONE 1759348
  misc_feature: Encodes the peptide sequence at SEQ ID NO. 11930
ataatccaccgactaccaagaagcctccgaaagcggtctcgtcggcctgagacttggagacgagcgcccgaggccgcgggagccatggtcctcgtggcgccgggctgctcccccgcatcgtcactccccgctcgttctgccacttccaggagaaaatgtagcaccaccagacagagattcgtcagatgctctctgaatgaggaaacgccaccgaacaaacatggagtagtatccaatcagataatctcttgcttcgctgcttcgctcgtgttcatctctccacctagtcaggctattcctgcagaagcctctgcccagctgggcttgtgccagattgcaacagtggcagccattgatactgcttcagttcctctaaaatttgacagcccttcagatgaaggcagcggggggatgatgatgatgaggggtatgactgccaagaactttgatccagttcgctactcgggtagatggtttgaggtagcctcactgaaacgtggatttgctggtcaaggacaagaagactgtcattgcactcagggtgtgtattcatttgatgagaagccacgctcaatccaggtggatacattctgtgtccacggtggacctgatggatacataactggtattcggggcagggtgcaatgcctgtctgaagaagacatggcgggtgctgagacagatcttgagagacaagagatgatccgtgagaaatgctttcttcggttcccgacactaccgttcatacccaaggaaccctatgatgttcttgcaactgactatgacaattatgcaattgtatctggagctaaggatacaagctttattcagatatactcaagaacacctaaccctgggccagaattcatcgagaagcacaagtcctatgttgccaacttcggctacgacccgagcaagatcaaggacaccccgcaggactgcgagtacatgtcctcggaccagctcgccctgatgatgtcgatgcccgggatgaatgaggccctaacgaatcagttcccagatctaaagctgaaggcaccaatagcactgaacccattcacaagtgtgtttgaaaccctgaagaaactgcttgaactgtacttcaagtaaagggagtgttagtgtagcatggttcagtattcaactgtccgcttctccacttggagcctcaattgaataaagttcagttcgcttgttctg

SEQ ID NO: 11930 - protein, 341 aa, Panicum virgatum
  misc_feature: Ceres CLONE 1759348
  misc_feature (121)..(284): Pfam Name: Lipocalin_2 Pfam Description: Lipocalin-like domain
MVLVAPGCSPASSLPARSATSRRKCSTTRQRFVRCSLNEETPPNKHGVVSNQIISCFAASLVFISPPSQAIPAEASAQLGLCQIATVAAIDTASVPLKFDSPSDEGSGGMMMMRGMTAKNFDPVRYSGRWFEVASLKRGFAGQGQEDCHCTQGVYSFDEKPRSIQVDTFCVHGGPDGYITGIRGRVQCLSEEDMAGAETDLERQEMIREKCFLRFPTLPFIPKEPYDVLATDYDNYAIVSGAKDTSFIQIYSRTPNPGPEFIEKHKSYVANFGYDPSKIKDTPQDCEYMSSDQLALMMSMPGMNEALTNQFPDLKLKAPIALNPFTSVFETLKKLLELYFK

SEQ ID NO: 11931 - DNA, 560 bp, Panicum virgatum
  misc_feature: Ceres CLONE 1759359
  misc_feature: Encodes the peptide sequence at SEQ ID NO. 11932
aaacgacccataaaacccacacgcggaggcgaagtaagcgaaggggggcgagctcaggagaaagacgcaaaggtcccagggaccagtaacgcaaagagcgggcggggtgtttggctcagatcgggcggccgccatggcggatcagttcgcggattcggcgaacaatgtgatcatcgaggaggtgaacaagggcctgaacccaggaatgatagtcctgcttgtagttgcaagcttcctgctgctctttttcgtggggaactatgcgctgtatgtgtacgcgcagaagacacttccgcctaagaagaagaagcctgtctccaagaagaagctgaagagggaaaaactgaagcagggcgtctccgctccaggagagtaaacagccatgctgctgatctcctcctgagctcctctttacatgataaaaaatatatatagaccagctggagctgcagtgtctgaagtgagtctgtagaatctttgtcttgaatggtacatttgtattgtgtttcagcaactgatgaacctttagcctaaattgagctactccgttgtttcttgtc

SEQ ID NO: 11932 - protein, 80 aa, Panicum virgatum
  misc_feature: Ceres CLONE 1759359
  misc_feature (10)..(80): Pfam Name: S1FA Pfam Description: DNA binding protein S1FA
  misc_feature: The sequence is a functional homolog of SEQ ID NO 1769 in the 11/479,226 US patent application
  misc_feature: The sequence is a functional homolog of SEQ ID NO 2604 in the 10/374,780 US patent application
  misc_feature: The sequence is a functional homolog of SEQ ID NO 960 in the 10/225,066 US patent application
  misc_feature: The sequence is a functional homolog of SEQ ID NO 1761 in the 11/479,226 US patent application
  misc_feature: Useful for making plants with modulated biomass
MADQFADSANNVIIEEVNKGLNPGMIVLLVVASFLLLFFVGNYALYVYAQKTLPPKKKKPVSKKKLKREKLKQGVSAPGE

SEQ ID NO: 11933 - DNA, 883 bp, Panicum virgatum
  misc_feature: Ceres CLONE 1759420
  misc_feature: Encodes the peptide sequence at SEQ ID NO. 11934
accgtgaagaacatccgtgcgctgtgcttcctcctctccccctctttctctctgtgaatcgagataagatctttgatgtccttgttggtggattgttcttgcagaggacgagcgcgagacgaagcacctggaggccctggacgccgcggcgtcgcgtctccggctgctccagatggacctcctcgaccctgcctccgtccgggcggcggtcgagggcgcccgtggcgtcttccacctggcctcccccgtgacgctgcagctgccacaagaccccgagaaggagctgctggaacctgcagtgaaggggacgctcaacattctccgcgccgcgaaagactctggaatcagtcgtgttgttctcatgtcgtcaaaggcggccatggtcccaaatcctgactggcctgcggacaaggtcatagatgacgactcctgggccgacgttgagctcctgaggaagcgtcagctctggtacaacgtgtccaaaacgctggccgagaaagctgcttgggatttcagcaccaaggagggactgcagctggtcgtgatcaatgcagggatggtgctggggccgtttctgacgccgtcagtcaatgctagcctccattgttttttgcagctgctggaaggccagaggatggacttggacctgtacatgggctgcgtcgatgtcagagacgtgtcaagctctctgatagcgctgcacgagagcccgtcggcacagggtcgccacttgtgcatggaatccgtcgaacgcctggttgatttcaccaaccatgttgctgatcttttccctgagctcccagtccagaggtcaaaccgtttcatcgaacacaaatcattgacccatgagatcgatgaaacaatgctctgtgttcacttggcc

SEQ ID NO: 11934 - protein, 236 aa, Panicum virgatum
  misc_feature: Ceres CLONE 1759420
  misc_feature (1)..(190): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature: Useful for making plants with altered carbohydrate content
MDLLDPASVRAAVEGARGVFHLASPVTLQLPQDPEKELLEPAVKGTLNILRAAKDSGISRVVLMSSKAAMVPNPDWPADKVIDDDSWADVELLRKRQLWYNVSKTLAEKAAWDFSTKEGLQLVVINAGMVLGPFLTPSVNASLHCFLQLLEGQRMDLDLYMGCVDVRDVSSSLIALHESPSAQGRHLCMESVERLVDFTNHVADLFPELPVQRSNRFIEHKSLTHEIDETMLCVHL

SEQ ID NO: 11935 - DNA, 937 bp, Panicum virgatum
  misc_feature: Ceres CLONE 1759463
  misc_feature: Encodes the peptide sequence at SEQ ID NO. 11936
gaacttccaggcccgccgaaaccacccgcgctcgtctctgccctctccctgccttcgtctccgtcttcggcggcgcggcggcggcagccgcggaggaggaggagatgctgtccggtgacatccccccgaaccagaccatttacgtcaacaacctcaacgagaaggtcaagaaagaagagttgaagaggtcactttatgccctgtgctcacagtatggaaggatactggatgtggtggccttgaaaactcaaaaactgagggggcaagcatgggtggtgtttagcgaaattacagctgctaccaatgctttccggggattgcaagactttgatttctacggcaaaaaaatgcgagtccaatatgcaaaaacaaaatctgactgtattgcaaaagaagatggtacttatgctcctaaggagaaaagaaagaagcaggaggagaaagctgctgagaaaaaacgacgagcagaagaggcacaagaatctggtcccaatgcttctactcaaagcaatggaactggataccaagcctctcgcctgggcaaggtctctcaagagcatcttcctcccaacaacatcctcttcatccagaacttgccggatcagaccacaagcatgatgctccagatcctgttccaacagtaccctggcttccgggaagtgcggatgatcgaagccaagccaggcatcgctttcgtggagtttgaggacgacagccagtcccatatcgcgatgcaggccctccagggcttcaagatcaccccagagaaccccatggctatatcctacgccaaaaaatgagaagcgcccgaaacccctgtactcgtaagatctttttccgctccgcctgtcggaatcaacctgcagtaccagctttccgaccgtgtatttttggaaagaactcgcttaatttagaagttttaactctttctactttt

SEQ ID NO: 11936 - protein, 231 aa, Panicum virgatum
  misc_feature: Ceres CLONE 1759463
  misc_feature (159)..(226): Pfam Name: RRM_1 Pfam Description: RNA recognition motif. (a.k.a. RRM, RBD, or RNP domain)
  misc_feature (12)..(84): Pfam Name: RRM_1 Pfam Description: RNA recognition motif. (a.k.a. RRM, RBD, or RNP domain)
  misc_feature: Useful for making plants with modulated nitrogen use efficiency
MLSGDIPPNQTIYVNNLNEKVKKEELKRSLYALCSQYGRILDVVALKTQKLRGQAWVVFSEITAATNAFRGLQDFDFYGKKMRVQYAKTKSDCIAKEDGTYAPKEKRKKQEEKAAEKKRRAEEAQESGPNASTQSNGTGYQASRLGKVSQEHLPPNNILFIQNLPDQTTSMMLQILFQQYPGFREVRMIEAKPGIAFVEFEDDSQSHIAMQALQGFKITPENPMAISYAKK

SEQ ID NO: 11937 - DNA, 836 bp, Panicum virgatum
  misc_feature: Ceres CLONE 1759508
  misc_feature: Encodes the peptide sequence at SEQ ID NO. 11938
aactacccccagtcaagcagccccgccccgcccgggaaccttccagaagcgcaagattccaaggccgtcgccttcccacccgttcctcgccgcgggggtcgcctgagatcacattaacaatggtgaaggctgttgctgtgcttggtagcagcgagggtgtcaagggcaccatctacttcacccaagagggagatggccccaccactgtcaccggaagtgtctctggcctcaagcctggcttccatgggttccatgtgcatgcacttggtgacacaacaaatggctgcatgtcaactggaccgcattacaaccctgcgggcaaggagcatggagcaccagaagatgagaaccggcatgctggtgatctcggaaatgtcaccgccggagatgatggtgttgctaacttcactgttaccgacagccagatcccactgactgggccaaactcaatcattggcagagctgttgttgttcatgctgatcctgatgatcttggaaagggtgggcacgagctgagcaagagcactggaaacgctggtggccgtgttgcctgcgggatcatcggactccagggctgagagtgatcaccgaactcaagtgccgaaagtgtcgtcgtccccgctgtcaccactggaccagcctgagcatcctctggatatgtgaaataagagcgcctgatctatgatcggcgtgtttgtgttctcgctcctgtagcacctaccgatgaactgaaacctgtgttggtgtaacgctgtttcacctggacctgtgtttcatacatttcgctttgagaacgcctggaccgatctgtggaaataagaaggcacttgttgtgg

SEQ ID NO: 11938 - protein, 152 aa, Panicum virgatum
  misc_feature: Ceres CLONE 1759508
  misc_feature (1)..(152): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGSSEGVKGTIYFTQEGDGPTTVTGSVSGLKPGFHGFHVHALGDTTNGCMSTGPHYNPAGKEHGAPEDENRHAGDLGNVTAGDDGVANFTVTDSQIPLTGPNSIIGRAVVVHADPDDLGKGGHELSKSTGNAGGRVACGIIGLQG

SEQ ID NO: 11939 - DNA, 719 bp, Panicum virgatum
  misc_feature: Ceres CLONE 1759518
  misc_feature: Encodes the peptide sequence at SEQ ID NO. 11940
atcttgcgccgccgcctcctcccatccgctcctccatccccctccctgctcacgcgacgtcaccggtcccgcgccgccctccaccgccaagatgaacaaggagaggctcatgaagatggccggcgccgtccgcaccggcgggaagggcaccgtccgcaggaagaagaaggctgtccacaagacggccaccacggacgacaagaggctgcagagcacgctcaagagagtaggagtcaataccattcctgcaatcgaggaggtcaacatcttcaaggacgacctcgtcatccagttcttgaatcccaaagtccaagcgtccatcgctgcaaacacatgggtggtcagtggatccccacagacgaaaaagctacaagatgttctccctgggatcattaaccagttgggtcctgacaacatggagcacctgaagaggattgctaaagagatgcagaagcaggtggctgctgctggtgcagcagcacaggccaaggaagataatgatgatgatgttcccgagcttgttccaggagagacttttgaggaagtagctcaggaggcaaaggcctaatcatagactccaaatagtgaaatgttactcgaccgctgctatgtggtcatggttttcttgtgatggcactgttttgctccccccacttaggccagccagccaccatttgtattcgcagtcggaaacttttagtttctccaagcttttacct

SEQ ID NO: 11940 - protein, 158 aa, Panicum virgatum
  misc_feature: Ceres CLONE 1759518
  misc_feature (34)..(92): Pfam Name: NAC Pfam Description: NAC domain
  misc_feature: The sequence is a functional homolog of SEQ ID NO 1614 in the 11/479,226 US patent application
  misc_feature: The sequence is a functional homolog of SEQ ID NO 784 in the 10/412,699 US patent application
  misc_feature: Useful for making plants with modulated biomass
  misc_feature: The sequence is a functional homolog of SEQ ID NO 1617 in the 11/479,226 US patent application
  misc_feature: The sequence is a functional homolog of SEQ ID NO 786 in the 10/412,699 US patent application
MNKERLMKMAGAVRTGGKGTVRRKKKAVHKTATTDDKRLQSTLKRVGVNTIPAIEEVNIFKDDLVIQFLNPKVQASIAANTWVVSGSPQTKKLQDVLPGIINQLGPDNMEHLKRIAKEMQKQVAAAGAAAQAKEDNDDDVPELVPGETFEEVAQEAKA

SEQ ID NO: 11941 - DNA, 543 bp, Panicum virgatum
  misc_feature: Ceres CLONE 1759546
  misc_feature: Encodes the peptide sequence at SEQ ID NO. 11942
gaaggcaaatcacgcgcaaagccacctccgcgtcatcgtcgtcgtctcctctcctctcctctccaagcaagcgaaacggcctcgagatcttctccgcgccgccatggacgccgtggactcggtggtcgacccgctccgggagttcgccaaggacagcatccgcctcgtcaagcgctgccacaagcccgaccgcaaggaattcaccaaggtggcggcgcggacggcgatcggcttcgtcgtcatgggcttcgtcggcttcttcgtcaagctcatcttcatccccatcaacaacatcatcgtcgggtcaggctgatccggtcccagcaggtgaggggccgcaggactggacaatggcaacaataccttggaagcagttttcagccctatatcataaagaatcatttaggttttctttttgttaaggactgctcctcctgttttgtctcgaaagatttggtacacttgaaactctttttgtaacctgatactgattaggcatgcgtgagctaacaggtaacaaaatccaatggtgacagtttccgc

SEQ ID NO: 11942 - protein, 69 aa, Panicum virgatum
  misc_feature: Ceres CLONE 1759546
  misc_feature (10)..(66): Pfam Name: SecE Pfam Description: SecE/Sec61-gamma subunits of protein translocation complex
MDAVDSVVDPLREFAKDSIRLVKRCHKPDRKEFTKVAARTAIGFVVMGFVGFFVKLIFIPINNIIVGSG

SEQ ID NO: 11943 - DNA, 758 bp, Panicum virgatum
  misc_feature: Ceres CLONE 1759559
  misc_feature: Encodes the peptide sequence at SEQ ID NO. 11944
cggactctttccccttcttcctccgcggcatcgggaggcgggagggagagaggcgaagcggataaggctcgctccagaaccccccatggcggccttcaaccccgccgcggcgctgacgtcgccggctccgtgccggccctccgccctcgccgcgcgtctgccggcggctcggtcgctgccgctccgctgctcgccgccagccctgggcctcaggcgtcggaccgggcattctcggcggggttcagccgcgctccgggtggaagctaagaagcaaacattctcttcatttgatgagttgctggagaagtctgagaagcctttactagttgacttctatgcaacttggtgtggcccatgccaatacatggttcccatacttcaagaagtgagtgaaaagttaagcgacaaggttcaagttgtgaaaattgatactgagaagtacgcagccattgcaagtcgttacagaattgaagcattgccaacttttatcatcttcaagaacaggaaaccttgctatcgttttgagggagcgttgcctgctaaccagatgattgaacaaattgagagtgctttggctgtctcagagtagcacacatggtgagcagagcagaaaagttttctgaaaaatatgtgctgctactgctaccccgtaacatgtgcctctgcatgttaatgcttcattattgttcaaaacattctcaattttttctacatcattacagtctgaaactatgatattgaaaatcttgtaatgattt

SEQ ID NO: 11944 - protein, 167 aa, Panicum virgatum
  misc_feature: Ceres CLONE 1759559
  misc_feature (59)..(162): Pfam Name: Thioredoxin Pfam Description: Thioredoxin
  misc_feature: SWISSPROT Homolog: EC 1.8.1.8 Protein-disulfide reductase
MAAFNPAAALTSPAPCRPSALAARLPAARSLPLRCSPPALGLRRRTGHSRRGSAALRVEAKKQTFSSFDELLEKSEKPLLVDFYATWCGPCQYMVPILQEVSEKLSDKVQVVKIDTEKYAAIASRYRIEALPTFIIFKNRKPCYRFEGALPANQMIEQIESALAVSE

SEQ ID NO: 11945 - DNA, 1062 bp, Panicum virgatum
  misc_feature: Ceres CLONE 1759574
  misc_feature: Encodes the peptide sequence at SEQ ID NO. 11946
acttcctcccctcccaccccccggcggcggcctccctctcctccctccttcccacgcgcccgcaggtcagcgagatgtcggcggcggaggcgaaggcggcgccggtgccggagtcggtgctgcggaagagcaagcgcgaggagcagtgggcggcggacaagaaggagaaggagctcgccgacaggaagaaggctctcgagagccgcaagatcatcagcgcgcgcgccaagcagtacgcgcaggagtacgacgcccaggataaggagcttgtgcagctcaaacgtgaggccaggttgaagggtgggttctatgtcagccctgaggccaagcttctgtttgtgatccgcatccgcggtatcaatgccatgcaccccaagacccgcaagatcttgcagcttctgcggttgaggcagatcttcaatggtgtcttcctcaaggttaacaaggctaccattaacatgctgcgcagggtcgagccatatgttgcatatggatacccgaacctgaagagtgttagggaattgatctataagagaggttatgggaagctgaacaagcagaggattcctctgagcaataacagtgtcattgaggagggccttgggaaccacaacatcatctgcattgaggatcttgtccatgagatcatgactgttggcccacacttcaaggaggctaataacttcctctggccattcaagctgaaggcaccgcttggtggcctgaagaagaagaggaaccactatgttgagggtggtgatgccggtaaccgtgagaactacatcaacgagctaatcaagaggatgaactaggttcttgtatcctgtgagaatgatttcaatgtttgagaagttatactctagggagttgatgctggataatggtggatgtgcaattttggctttccaaacagaatgtagacttgctctttcagtgagacttccaataggatttttctcttccaaacagaatgtagacttgtacctgtttattttgctgttctttcttgagatggttgtgtatgctgtcgtttcgtcatgtttcttagctttggttagttgc

SEQ ID NO: 11946 - protein, 245 aa, Panicum virgatum
  misc_feature: Ceres CLONE 1759574
  misc_feature (86)..(137): Pfam Name: Ribosomal_L30 Pfam Description: Ribosomal protein L30p/L7e
  misc_feature (14)..(84): Pfam Name: Ribosomal_L30_N Pfam Description: Ribosomal L30 N-terminal domain
MSAAEAKAAPVPESVLRKSKREEQWAADKKEKELADRKKALESRKIISARAKQYAQEYDAQDKELVQLKREARLKGGFYVSPEAKLLFVIRIRGINAMHPKTRKILQLLRLRQIFNGVFLKVNKATINMLRRVEPYVAYGYPNLKSVRELIYKRGYGKLNKQRIPLSNNSVIEEGLGNHNIICIEDLVHEIMTVGPHFKEANNFLWPFKLKAPLGGLKKKRNHYVEGGDAGNRENYINELIKRMN

SEQ ID NO: 11947 - DNA, 664 bp, Panicum virgatum
  misc_feature: Ceres CLONE 1759605
  misc_feature: Encodes the peptide sequence at SEQ ID NO. 11948
tgttcagttcaggactctatagcttgcttgcttgccgctgccgtggtgtcagtgtgagagagagagagcaagaagaggagagggtgagggatggaaggggacagcttctccggcatggcgaacggcggcggcggcgggcaggcggacgggaagctgatccagacgttccacaagagcttcgtgcaggtgcagagcctgctggaccagaaccggctgctcatcagcgagatcaaccagaaccacgagtcccgggcgcccggcaacctcacccgcaacgtcggcctcatccgggagctcaacaacaacatccgccgcgtcgtcagcctctacgccgacctctccgcctccttcgcccgcaacatggacgcctcctccgacggcgactcctccggcaccgctacgctccgcgccgccgacggccgcgccggccagaagcgcgtccgccccggctagctagctccatctcttggtcttgccactactaggcttaggcttagccttttttctcgcagttctctcttcttgttcattaatcctccttgtccttgctgcaaatgcttcagctgcatcagtgattaattagtgtatgattagtgagaaacagaaagctgttatgtggtagttgctgcaatgatggtgagacgagatgttcatgtgtgttggc

SEQ ID NO: 11948 - protein, 120 aa, Panicum virgatum
  misc_feature: Ceres CLONE 1759605
  misc_feature: Useful for making plants with altered lignin content
MEGDSFSGMANGGGGGQADGKLIQTFHKSFVQVQSLLDQNRLLISEINQNHESRAPGNLTRNVGLIRELNNNIRRVVSLYADLSASFARNMDASSDGDSSGTATLRAADGRAGQKRVRPG

SEQ ID NO: 11949 - DNA, 849 bp, Panicum virgatum
  misc_feature: Ceres CLONE 1759690
  misc_feature: Encodes the peptide sequence at SEQ ID NO. 11950
atcctcccagtcctcaactcctcacccccagcatccaactacccccagtcaagccgccccgccccgccccgcctgggaaccttccagaagcgcaagactccaaggccgtcgccctcccacccgttcctcgccgcgggggtcgcctgagatcacataaacaatggtgaaggctgttgctgtgcttggtagcagcgagggtgtcaagggcaccatcaacttcacccaagagggtgatagccccaccactgtcaccggaagtgtctctggcctcaagcctggcctccatgggttccatgtgcatgcacttggtgacacaacaaatggctgcatgtcaactggaccgcattacaaccctgcgggcaaggagcatggagcacaagaagatgagaaccgccatgctggtgacctcggaaatatcacggtcggagatgacggtgttgctaacttcactattactgacagccagatcccactgactgggccaaactcaatcattggcagagctgttgttgttcatgctgatcctgatgatcttggaaagggtaatgctgctacttcatgtttacgcttgtgccttttatgtgcacatgtagtccattttgagttaaagttctgtctattagaacaattgttcttatttcagatagatgtacaaacaatcactattcactatagatttctgtatattaaacgccatgtaagagtatctctaattatctgattattaaacgccagagaaaaaaaaatgtagtcattgctatgcttgtacggtcctgattccctgaaaaccccagtgcctttggcatttctcagtcaggaaggaatttatagtgtcttacttgagtcgtc

SEQ ID NO: 11950 - protein, 186 aa, Panicum virgatum
  misc_feature: Ceres CLONE 1759690
  misc_feature (1)..(142): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGSSEGVKGTINFTQEGDSPTTVTGSVSGLKPGLHGFHVHALGDTTNGCMSTGPHYNPAGKEHGAQEDENRHAGDLGNITVGDDGVANFTITDSQIPLTGPNSIIGRAVVVHADPDDLGKGNAATSCLRLCLLCAHVVHFELKFCLLEQLFLFQIDVQTITIHYRFLYIKRHVRVSLII

SEQ ID NO: 11951 - DNA, 709 bp, Panicum virgatum
  misc_feature: Ceres CLONE 1759694
  misc_feature: Encodes the peptide sequence at SEQ ID NO. 11952
atggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatatatatatatatatatatatatatatatatatatataaataaacacatatatatgtgtgatatatatatatatatatatatactataatatataggtatgcaaatatactatatgcaaaatgcatgctagctgtggctatttatatctggtttatttgcaattgatc

SEQ ID NO: 11952 - protein, 149 aa, Panicum virgatum; identical to SEQ ID NO: 10105
  misc_feature: Ceres CLONE 1759694
  misc_feature (58)..(133): Pfam Name: Fer2 Pfam Description: 2Fe-2S iron-sulfur cluster binding domain

SEQ ID NO: 11953 - DNA, 283 bp, Panicum virgatum
  misc_feature: Ceres CLONE 1759753
  misc_feature: Encodes the peptide sequence at SEQ ID NO. 11954
cgatgggatgcgcttcgtgcagcgcggccgctgctgggagtacaggcagcagccggcgatcgtccgcctcaccaggcccacccgccccgacaaggcccgccgcctcggcttcaaggccaagcagggctatgttgtttaccgtgtccgtgtcaggcgtggtggtaggaagaggcccgtgcccaagggtattgtctatggcaagccaaagcaccagggtattttttttttcaagttccagaggaacaagaggtctgttgctgaggagagggcttttttttccccc

SEQ ID NO: 11954 - protein, 93 aa, Panicum virgatum
  misc_feature: Ceres CLONE 1759753
  misc_feature (1)..(93): Pfam Name: Ribosomal_L15e Pfam Description: Ribosomal L15
DGMRFVQRGRCWEYRQQPAIVRLTRPTRPDKARRLGFKAKQGYVVYRVRVRRGGRKRPVPKGIVYGKPKHQGIFFFKFQRNKRSVAEERAFFS

SEQ ID NO: 11955 - DNA, 746 bp, Panicum virgatum
  misc_feature: Ceres CLONE 1759793
  misc_feature: Encodes the peptide sequence at SEQ ID NO. 11956
aagcagctagctagcctatctagcattgattacggcaccacaagaaagaagaagctagcatcaatggccgcctcgatccccctgctgctgctcctggccgccaccctggcagccagcgccagcgccgcgaccttcaccatcaccaacaagtgcgggttcacggtgtggccggcggcgacgccggtgggcgggggcacgcagctgaactccggcgcgacgtggaccatcaacgtgcccgcgggcaccagctccggccgcgtctggggacgcacgggctgctccttcagcggcaaccgcgggagctgtcagacgggcgactgcggcggcgcgctcgcctgcacgctgtccggccagccgccgctgacgctggccgagttcaccatcggccgccgccaggacttctacgacatctcggtcatcgacggcttcaacatcggcatggccttctcgtgcagcaccggcgtcgggctggtgtgcagggactcggggtgccctgacgcgtaccacaaccccaacgacatgaagacccatgcctgtggcggcaacagcaactaccaggtcaccttctgcccgtgatgaggcggctgtaatgcatgtatcggagagtacttgatttgcttgcaggaagaataatatgtatatgcaagcccaagcgtgcacgcatgtatatgtatgtatgtagctggatctctgtacctactccgtataccatatggtatactatacaataagactatgttcttgcc

SEQ ID NO: 11956 - protein, 170 aa, Panicum virgatum
  misc_feature: Ceres CLONE 1759793
  misc_feature (28)..(170): Pfam Name: Thaumatin Pfam Description: Thaumatin family
MAASIPLLLLLAATLAASASAATFTITNKCGFTVWPAATPVGGGTQLNSGATWTINVPAGTSSGRVWGRTGCSFSGNRGSCQTGDCGGALACTLSGQPPLTLAEFTIGRRQDFYDISVIDGFNIGMAFSCSTGVGLVCRDSGCPDAYHNPNDMKTHACGGNSNYQVTFCP

SEQ ID NO: 11957 - DNA, 803 bp, Panicum virgatum
  misc_feature: Ceres CLONE 1759801
  misc_feature: Encodes the peptide sequence at SEQ ID NO. 11958
acttcctcgagctcagtgctatcctacactactgaagaaatggcaagcctgcagaatctgatttgctccgtatctaaacaactggttgcgccaaattttgcgttgactgccaaactgaatggggcttctcactctgttgtcccagcaagctcaagcggagcatcttcgcatgaaaagaatgtcacgaaaaggcagttagctttgcttggtgctggagcattagccaccggcctactgaagacaagctccgcatttgctgaagaagtacctaagaattacaagtcttacgtggatgcaaaagatggatattcgtatctttatccagtttattggagggatttcgacttcttgggtcatgattcagcattcaaagattttttttttgctcctcagtgtgtccgtgtggggtttattcctactgataaaacagatattcgcgacctaggaccaatggatgaggccatcttcaatttggtaaacaacgtttacgctgccccaaatcaaaaaccgtcgatctatgacatgcaagagcgcacggtggacggcaagaactactggacgttcgagtacgatctggaggctccgggctacggcgtatccgcgttcgcgacagtcgccattggaaacggtcggtactacacgctgatcgtgaccgcgaacgaacgccggtggagcaggctccggaacaggctcaaagtcgtcgcggactctttcaagatctccgacctgaccgcgtgaccgccagcgttctcgttaactgtaatggacggtctcattcagtcatggtatatatacttacgcgc

SEQ ID NO: 11958 - protein, 232 aa, Panicum virgatum
  misc_feature: Ceres CLONE 1759801
  misc_feature (46)..(228): Pfam Name: PsbP Pfam Description: PsbP
  misc_feature: Useful for making plants with modulated salt sensitivity
MASLQNLICSVSKQLVAPNFALTAKLNGASHSVVPASSSGASSHEKNVTKRQLALLGAGALATGLLKTSSAFAEEVPKNYKSYVDAKDGYSYLYPVYWRDFDFLGHDSAFKDFFFAPQCVRVGFIPTDKTDIRDLGPMDEAIFNLVNNVYAAPNQKPSIYDMQERTVDGKNYWTFEYDLEAPGYGVSAFATVAIGNGRYYTLIVTANERRWSRLRNRLKVVADSFKISDLTA

SEQ ID NO: 11959 - DNA, 964 bp, Panicum virgatum
  misc_feature: Ceres CLONE 1759832
  misc_feature: Encodes the peptide sequence at SEQ ID NO. 11960
atttttcggattggccagcagcacaagatcagatctgaattccagacaaaattccaacatccattggccgaatgggggaattcggaagcccgccgacgacggcgacggcacgacgcgatgtgtcaacgccccgcgaaagcaacggctttgcaggcgccagtcgcgctctcggcctcggcgagcaccgggcccggggcgggctgaaggctgaccccggagtcgcgcaggcgcgggtcaccggagaggcggagcttaccaccatgctcccggacgcggaacggcggaagcagcggcaggtggtgagaggtgatctcgccggccgcgggggattggagcgcggaacacccacccatttataccccgctcgttccatgccctatccatccatccgccgcgcaacctcttcccgttccgatcccctttccaaccgaggaaggacaatccctaccgcaccgccggatcccccgatttgcatagatgcagatctttgtgaagaccctcaatgggaagaccctcacctttgaggtggagtcatgtgacacaatcgacaatgtcaaggcaaagattcaggataaggagggaactccactgggccagcagcgacttatctttgctggcaagcagctcgcggacgggtgcacgtttgctgactacaacattcagaaagagtccaccctgcatcttgtccttcgtctccgcggcggcctgcagatagccaacaacaacaacaacaaccctgaggtggagtcgtttatgaccctcttggtcactagtctttatatcttgtttgatttacccttttggcagagccggtcagttcttcttttccttttctttttgaatgggcaggggcgcagccccttctatatagacctaggaagtacagaaggttttagaatagcctcaagacgactttgttctcacctcagtgtaagaacaattaaaaaaagccagttagcagtgc

SEQ ID NO: 11960 - protein, 162 aa, Panicum virgatum
  misc_feature: Ceres CLONE 1759832
  misc_feature (6)..(74): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MQIFVKTLNGKTLTFEVESCDTIDNVKAKIQDKEGTPLGQQRLIFAGKQLADGCTFADYNIQKESTLHLVLRLRGGLQIANNNNNNPEVESFMTLLVTSLYILFDLPFWQSRSVLLFLFFLNGQGRSPFYIDLGSTEGFRIASRRLCSHLSVRTIKKSQLAV

SEQ ID NO: 11961 - DNA, 844 bp, Panicum virgatum
  misc_feature: Ceres CLONE 1759833
  misc_feature: Encodes the peptide sequence at SEQ ID NO. 11962
caactcaagcaagcctgcctcttcttctccttagttaatattctagtaatataagcaagcatatactaccaagccaagccatggcccccaccgtgatggcctcgtcggccacctccgtggctccattccagggcctcaagtccaccgctggcctccccgtcagccgccgcgcccgaagctccggcttcggcaatgtcagcatcggcggaaggatcaggtgcatgcaggtgtggccgacggagaacaacaagaagttcgagaccctgtcgtacctgccgcccctctccacggaggacctcctgaagcaggtcgactacctgatccggaatttctgggtcccctgcctcgagttcagcaaggtcggcttcgtcttccgcgattttttcacttcccccgggtactacgacggccgctactggaccatgtggaagctgcccatgttcggctgcaccgacgccacccaggtgtacgccgagctcgaggagtgcaagaaggcctaccccgacaactacatccgcatcctcggcttcgacaacgtcaggcaggtgcagtgcgtcatgttcatcgcctacaagcccccggccgccgcctaagcgcagctagctagctcctgcgtgatcgagcaaccatcaagtgtctcctttttgtttttgcttcgatcgggtcaccttgattttctttctttttcatggttgcttctgctgtatccatccatggcatgcatgcatgtgtgaggaacatgtcagtgcaagctccggctatatatgatatgtaatgtggatactatctagagcacattattatctgccaatccgccgacaatatatttaaactagattgtgtt

SEQ ID NO: 11962 - protein, 170 aa, Panicum virgatum
  misc_feature: Ceres CLONE 1759833
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMASSATSVAPFQGLKSTAGLPVSRRARSSGFGNVSIGGRIRCMQVWPTENNKKFETLSYLPPLSTEDLLKQVDYLIRNFWVPCLEFSKVGFVFRDFFTSPGYYDGRYWTMWKLPMFGCTDATQVYAELEECKKAYPDNYIRILGFDNVRQVQCVMFIAYKPPAAA

SEQ ID NO: 11963 - DNA, 802 bp, Panicum virgatum
  misc_feature: Ceres CLONE 1759858
  misc_feature: Encodes the peptide sequence at SEQ ID NO. 11964
agccgagagaccgcgtgcgaaccaagcagaccccagccgaagtagcgaaagcgaagtcgtcgccggagcaggaggaggaggaagcgcgccggagcaagatgtcgtggcagacgtacgtcgacgagcacctgatgtgcgagatcgaaggccagcatctcacctccgccgccatcgtaggccacgacggcagcgtctgggcgcagtccccgaacttcccccagtacaagcctgaagagattgctgccatcatgaaggacttcgatgagcctggtactcttgcaccaactggtctttttcttggaggcacaaaatacatggtgatccaaggtgaacctaatgttgtcatccgaggaaagaagggcactggaggcatcactgtcaagaagacgaccctagccttgatcattggtatctatgatgagccaatgactccagggcaatgcaacatgatagtggagaggctcggcgactacctgatcgagcagggtttctaagtttgtcatatgttattttggtcatttggcacgtaagtttgcacctcatttggttcagtaatctgtgggcttgctcatctacttggcgaatcgcattatattgcatgcagtgaataattagcttgggtttgtttgttggtaacaatgttggaaaagagtctgaattggggtttatgtttggcctcgcgtcatatcaaactcagctgctgtttcactgagtaatgtacatttccctggtcatgctacttgtgattctgctgctgtatggagatgagtgcattttaccgaatgtgatcggcttgctgttg

SEQ ID NO: 11964 - protein, 131 aa, Panicum virgatum
  misc_feature: Ceres CLONE 1759858
  misc_feature (2)..(126): Pfam Name: Profilin Pfam Description: Profilin
  misc_feature: Useful for biocontainment applications
  misc_feature: Useful for making plants with modulated biomass
MSWQTYVDEHLMCEIEGQHLTSAAIVGHDGSVWAQSPNFPQYKPEEIAAIMKDFDEPGTLAPTGLFLGGTKYMVIQGEPNVVIRGKKGTGGITVKKTTLALIIGIYDEPMTPGQCNMIVERLGDYLIEQGF

SEQ ID NO: 11965 - DNA, 814 bp, Panicum virgatum
  misc_feature: Ceres CLONE 1759860
  misc_feature: Encodes the peptide sequence at SEQ ID NO. 11966
attttctaggtttccgtcccgccgccgccaccgccgccacttgtcactcgctcgccaccgccgccgccatgggccgcatgtacggccccgggaagggcatgtcctcgtcggtgctgccctacgctcgctccgcgcccgggtgggtcaggtcgtccgcggcggaggtggaggacgcgatcgtgcgcgccgccaagaagggccagctgccatcacagatcggcacgctgctccgcgacgcgcacggcgtgccgctggtccacggcgtcacggggcgcaagatcctgcgcgtgctcagggcccgcggcctcgcgccggaggtgcccgaggacctctacttcctcatcaagaaggccgtcgcaatcaggaagcacctggacaggaaccggacggacgtggacgccaagttccgcctcatcctcgtcgagagcagggtccaccgcctctcccgctactaccgccgcgccaagaagatccccgcctcctggaagtacgaatccaacaccgcgagcactctggtggcttgagtgacgattttgttttgagcttcgtggttcctgtgaattgattatctacacttctggagtttaccttgaacttaaattaagtgacagtagtgcctttttggttgcacctaggaagaagtatgtatcttgagagtttatgaaactggatcaagttttagtcctttggagctagattgttcaaggtgttttggagttgggttcaaccttgagctggttggtaatactctgtatggacgtatgctcatggaaagttcggaatgaagcaagagaattggtggtattctgtttgc

SEQ ID NO: 11966 - protein, 151 aa, Panicum virgatum
  misc_feature: Ceres CLONE 1759860
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
  misc_feature: Useful for making plants with modulated nitrogen use efficiency
MGRMYGPGKGMSSSVLPYARSAPGWVRSSAAEVEDAIVRAAKKGQLPSQIGTLLRDAHGVPLVHGVTGRKILRVLRARGLAPEVPEDLYFLIKKAVAIRKHLDRNRTDVDAKFRLILVESRVHRLSRYYRRAKKIPASWKYESNTASTLVA

SEQ ID NO: 11967 - DNA, 807 bp, Panicum virgatum
  misc_feature: Ceres CLONE 1759881
  misc_feature: Encodes the peptide sequence at SEQ ID NO. 11968
aaaacacaagacccatccccccatggcagccgaagagggttccggcggcggcggcggcggctgcagcggcggggacaggaagagctctccggcgccaacgaagcccggagggggcggtgcggcgacgttcctctcggggatgccgtcgcgcggcaacttctcgtccgcctccgtttcctccagcctgggtgggttcagggtttacgtctgcgagcacagcacggaacccccagaaggacaaatcatacagacggattcgacaaatattttaatcagacatctccaattgaacaaacagaagagtgaagctaaagattcaggttcgaggactccaggggaaaccaccagagggaaaagatctgctgccagaagtttggatgtcaacaattcagcaaagagagctaacttgggtacctcctctgggtcatcagtctatgaagaaacaatctctggattttcacagcacacactacaatcatttacagttgagaggttacgtgcacttctacgacaaagtggtctctctaccaaagggaaaaaggatgaattgatcgcacgtttacgagaatcacagggttgacgtgaagctcatatgtaatcttgtcttgtcggtcgaagcccttttggcagggtttacacgtagaatgagtatcatgttgtaattgttagtggtgattttgtttagactcaaattcagtgtagtggcatacttcggccaacactattccgagattatttatagtcagaatccgctaagtagttgttatctttcaaccatcatgaattccctgttttctcatgccatag

SEQ ID NO: 11968 - protein, 185 aa, Panicum virgatum
  misc_feature: Ceres CLONE 1759881
  misc_feature (150)..(184): Pfam Name: SAP Pfam Description: SAP domain
MAAEEGSGGGGGGCSGGDRKSSPAPTKPGGGGAATFLSGMPSRGNFSSASVSSSLGGFRVYVCEHSTEPPEGQIIQTDSTNILIRHLQLNKQKSEAKDSGSRTPGETTRGKRSAARSLDVNNSAKRANLGTSSGSSVYEETISGFSQHTLQSFTVERLRALLRQSGLSTKGKKDELIARLRESQG

SEQ ID NO: 11969 - DNA, 680 bp, Panicum virgatum
  misc_feature: Ceres CLONE 1759891
  misc_feature: Encodes the peptide sequence at SEQ ID NO. 11970
acggatccatccatctctcctttgctctttcccttcaattcaactcgtctcacagaactctttccgagagatcgagacaatcctgcggcatcggcgcgccgacttccacacctactccatcgagtggacgcagcagcacatcctcgtgctggtggacgggacgccgatccgggagttcaagaaccacgcggaccgcggcgtggcgtacccgtcgacgcagcggatgcggctgtacggctcgctgtgggacgccgaggactgggccacgcagggcggccgcgtcaagacggactggtcgcaggcccccttcgcggcgcagtaccgcaacttcacggccgcggacgcctcctcctcctcggcgtcgccggcggcggcgggcgggtacgggcaggagatggacgcggcggcgcagcaggccatgaagtgggcgcgggacaactacatggtgtacgactactgcgccgacggcaagcggttcccgcagggcgtcccgcccgagtgctccatgccgtagccgtagcgtagcgtccagatgggctaagagccggcgcgctttgattgcgaagtcgtcgatcggagggagcaagcattaggggcaggttacacgcatatgctaggttacagaatccattggtctcattcattgtttatatattcatcgacatcgattctttggtgcg

SEQ ID NO: 11970 - protein, 170 aa, Panicum virgatum
  misc_feature: Ceres CLONE 1759891
  misc_feature (115)..(167): Pfam Name: XET_C Pfam Description: Xyloglucan endo-transglycosylase (XET) C-terminus
  misc_feature (2)..(100): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered cell wall content and/or composition
  misc_feature: Useful for making plants with altered carbohydrate content
RIHPSLLCSFPSIQLVSQNSFREIETILRHRRADFHTYSIEWTQQHILVLVDGTPIREFKNHADRGVAYPSTQRMRLYGSLWDAEDWATQGGRVKTDWSQAPFAAQYRNFTAADASSSSASPAAAGGYGQEMDAAAQQAMKWARDNYMVYDYCADGKRFPQGVPPECSMP

SEQ ID NO: 11971 - DNA, 752 bp, Panicum virgatum
  misc_feature: Ceres CLONE 1759899
  misc_feature: Encodes the peptide sequence at SEQ ID NO. 11972
aaagccaacagcgtagctccgccggcttcctccacgcttgagctccgccgccgccgcctccctccgttcctccgctaggaccggcaagatgaagctcgtcaggttcttgatgaagctgaacaacgagacggtcaccatcgagctcaagaatggcacggtggtccatggcaccatcacaggtgttgacataagcatgaatactcatctgaagacagtgaagcttacactgaaaggaaagaatcctgtgacccttgaccacctcagtgtgcgaggaaacaacattcgctattatattcttcctgacagcttaaacctggaaactttgctggtggaggaaacccctagagtcaagcctaagaagccaactacaggaaagcctttgggacgtggtcgcggccgtggtcgtggacgtggtcggggccggggtccgcgctgagctccattgtacccttgctgtcagctgtctcgcatggcaagtttcccatacaatgtaaccctcttgcccccgcacgagatgtgaaagaatgttgcattgttacccttctgatgaacgcggacctaatatctcaatctcagtagttcttgttgtggaatccctctgtctatttgaccaatcgttcatgcttatcttaggtcttgtagttaatttgcaatgctttgacctgtcatacatattaagatgcgcagacatttgaatatctaggttgtatgcttgtgttttgacatcatgggggaattatcgcttcggagct

SEQ ID NO: 11972 - protein, 115 aa, Panicum virgatum
  misc_feature: Ceres CLONE 1759899
  misc_feature (5)..(70): Pfam Name: LSM Pfam Description: LSM domain
MKLVRFLMKLNNETVTIELKNGTVVHGTITGVDISMNTHLKTVKLTLKGKNPVTLDHLSVRGNNIRYYILPDSLNLETLLVEETPRVKPKKPTTGKPLGRGRGRGRGRGRGRGPR

SEQ ID NO: 11973 - DNA, 808 bp, Panicum virgatum
  misc_feature: Ceres CLONE 1759910
  misc_feature: Encodes the peptide sequence at SEQ ID NO. 11974
cccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaggccatgaacggcaaggagctcgacggccgcaacatcaccgtcaaccaggcccagtcccgcggcggtggcggcggcggcggcggttacggcggcggtcgccagggaggctacggcggcggcggcgggtacggtggcggcggcggtcgccgtgagggcgggtacggtggcggcggctacgacggtggcggtggcggatacggtggcggtcgccgcgagggcggctacggcggtggtggctacggcagccgcggtgactccggtggcaactggaggaactgatggggtagccctcccgtgctggcagccaagttatcctagatatctattagtgttcgtgttaccatttgatcccgagttaccccagagtttagtgtccgtgttaccgtttgattaggtgttggttcccatgttaccccagagtttagtgtccgtgttaccgtttgattaggtgttggttcccatgttaccgttcccgagttgtttccgcaatgaaatgagaagaaaagagtgagcaaggtttttgttcgc

SEQ ID NO: 11974 - protein, 159 aa, Panicum virgatum
  misc_feature: Ceres CLONE 1759910
  misc_feature (10)..(81): Pfam Name: RRM_1 Pfam Description: RNA recognition motif. (a.k.a. RRM, RBD, or RNP domain)
  misc_feature (48)..(151): Pfam Name: GRP Pfam Description: Glycine rich protein family
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: Useful for making plants with altered terpenoid content
  misc_feature: Useful for making plants with modulated phosphate use efficiency
MAAADVEYRCFVGGLAWATDNASLQQAFASYGDVLDSKVITDRETGRSRGFGFVTFSTEQSMLDAIEAMNGKELDGRNITVNQAQSRGGGGGGGGYGGGRQGGYGGGGGYGGGGGRREGGYGGGGYDGGGGGYGGGRREGGYGGGGYGSRGDSGGNWRN

SEQ ID NO: 11975 - DNA, 841 bp, Panicum virgatum
  misc_feature: Ceres CLONE 1759950
  misc_feature: Encodes the peptide sequence at SEQ ID NO. 11976
acgccgccgcaccgcagctcgcattcgcaatccaaggttccaatccgccgagccatcaccgcctcgtcgcgccgcccgtccacggccccgctccgatggcccgcacgaagcagacggcgcgtaagtcgaccggcggcaaggcgccgaggaagcagctggccaccaaggccgcccgcaagtcggcgccggccaccggcggcgtgaagaagccgcaccggttccgccccggcaccgtcgcgctccgcgagatccgcaagtaccagaagagcacggagctgctcatccgcaagctccccttccagcgcttggtgcgggagatcgcgcaggacttcaagacggacctccggttccagtcgtcggcggtggcggcgctgcaggaggccgcggaggcgtacctggtggggctcttcgaggacaccaacctgtgcgctatccacgccaagcgcgtcaccatcatgcccaaggacatccagctcgcgcgccgcatcaggggtgagagggcctgagcgccgggcttctgcttctgcattgtcgtcgtagcgatagaattggattgggggaattttttttcttgccgtgctatcctgtagtcagattctgaatgggttcgactcgttgcaatggaacgtgattgctagtttctgaaatgtctgaatggctctgtttttgggagatttgctctctgatctttgaaataacttgttgattgcacgggaaaagagtaggtctgctggagttgaatttagcattttccatttttttccttatgtgcctgtataattgattttctgtcaaaaatgaaaaagttgctctcaaggctccaggctagcatttgctgcgg

SEQ ID NO: 11976 - protein, 136 aa, Panicum virgatum; identical to SEQ ID NO: 10238
  misc_feature: Ceres CLONE 1759950
  misc_feature (58)..(132): Pfam Name: Histone Pfam Description: Core histone H2A/H2B/H3/H4

SEQ ID NO: 11977 - DNA, 599 bp, Panicum virgatum
  misc_feature: Ceres CLONE 1759959
  misc_feature: Encodes the peptide sequence at SEQ ID NO. 11978
gaccccgacgcggccgcgctctccgactactgcctccaccagatcttccccccggcccccgcgcgccccggcgggagcggcggcgggtaccgcgcgccggagctcgtggacgcgcgccgcccgacgttcaggtccgacgtgtactcgctcggggtgctgttcctggagctcctgacgggcaagtcccccgcgcaccacgcgtccctggagggcggcgacggcgccgtggacctcccgcggtgggtgcaatcggtggtgcgggaggagtggacggcggaggtgttcgacgcggagctggtgcggatgggcgggggcgccgaggaggagatggtggcgctgctccaggtggccatggcgtgtgtgtctaccgcgccggatgcgcgcccggacgccgccgacgtcgtcaggatggtcgaggagatcggcggcgggcacgggcgcgcgacgacggaggagagcgaggggacgaggggcgcgtcggaggaggagcggtccaggggcccgactccgtgacgccgcctggggcaacgcaacgcaatgccagcatgtcgcatggcaaagttgtttcctttcgatcgatttatatagcatttgttttc

SEQ ID NO: 11978 - protein, 170 aa, Panicum virgatum
  misc_feature: Ceres CLONE 1759959
  misc_feature: SWISSPROT Homolog: EC 2.7.11.1 Non-specific serine/threonine protein kinase
DPDAAALSDYCLHQIFPPAPARPGGSGGGYRAPELVDARRPTFRSDVYSLGVLFLELLTGKSPAHHASLEGGDGAVDLPRWVQSVVREEWTAEVFDAELVRMGGGAEEEMVALLQVAMACVSTAPDARPDAADVVRMVEEIGGGHGRATTEESEGTRGASEEERSRGPTP

SEQ ID NO: 11979 - DNA, 701 bp, Panicum virgatum
  misc_feature: Ceres CLONE 1759962
  misc_feature: Encodes the peptide sequence at SEQ ID NO. 11980
cctagctttgcctctcctctcccgcgcctttgcctcctctttcgcccacctcgcggtccagccgtccgtcgaggttgagcaacctgaaactacaatggcgcctaaagctcccccgaaaaaggctgatagcaaggctcaagccttgaaggttgccaaggctgttaagtctggatccaccaagaggaagaccaagaagatccgcacatctgtgacatttcacaagccgaagaccctcaagaagccaagggaccccaagtacccaagagtcagtgcacctgggaggaacaagcttgatcagtaccaaatcctcaaatacccacttacgaccgagtctgcaatgaagaagattgaagacaacaacacccttgtcttcatcgtcgacctcaaggcggacaagaagaagatcaaggcagctgttaagaagatgtatgacatccaggcgaagaaggtcaacactctgatcaggcctgatggcaagaagaaggcttacgtgaagcttacaccagactatgatgcccttgatgtggccaacaagatcggcatcatctaaattttgtagttctgtgtgccagtgtgttgcagtttcagagttctgtgggggtagggtcttatctgtagctaagcctgagtaccctttttctgcttgtgaactggtaccaatgatggaaatttgcaatgttcaagttctgcatttgaatttt

SEQ ID NO: 11980 - protein, 151 aa, Panicum virgatum
  misc_feature: Ceres CLONE 1759962
  misc_feature (69)..(148): Pfam Name: Ribosomal_L23 Pfam Description: Ribosomal protein L23
  misc_feature (10)..(63): Pfam Name: Ribosomal_L23eN Pfam Description: Ribosomal protein L23, N-terminal domain
  misc_feature: Useful for making plants with modulated nitrogen use efficiency
MAPKAPPKKADSKAQALKVAKAVKSGSTKRKTKKIRTSVTFHKPKTLKKPRDPKYPRVSAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 11981 - DNA, 732 bp, Panicum virgatum
  misc_feature: Ceres CLONE 1759975
  misc_feature: Encodes the peptide sequence at SEQ ID NO. 11982
cagcaatccgcaatcatcccgagcaatccctcgtcgaatccaccagcgaagcaaatccccagccttcctccccctctcccccgatggcccgcacgaagcagacggcgaggaagtccaccggcggcaaggcgccgaggaagcagctggcgacgaaggcggcgcgcaagtcggccccggcgaccggcggcgtgaagaagccccaccgcttccgtcccggcaccgtcgcgctccgggagatccgcaagtaccagaagagcacggagctgctgatccgcaagctgccgttccagcgcctggtgcgggagatcgcgcaggacttcaagaccgacctccgcttccagagctcagccgtcgccgcgctgcaggaggcggccgagtcctacctcgtcgggctcttcgaggacaccaacctctgcgccatccacgccaagcgcgtcaccatcatgcccaaggacatccagctcgcccgccgcatccgtggcgagagggcctaggcgccgtcaccgtggagtggaagtagtagaaatggtagcttgtcatctgtgtccaatcggaatggtgtagagatgtgctgggttccttagctttggttgttggtcgaatcaagaagtggttggttggtctcctgctgtaatttatcccattgtatcttctgtaccttggagttgccatggatcaatgaattggcaatgggcaccgagttatcatgatgtggcgagatccctgcttgtt

SEQ ID NO: 11982 - protein, 136 aa, Panicum virgatum
  misc_feature: Ceres CLONE 1759975
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAESYLVGLFEDTNLCAIHAKRVTIMPKDIQLARRIRGERA

SEQ ID NO: 11983 - DNA, 681 bp, Panicum virgatum
  misc_feature: Ceres CLONE 1759980
  misc_feature: Encodes the peptide sequence at SEQ ID NO. 11984
aaacgcaacaacgcctcgtgcagtttcttcgtgacacggcaagtaaaagccacaccaaaactatcacacgagaagggttttttttttttttttgtttgtagcagcgagctgttgcaaatggcgtcgacggtggcgagcctgtccaccccggcgaccttcgcggccgcagacgtggtcccgaggaggaaggtcgtcgccgccggccgcgtctggttccccgtggcgcgccgcggcggcggcttcgcggtgaggtcgagcgggccggcgacgccgccggggatctccgacaaggtgtcggagagcatcaagaaggcggaggagacgtgcgcggaggagacggcctccggggagtgcgcggcggcttgggacgaggtggaggagctcagcgccgcggcaagccacgcccgggacaagctcaaggagaacagcgacccgctcgagaactactgcaaggagaaccccgaggccgacgagtgccgcacctacgacaactagaccatgcctgtttgctaaatttgccgcacacgaccggaggatttgcacgaagctttatgcttctctgcctgtaatatatatatccactatactcgtgtgtgcgatatagattgaatataagaacgagttatctttcgaaaaaaaatatataataacgaggtggtaacccgcttgcttgattcagtc

SEQ ID NO: 11984 - protein, 125 aa, Panicum virgatum
  misc_feature: Ceres CLONE 1759980
  misc_feature (55)..(125): Pfam Name: CP12 Pfam Description: CP12 domain
MASTVASLSTPATFAAADVVPRRKVVAAGRVWFPVARRGGGFAVRSSGPATPPGISDKVSESIKKAEETCAEETASGECAAAWDEVEELSAAASHARDKLKENSDPLENYCKENPEADECRTYDN

SEQ ID NO: 11985 - DNA, 761 bp, Panicum virgatum
  misc_feature: Ceres CLONE 1760004
  misc_feature: Encodes the peptide sequence at SEQ ID NO. 11986
attccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatatatatatatatatatatatatataattaaaccctacgtcgtgcgtgctatagctatagctatagctatactatacttaattggtttgcaattcagctatatgcataatgcatgctagctgtggctatttatatctggtttatatgcaattgatcgagctat

SEQ ID NO: 11986 - protein, 149 aa, Panicum virgatum; identical to SEQ ID NO: 10105
  misc_feature: Ceres CLONE 1760004
  misc_feature (58)..(133): Pfam Name: Fer2 Pfam Description: 2Fe-2S iron-sulfur cluster binding domain

SEQ ID NO: 11987 - DNA, 810 bp, Panicum virgatum
  misc_feature: Ceres CLONE 1760008
  misc_feature: Encodes the peptide sequence at SEQ ID NO. 11988
acccaaaaaaacattgtcgaatcccgtttccctcgcttcccgccaaacccaaaaccgaattccctccaaatccacccacaccctccgaaatggacgccggcgccccgaaggtgaagaaggcggcggcgggccgcaagctcggcgggccgaagaagaagccggtgtcgcgctccgtcaaggccgggctccagttccccgtcggccgcatcgggcgctacctcaagaagggccggtacgcgcagcgcgtgggcacgggcgcccccgtctacctcgccgccgtcctcgagtacctcgccgccgaggtcctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaagaaggccgccgagaaggcggagaaggcggccaagtcgcccaagaaggccgccgccaaatcccccaagaagtaggctgctcctggtcatgcgcgcgctgatctctcatcgcatccgatcctagcagtcttgcttcccctgtgttcgttgcttttgtgtgtatgtagtgccgcatctctatgtaccgtgccctccgtgcttcggatcgtaagtcgtaggtctaggtctagctgtagttgttggtgatggggttatctatgttaccaaaatttaatgagatgagggatcggtagatgtagattcagattggtgaatcctaatgatttcagtgaaattcctt

SEQ ID NO: 11988 - protein, 151 aa, Panicum virgatum
  misc_feature: Ceres CLONE 1760008
  misc_feature (27)..(100): Pfam Name: Histone Pfam Description: Core histone H2A/H2B/H3/H4
MDAGAPKVKKAAAGRKLGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNIHSVLLPKKAAEKAEKAAKSPKKAAAKSPKK

SEQ ID NO: 11989 - DNA, 567 bp, Panicum virgatum
  misc_feature: Ceres CLONE 1760026
  misc_feature: Encodes the peptide sequence at SEQ ID NO. 11990
attcagctgagtgtgctcgatcatcaagcaatcaacaaagcctcccaattatcctttcatcagatcatcttccttcttccaaattgtcttgcagctgcggatcaagctgcaactgcggctccaactgcaagtgcggcaagatgtaccctgaccttgaggagaagagcagcggcggcgctcaggccaccatcgtcctcggcgtggccccggagaagaaggccggccagttcgaggcggcggcggagtccggcgagaccgcccacgcctgcaagtgcggtaacagctgcagctgcgacccctgcaactgctgatttcgatggggaacgtcagaacacacctgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtctgtatgtgttgatgggtgcaaagaaaccatgcaggcatacatctctgcatgtgtctctgtaa

SEQ ID NO: 11990 - protein, 102 aa, Panicum virgatum
  misc_feature: Ceres CLONE 1760026
  misc_feature (28)..(102): Pfam Name: Metallothio_2 Pfam Description: Metallothionein
SAECARSSSNQQSLPIILSSDHLPSSKLSCSCGSSCNCGSNCKCGKMYPDLEEKSSGGAQATIVLGVAPEKKAGQFEAAAESGETAHACKCGNSCSCDPCNC

SEQ ID NO: 11991 - DNA, 619 bp, Panicum virgatum
  misc_feature: Ceres CLONE 1760027
  misc_feature: Encodes the peptide sequence at SEQ ID NO. 11992
cccttctcctcgcgccgccgccgccgccatgtcgaagcacgggaggggaggttccgcggggaacaagttccgcatatcgctgggtctgcccgtggcggcgacggtgaactgcgccgacaacacgggcgccaagaacctctacatcatctccgtcaagggcatcaagggcaggctcaaccgcctgccgtccgcctgcgtcggcgacatggtcatggccaccgtcaagaaggggaagcccgacctcaggaagaaggtcatgcccgccgtcatcgtccgccagcgcaagccgtggcgccgcaaggacggagtctacatgtacttcgaagataatgctggggttattgtgaacccaaaaggcgagatgaaaggatctgctattactggacccattggcaaggagtgtgctgacctttggcctaggattgctagcgcagcaaatgccattgtctgaaatcaggatttggggaaatttagagttttgtgtgctccttatttaggtcttatctgatgcagtttttgtacccaaacatggtaatgtacttgcgagttatgtttctgaaaatgttatatgataattgaactcaagtggaaagcataatcaacggagaattgtgaaccc

SEQ ID NO: 11992 - protein, 140 aa, Panicum virgatum
  misc_feature: Ceres CLONE 1760027
  misc_feature (19)..(140): Pfam Name: Ribosomal_L14 Pfam Description: Ribosomal protein L14p/L23e
  misc_feature: Useful for making plants with modulated biomass
  misc_feature: Useful for making plants with modulated heat sensitivity
MSKHGRGGSAGNKFRISLGLPVAATVNCADNTGAKNLYIISVKGIKGRLNRLPSACVGDMVMATVKKGKPDLRKKVMPAVIVRQRKPWRRKDGVYMYFEDNAGVIVNPKGEMKGSAITGPIGKECADLWPRIASAANAIV

SEQ ID NO: 11993 - DNA, 774 bp, Panicum virgatum
  misc_feature: Ceres CLONE 1760037
  misc_feature: Encodes the peptide sequence at SEQ ID NO. 11994
tagttaatgttctagtaatataagcaagcatacactaccaagccaagccatggcccccaccgtgatggcctcgtcggccacctccgtggctccattccagggcctcaagtccaccgctggcctccccgtcagccgccgcgcccgatgctccggcttcggcaacgtcagcatcggcggaaggatcaggtgcatgcaggtgtggccgacggagaacaacaagaagttcgagaccctgtcgtacctgccgcccctctccacggaggacctcctgaagcaggtcgactacctgatccgttttttctgggtcccctgcctcgagttcagcaaggtcggcttcgtcttccgcgagaacgccacttcccccgggtactacgacggccgctactggaccatgtggaagctgcccatgttcggctgcaccgacgccacccaggtgtacgccgagctcgaggagtgcaagaaggcctaccccgacaactacatccgcatcctcggcttcgacaacgtcaggcaggtgcagtgcgtcatgttcatcgcctacaagcccccggccgccgcctaagcgcagctagctagctcctgcgtgatcgagcaaccatcaagtgtctcctttttgtttttgcttcgatcgggtcaccttgactttctttctttttcatggttgcttctgctgtatccatccatggcatgcatgcatgtgtgagggacatgtcagtgcaagctccggctatatatgatctgtaatatggatactatctagagcaaattatctgc

SEQ ID NO: 11994 - protein, 170 aa, Panicum virgatum
  misc_feature: Ceres CLONE 1760037
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMASSATSVAPFQGLKSTAGLPVSRRARCSGFGNVSIGGRIRCMQVWPTENNKKFETLSYLPPLSTEDLLKQVDYLIRFFWVPCLEFSKVGFVFRENATSPGYYDGRYWTMWKLPMFGCTDATQVYAELEECKKAYPDNYIRILGFDNVRQVQCVMFIAYKPPAAA

SEQ ID NO: 11995 - DNA, 703 bp, Panicum virgatum
  misc_feature: Ceres CLONE 1760075
  misc_feature: Encodes the peptide sequence at SEQ ID NO. 11996
gttcgtcttcgccttccagaaaaaggaaaaaccctctcgtcccgccagccacccagcctagggttcttccttcccgccgccgcctcgctgctccagactcgcctccacaccacccagactgccagttctacttcaaagccatagcggaggaaaccaatggaaagaaggaggaggaggaggagttcagcacaggtcctctgtcagtgctcatgatgagcgtcaagaacaatacccaggttcttatcaactgccggaacaacaagaagttacttggtcgtgtgagggcatttgataggcactgcaacatggttcttgagaatgttagggagatgtggactgaggtaccaaaaaccggtaaaggcaagaagaaggctcttccagtgaacaaagacaggttcataagcaagatgttcctccgtggtgattcagttatcattgttctcaggaacccaaaatgagtctcttgcacatgagatctttgcaagtagtaaagtgctatgaattagtctgtatgccaacttgtagcatgggattgcattagacgacaattcctgagccagaattagctgtgtatgtcaatggtggagggtggttgttggatgctatgaattggttttacctcttgtaactgaattaaatttttagtttatttttggaatactggcaattccaccgtttgaattggctgtcattcgagaatagt

SEQ ID NO: 11996 - protein, 151 aa, Panicum virgatum
  misc_feature: Ceres CLONE 1760075
  misc_feature (69)..(148): Pfam Name: LSM Pfam Description: LSM domain
SSSPSRKRKNPLVPPATQPRVLPSRRRLAAPDSPPHHPDCQFYFKAIAEETNGKKEEEEEFSTGPLSVLMMSVKNNTQVLINCRNNKKLLGRVRAFDRHCNMVLENVREMWTEVPKTGKGKKKALPVNKDRFISKMFLRGDSVIIVLRNPK

SEQ ID NO: 11997 - DNA, 949 bp, Panicum virgatum
  misc_feature: Ceres CLONE 1760086
  misc_feature: Encodes the peptide sequence at SEQ ID NO. 11998
atccattcagagctctcgcttcgaaaccgaaccagctcactctacccagctgccgtttctagagaatcccctgcgtttcgagatcccgctcgcaacgatgcctgccctcgccaagcccgcctcgcgccccgccaagaccaccgcggcgccgaagccgaagcccgccgccgccaaacccaaggccgcggccgccgccggcgcctcccacccgccctacttcgagatgatcaaggaggcgatctcggcgctcaaggagaggaccggctcgagctcgcacgccatcgccaagtacatggaggacaagcacggcccgtcgctgccggccaactacaagaagatgctctccatccagctccgcgggttcgccgccaagggcaagctcgtcaaggtcaaggcctcctacaagctctccgacgctgccaagaaggagccccccaaggccaagcccgcagccgccaagatcgtcacggccaagccggccaaggccgccgcgaagccgaagaagagcgccgccgccgcgaagccgaagaagaccgcggcggccgccgccgggaccaagcgcaaggcgccggagaagaaggtcgtggcgaagccgaagaagtcccccgcggcgaaggccaaggccaagcccaagactgtcaagtcccccacctccaagaaggcccggaaggtcgccgcatgagatggttccataggtcttagctctgattgtggtgtggttgtccctagggagttgtacaaatgaagtgcgcgtctctgatccggtgttgtggtgcgttccccaagtgtctctgatccggtgttgtgttaggtcagttcaatctatccaggtcggtgttagtgtaacagatggttaggtttcttgtgatggagatgtatctcgctctcttatatatgataggaacctgcagtttgccagaactttcttgtgatggaaattgtttgtttc

SEQ ID NO: 11998 - protein, 194 aa, Panicum virgatum
  misc_feature: Ceres CLONE 1760086
  misc_feature (36)..(106): Pfam Name: Linker_histone Pfam Description: linker histone H1 and H5 family
MPALAKPASRPAKTTAAPKPKPAAAKPKAAAAAGASHPPYFEMIKEAISALKERTGSSSHAIAKYMEDKHGPSLPANYKKMLSIQLRGFAAKGKLVKVKASYKLSDAAKKEPPKAKPAAAKIVTAKPAKAAAKPKKSAAAAKPKKTAAAAAGTKRKAPEKKVVAKPKKSPAAKAKAKPKTVKSPTSKKARKVAA

SEQ ID NO: 11999 - DNA, 602 bp, Panicum virgatum
  misc_feature: Ceres CLONE 1760093
  misc_feature: Encodes the peptide sequence at SEQ ID NO. 12000
tgacatttggctacagcagggatgatgtggggaagtttctccccatttatctttctcagggtatcctccaacatgatccctttgaggtgcttgatcagagaggagtgggcgagctggttaagttagctacagagaggggacgcaaaactaggcctaacctgaaggtgggcatctgtggagaacatggtggggagcctctgtcagttgctttcttcgcaaaggctgggctggattacgtttcttgctcccctttcagggttccgatcgctaggctggctgccgctcaggtgctcatctgagagcacctcctcatcggcaaccggatcgccagctgttggtgcatctggtgaagaataatcatacagggccatggaacggtggaaactctgcttcctggcaaaggctgttgtatgtagtcttctccgtgtgggtgcgcatgtaagccttaatgggtggtgttctgaatttcccttgaactgccatggtaatgtagtaccaaattgaacatcgatgatgacgaagagctatcgaatatattggcgattacctgtgctgtcaatttgcttctttgtatgagttgctaatagaagtgatgcatttcg

SEQ ID NO: 12000 - protein, 98 aa, Panicum virgatum
  misc_feature: Ceres CLONE 1760093
  misc_feature (1)..(98): Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
TFGYSRDDVGKFLPIYLSQGILQHDPFEVLDQRGVGELVKLATERGRKTRPNLKVGICGEHGGEPLSVAFFAKAGLDYVSCSPFRVPIARLAAAQVLI

SEQ ID NO: 12001 - DNA, 728 bp, Panicum virgatum
  misc_feature: Ceres CLONE 1760096
  misc_feature: Encodes the peptide sequence at SEQ ID NO. 12002
ttctcacactcagcttcccatttacaccgtcatccagtccagtgcccggccagccgccgccgtcccggaacggaaacgacgatggcggaggcgacgccgacgagggtgttcgtgtacggcaccctgaagcgcgggttccccaaccaccccctcctcgtcgcctgcgcttgccccttggtcggagccgcctccacaaccgccccagcctccctcgtcatcggcccctactcggtccctttcctcctccccaccccttcctcctcttcctccggccgcgtcgtctccggcgagctctacgccccatcccccgccgctctcgccgagctcgacgccttggagggaacccacatcggcgcctacgagcgccgcccgatcaccgtcgtggctgatggatcgggcgaggtggtggaggcggaggcgtactacgcgcacccgagctacgcggaggcgctctggcggcgctgcggcggtgaggcggccgagatcggggagtacaccgcggaccatgccgccaggtacgtcccaattaatgagcgcgctgccggcgccgctgggctcatggaggccgtccataggttcctcgacactgcccctgacagttgacttggtgttcatggatcgatacctgaatctgtcacctgttgtttcctagtgcttccgttgcagctcttgtttggtggagtctgtgatgaatctctaaaatatattcatgatgcaaatttgcagac

SEQ ID NO: 12002 - protein, 173 aa, Panicum virgatum
  misc_feature: Ceres CLONE 1760096
  misc_feature (9)..(117): Pfam Name: AIG2 Pfam Description: AIG2-like family
MAEATPTRVFVYGTLKRGFPNHPLLVACACPLVGAASTTAPASLVIGPYSVPFLLPTPSSSSSGRVVSGELYAPSPAALAELDALEGTHIGAYERRPITVVADGSGEVVEAEAYYAHPSYAEALWRRCGGEAAEIGEYTADHAARYVPINERAAGAAGLMEAVHRFLDTAPDS

SEQ ID NO: 12003 - DNA, 807 bp, Panicum virgatum
  misc_feature: Ceres CLONE 1760181
  misc_feature: Encodes the peptide sequence at SEQ ID NO. 12004
agcgcgcagatggcgaccgcggcgacggcgtccgccacggcggcgacccgcttcacgctcctagctggcgccggcctccgcgcccgcgcccgcgcccgcgccggccgcctccccaccgccgtgcggttccagcgccagcgggggctcaccaccaccgcgctcctgaagaccgccgacctccgccccaaggaccagggccagcccgagacgctcgactaccgcgtgttcctcgtcgacggcgggggccggaaggtgtcgccgtggcacgacgtgccgctgcgcgccggggacggggcgttccacttcatcgtcgagatccccaaggagagcagcgccaagatggaggtcgccaccgacgaggccttcacgcccatcaagcaggacaccaagaagggcaacctccgatactacccgtacaatattaattggaactatggattatttcctcaaacatgggaagacccgactactgcaaattctgatgttgaaggagcattcggagataatgaccctgttgatgttgttgagataggtgaaagacgtgccaatattggggatgtccttaaggttaaaccattggcagctttagcaatgattgatgaaggggagctcgactggaaaattgtggccatttctttggatgaccccaaagcatctcttgttaatgatgtggatgatgttgagaagcattttccggggacactgactgccatcagagactggttcagagactacaagataccagatggaaagcctgctaacagatttggtctcggcaacaagcccacaagcaaggaatatgctctg

SEQ ID NO: 12004 - protein, 265 aa, Panicum virgatum
  misc_feature: Ceres CLONE 1760181
  misc_feature (98)..(265): Pfam Name: Pyrophosphatase Pfam Description: Inorganic pyrophosphatase
  misc_feature: SWISSPROT Homolog: EC 3.6.1.1 Inorganic diphosphatase
MATAATASATAATRFTLLAGAGLRARARARAGRLPTAVRFQRQRGLTTTALLKTADLRPKDQGQPETLDYRVFLVDGGGRKVSPWHDVPLRAGDGAFHFIVEIPKESSAKMEVATDEAFTPIKQDTKKGNLRYYPYNINWNYGLFPQTWEDPTTANSDVEGAFGDNDPVDVVEIGERRANIGDVLKVKPLAALAMIDEGELDWKIVAISLDDPKASLVNDVDDVEKHFPGTLTAIRDWFRDYKIPDGKPANRFGLGNKPTSKEYA

SEQ ID NO: 12005 - DNA, 688 bp, Panicum virgatum
  misc_feature: Ceres CLONE 1760193
  misc_feature: Encodes the peptide sequence at SEQ ID NO. 12006
gtccctccctcgcccaccatttttgtccacctcctgagccctccccaccctccaaccccggcggcggcagcggcggcggcgcagcagcagcagcagcagtagctgaagatggtgaagttcctgaagcccggcaaggccgtgatcctccttcagggccggttcgccggccggaaggcggtgatcgtgcgcgtgttcgaggagggcacacgcgaccgcccctacgggcactgcctcgtcgccggcctcgccaagtatcccaagaaggtgatccgcaaggactccgccaagaagacggccaagaagtcccgtgtcaagtgcttcatcaagctcgttaacttcacccacctcatgcccacccgctacacccttgacgtcgacttcaaggacgtcgcctcgggcgggcccgacgcgctctccacccgggacaagaaggtcgccgcctgcaaggccgcgaaggcccgcctcgaggagaggttcaagacaggcaagaacaggtggttctttaccaagctccgcttctagatgccaggcgtccagcatagtacctgctttagttgtcaatttcatgtatcggacacccttatctctgttttggtattgccgtgaagacttcgtgcttactgttatggatcttggagacgatgtcatgtggatgatgtgtcgaatgatgccaatcatagatcctgtc

SEQ ID NO: 12006 - protein, 137 aa, Panicum virgatum; identical to SEQ ID NO: 10158
  misc_feature: Ceres CLONE 1760193
  misc_feature (52)..(137): Pfam Name: Ribosomal_L27e Pfam Description: Ribosomal L27e protein family
  misc_feature (7)..(40): Pfam Name: KOW Pfam Description: KOW motif

SEQ ID NO: 12007 - DNA, 613 bp, Panicum virgatum
  misc_feature: Ceres CLONE 1760196
  misc_feature: Encodes the peptide sequence at SEQ ID NO. 12008
actcttccacctgcagtcaccaaccacaagcagacctgctgcacatttgcaaagtttaagtttgcaacaactacagctcctccttcagagagctatttatttgccactagacttcgtgttccgagagagagaagaagaaaggtagagagatggagatgtacatggatgacaagagcaagatgatgttcaagaagggaagccggaggtcggcagcggtggcggccgaggggagcccggcggcccggtcggtgccgggccggctggcgagcctggtgaaggagcagagggccaggttctacatcatgcgccgctgcgtcaccatgctcgtgtgctggagggactgactagtggaactggaatgtaagcctccagggccgtgggcttaccagggccctgtgatcgggcccaattgggcctagtccggtggtaggttcatgtgtcgtagtgactgacggttcttcctcacagtcagaggaagagagatcagagatgtgcctgatctgtggccatcctgagcttgacggtgtttatagtgtcagaaaattagttcctgttctgtctgaatgacagcattgtttgctgcaaaaggctaatacactcctgatttcagtgt

SEQ ID NO: 12008 - protein, 64 aa, Panicum virgatum
  misc_feature: Ceres CLONE 1760196
  misc_feature (43)..(61): Pfam Name: DVL Pfam Description: DVL family
  misc_feature: Useful for making plants with modulated biomass
MEMYMDDKSKMMFKKGSRRSAAVAAEGSPAARSVPGRLASLVKEQRARFYIMRRCVTMLVCWRD

SEQ ID NO: 12009 - DNA, 859 bp, Panicum virgatum
  misc_feature: Ceres CLONE 1760207
  misc_feature: Encodes the peptide sequence at SEQ ID NO. 12010
cgccaacgatggccctggagacgtgcttcagagcgtgggcgctgcacgccgcccccgccggcggcaaggacaggctcgccgtcggcagcagcttcgcgccgtccaagcgggccgccgccgcgccgctgtccgtcggccgcgtcgccacgcggcggccgcggcacgtctgccagtccaagaacgccgtcgacgaaggtacgtgttccgatcgatcgatgccttggcttttagtagattaattccacggagcacgcagcagcagccttgcgcttgcgcaagctgaccctcctccgttactggttccggtgtggttggccgggggtgcagtgctggtggcggacgagaagaactgggacgggatggtgatggcgtgcgagacgccggtgctggtggagttctgggcgccgtggtgcgggccgtgccggatgatcgcgccggtgatcgacgagctggccaaggactacgccggccagatcaagtgctgcaaggtgaacacggacgactgccccaacgtggcctccacctacggcatccgcagcatccccaccgtgctcatcttcaagggcggcgagaagaaggagagcgtcatcggcgccgtgcccaagaccacgctcaccaccatcgtcgacaagtacatcggcagctcgtgagccagacaactataaatacatacgtgtccgtgctcgcgcgtacacaccatgtatgtgtatctcttgtttcgtagcaaggatgatgatgcgataactcaggcagccgtctgctcctgctccgttatactatgtccaatccaactccattaattagtttcgatcggtgcatgattttcacagtgaatattataaatcaagtcatgcatgtc

SEQ ID NO: 12010 - protein, 96 aa, Panicum virgatum
  misc_feature: Ceres CLONE 1760207
  misc_feature (2)..(92): Pfam Name: Thioredoxin Pfam Description: Thioredoxin
  misc_feature: SWISSPROT Homolog: EC 1.8.1.8 Protein-disulfide reductase
  misc_feature: Useful for making plants with modulated heat sensitivity
MVMACETPVLVEFWAPWCGPCRMIAPVIDELAKDYAGQIKCCKVNTDDCPNVASTYGIRSIPTVLIFKGGEKKESVIGAVPKTTLTTIVDKYIGSS

SEQ ID NO: 12011 - DNA, 769 bp, Panicum virgatum
  misc_feature: Ceres CLONE 1760212
  misc_feature: Encodes the peptide sequence at SEQ ID NO. 12012
aaactctgcacttcttcctcgagaaaaacagtttgcatccaccgcaagaaagaggcggctggggtgctggagagcgagcagctcgggcgggcatggcggagaagctgacgccggagcaggccgacgagtgcaaggagatcttcgacctgttcgacgccgacgaggacggtcgcatcgccacgggcgagctcgtgacggcgctgcgctcgctgggccagaacgtggacgaggccgaggcgcggcgcttcctggtggacgcgggcgtccccgcgggcgccgccgccatcgacctcgcggcgttcctggccatggcggcgcgcaggatgggcgccgggccgtcggcggagcgcctcgccgagtgcttcgacgtgttcgacgacgcccgcagcgggtccatccccgcggagcagctgcggcaggtgatggtgagccacggcgaccggctcacggaggaggaggccgacgcgatgctccgcgaggccgacccccgaggcgagggccgcgtcgagtacaaggagtacgtcaaggtgctgctcagggacaggaaatgatccggtggcccgtcgccgccggtgggcgcgtgcatgcgatcgccggggatcaagattattcagtgtgtgtctgtgttaacttcgtcagtgactcggtgttgatgaatcctggggttttgtaccagttggcacagtcgattaccaccaatttaccttttcttccgggtaatcttgtgttagggggcgtttagttccaaaaacaaaattttttgggtgcc

SEQ ID NO: 12012 - protein, 152 aa, Panicum virgatum
  misc_feature: Ceres CLONE 1760212
  misc_feature (12)..(40): Pfam Name: efhand Pfam Description: EF hand
  misc_feature: SWISSPROT Homolog: EC 2.7.11.1 Non-specific serine/threonine protein kinase
MAEKLTPEQADECKEIFDLFDADEDGRIATGELVTALRSLGQNVDEAEARRFLVDAGVPAGAAAIDLAAFLAMAARRMGAGPSAERLAECFDVFDDARSGSIPAEQLRQVMVSHGDRLTEEEADAMLREADPRGEGRVEYKEYVKVLLRDRK

SEQ ID NO: 12013 - DNA, 872 bp, Panicum virgatum
  misc_feature: Ceres CLONE 1760213
  misc_feature: Encodes the peptide sequence at SEQ ID NO. 12014
agccatggccctcgcgctcgccacgaccccactcgcgcacctcgccctcgccccgcccccgatctccggctcccagtcctcgctgctgctgctgctcccgcgccgcccgtcgcccgccggcgtctcactctccctacgttcgcgcctcaccgcggccgtcgcgaccaaggaacccgagctcggcggcggcggatcggagggcggtgacggtgcaggagggagcggaggcggtggcggtgacagcgacccgagggaaggaggtccggaaggggaaggggagggggaggaacagaagatggggcagggtctatccatgtcgcagaagctcactctcgcctacgccgcgctcgtcggagctggtggtgtgatgggatatatgaagagtggaagccagaaatccttggctgcaggaggcatatcagcccttgtcctatacttcgtccacactcaactcccagtgaggcctgtctttgcatcatcaattggtttaggtatatcggctgcgctactgtcagtgatggagtctcgcttcaagaagtccgggaagatattcccggccggtgtcgtgtcacccgtgtccctagtcatggtcggaggctacttccatgggatcttgcatagctcccatgcttgatagaatccatttccatcacaccatctgcactacgcattggcatcactatcatgtttcctgtttcatgcactttaggcaccctttgttgttttaagtgttattagagttaccgttctttaagtttagttcatgttcagtgcctctgtgggacagatagtcaataagcacatgactgtgagctggtagttgtgaaagacgagcatgttttttttttgaattatgaaagacgaacattttg

SEQ ID NO: 12014 - protein, 209 aa, Panicum virgatum
  misc_feature: Ceres CLONE 1760213
  misc_feature (106)..(203): Pfam Name: TMEM14 Pfam Description: Transmembrane proteins 14C
MALALATTPLAHLALAPPPISGSQSSLLLLLPRRPSPAGVSLSLRSRLTAAVATKEPELGGGGSEGGDGAGGSGGGGGDSDPREGGPEGEGEGEEQKMGQGLSMSQKLTLAYAALVGAGGVMGYMKSGSQKSLAAGGISALVLYFVHTQLPVRPVFASSIGLGISAALLSVMESRFKKSGKIFPAGVVSPVSLVMVGGYFHGILHSSHA

SEQ ID NO: 12015 - DNA, 687 bp, Panicum virgatum
  misc_feature: Ceres CLONE 1760222
  misc_feature: Encodes the peptide sequence at SEQ ID NO. 12016
gattcacaactcgcatctggagccatcggagttcatcagcactctctagtcacacagcacaacttcttctcctcctgctacagagctcaggcaaaagcttcgccgccacaacatcccaatggctcgcttcgccgtggtcgccgccatcgtcgccctcctcgccgtcaccgcggccgcgcaggccccggccgcgacgcccaccccggcgcccaggatggccccgctgccgcgctccccggccaccgccccggcaccggccgcgaagccgcccaccgcctcggcgccgtccccgctggcctctcccccggccccgcccgccgccgagggccccgccgcggccgcgccctccgcgctgacaccgaccagctccgtctccgcccccgccggcgcccccaccgccacgcccaccgggaacggcgccgccacctccgccgtcagcttcgtcgccgtcgccgctgttgccgccgccgccgtcgtgttctagatgggggacgcgtgatgggatctcgagctgtttatactgccatattcttttttgccattcttttttattagataccgatgatgagagagcagagagaggacatttgaggggggggggggggggggattcaccgagtgctgtacacatcatgcatggttcatgatgatatgattattaatggaattctttcatttgttactact

SEQ ID NO: 12016 - protein, 121 aa, Panicum virgatum
  misc_feature: Ceres CLONE 1760222
  misc_feature: Useful for making plants with altered carbohydrate content
MARFAVVAAIVALLAVTAAAQAPAATPTPAPRMAPLPRSPATAPAPAAKPPTASAPSPLASPPAPPAAEGPAAAAPSALTPTSSVSAPAGAPTATPTGNGAATSAVSFVAVAAVAAAAVVF

SEQ ID NO: 12017 - DNA, 854 bp, Panicum virgatum
  misc_feature: Ceres CLONE 1760230
  misc_feature: Encodes the peptide sequence at SEQ ID NO. 12018
gcggccactagatttttcctgacgcggtcgctgctcccacttgctcttcccaagtcgcagcggcggcgggggcggctggggtctagcgtttgcgcggcgagggctttccccatggcggcctcggggttcggcggcggcgaggcgttccggctctcggccgcgccgggggccagcgcgctgaagctgcacaagggagacatcaccctctggtccgtcaacggcgccaccgacgccatcgttaatgctgctaatgagcgaatgctaggaggtggaggtgttgatggagcaatacatcaagctgctggaccagaattagtgcaagcatgccgcaaagttccagaggtcagaccaggagttcgttgcccaactggagaagctaggattactccagctttcaagcttcctgtgtcccgagtgattcacactgttgggcccatatatgacatggacaagcatccagaggtgtcgttgaagaatgcctatgaaaatagcttgaagcttgctaaagagaatggcattcagtacatcgcattccctgctatatcttgtggtgtttttcgttatccgcccaaagaagcatcgaaaatagctgtttctactgcacaacaattttcggaggatttaaaagaggtgcattttgttctgttttcagatgatttgtacgagatttggcgcgagactgcccaggagatgctatcacaatttcagaaatgagtggtcctatagtttctgatgcggctgtgtacttggctgctgtccttattgagatgcgagagccagaggctgtttaccgatgtaacaactataggacatttacatctttaaccatgtcgtgcacttgtggtgtaacgtcg

SEQ ID NO: 12018 - protein, 237 aa, Panicum virgatum
  misc_feature: Ceres CLONE 1760230
  misc_feature: SWISSPROT Homolog: EC 2.4.2.30 NAD(+) ADP-ribosyltransferase
AATRFFLTRSLLPLALPKSQRRRGRLGSSVCAARAFPMAASGFGGGEAFRLSAAPGASALKLHKGDITLWSVNGATDAIVNAANERMLGGGGVDGAIHQAAGPELVQACRKVPEVRPGVRCPTGEARITPAFKLPVSRVIHTVGPIYDMDKHPEVSLKNAYENSLKLAKENGIQYIAFPAISCGVFRYPPKEASKIAVSTAQQFSEDLKEVHFVLFSDDLYEIWRETAQEMLSQFQK

SEQ ID NO: 12019 - DNA, 698 bp, Panicum virgatum
  misc_feature: Ceres CLONE 1760244
  misc_feature: Encodes the peptide sequence at SEQ ID NO. 12020
agcggcggcgactgcgagtccaagatcgagcggaccgacgcagaccgggccaggaaagccggagggaggcagcggcatgtcgtggcaggcgtacgtggacgaccacctgctctgcgacatcgacagccagcgcctcgccgccgccgccatcctcggccacgatggcgccgtctgggcccagtccgacgccttcccgcaggtcaaacctgaagaaatcattgcaataatgaatgacttcaatgagccaggctctctagcacccactggtttatacctgggtggtagcaaatacatggttatccaaggtgaacctggagctgtcattcgagggaagaagggaccaggcggagttacaatcaagaagaccaatctagccataatcattgggatctatgaggaaccaatgactgctggccaatgcaacatggttgtggagaggcttggtgattaccttgtagatcagggcttctaaaccccaaatctgtaatttgtggcatccgggttgtttgtgtttgctgaaatatgccatctatcccatgaataactagcaaatgtttggacgaatactgaacaccggtggttcctcgttgtattgcaacagcttcgaacattccatggggcttatatgtaatccttttctttttttttttgaggaggtctatcctcttactggagcttactattttgacgtcaggatt

SEQ ID NO: 12020 - protein, 131 aa, Panicum virgatum
  misc_feature: Ceres CLONE 1760244
  misc_feature (2)..(126): Pfam Name: Profilin Pfam Description: Profilin
  misc_feature: Useful for biocontainment applications
  misc_feature: Useful for making plants with modulated biomass
MSWQAYVDDHLLCDIDSQRLAAAAILGHDGAVWAQSDAFPQVKPEEIIAIMNDFNEPGSLAPTGLYLGGSKYMVIQGEPGAVIRGKKGPGGVTIKKTNLAIIIGIYEEPMTAGQCNMVVERLGDYLVDQGF

SEQ ID NO: 12021 - DNA, 866 bp, Panicum virgatum
  misc_feature: Ceres CLONE 1760245
  misc_feature: Encodes the peptide sequence at SEQ ID NO. 12022
gagacctgagctggactgcgggccgcggcaggcttctccggcggagccaaagcaagcggagggtgaagtcagtgggaggcggcgtcggcatggacgaggcgacgaagaagaaagtggaagcgacggtgctggagatcctccggggctccgacatggattccgtgacggagtacaaggtccgctccgccgccgccgaccgcctcggcatagatctctccgtccccgaccgcaagctcttcgtccgcggcgtcgtggagggatacctcacttccctctcctcccaggaggtggaggaagagcagcagcagggcggcgccggcgaggaggcaaagggggacgagaaggaagatgaagaggaagaggaacaggaagaggaagaagaggaggaggagggaggtgcgcggaagaaagaatacgacgaccagggggaccttatcctctgccgcctgtcgaccaagaggagggtgacgctgtcggagttcaagggcaggacactggtgtccatccgcgaattctacttgaaggacggcaaggagctgccaaccagcaaaggaataagtatgacagtcgagcagtgggaagcattccgcaatgctgtacctgcgatagaggatgccataaaaaagcttgaagattcagactgagaacatgttttacaagcctcttcttttgcctgtatcgaatcaaatggcccagggcatatgtggtttgcaaagtgccttgcagtctcatctcatggagctcctagagctcctatgaacttgtgtaaaactaaaagtagtgccatctgtagggtagactctagacagtacggaatgtttgctaacaagtagtaaagagttcggaatttatgctagcaagtttgt

SEQ ID NO: 12022 - protein, 184 aa, Panicum virgatum
  misc_feature: Ceres CLONE 1760245
  misc_feature (86)..(177): Pfam Name: PC4 Pfam Description: Transcriptional Coactivator p15 (PC4)
  misc_feature (5)..(60): Pfam Name: DEK_C Pfam Description: DEK C terminal domain
MDEATKKKVEATVLEILRGSDMDSVTEYKVRSAAADRLGIDLSVPDRKLFVRGVVEGYLTSLSSQEVEEEQQQGGAGEEAKGDEKEDEEEEEQEEEEEEEEGGARKKEYDDQGDLILCRLSTKRRVTLSEFKGRTLVSIREFYLKDGKELPTSKGISMTVEQWEAFRNAVPAIEDAIKKLEDSD

SEQ ID NO: 12023 - DNA, 860 bp, Panicum virgatum
  misc_feature: Ceres CLONE 1760248
  misc_feature: Encodes the peptide sequence at SEQ ID NO. 12024
atccagccccgctcgtttcccgcttcccacagtttttttttttggccttgtcgcagcaggcaggcctgcacccaacacaggcaggcacggatccgggccgatcgatggcgcgcgggcggacgatgatgatgcggcgcgcgttcctggcgtgcctggtggcggcgtgggcgtcgtccaccgcgtccgcgttcgtgttcaaggcgggcggcacgggcgagtggcgcgtgcccgccggcgccaacgccaacgccaccaacgcgtacaacgcctgggcgcagcgcaaccgcttccgcgtcggtgacgccatcgctttcacctacccggccggcaacgactcggtgctcctcgtcgacaagaggtcctacgacgcctgcgacacggccgcgcccgtcgacaccttctccgacggcagcaccgtgttcaccttcccccgctccggcccctactacttcatcagcggcaccagggacaactgcaaccgcggcgagaagctcatcgtcgtcgtcatggccgagcgatcggccgtcggcaacgccaccgagccgggcgcgggactggcgccatcgcccaacggcccctactcgacctactccccgccgccgccattcggcatcgacatctcgccgccggcgtacccgccgccacccagtgacgcggcacccaaggtggcgggacttgccggcactgccgcgcttgccattggagcgctgttctacgcgcttgtttgatgtgcgcgtgttttgtttaaaatggtcatttgcgcgcgcagtggatggagagaaggtctcatcatatgcatggctgcttgactagtagcttgcccacattatatgtatgtaatcgatcacctatgccaacgc

SEQ ID NO: 12024 - protein, 207 aa, Panicum virgatum
  misc_feature: Ceres CLONE 1760248
  misc_feature (39)..(128): Pfam Name: Cu_bind_like Pfam Description: Plastocyanin-like domain
MARGRTMMMRRAFLACLVAAWASSTASAFVFKAGGTGEWRVPAGANANATNAYNAWAQRNRFRVGDAIAFTYPAGNDSVLLVDKRSYDACDTAAPVDTFSDGSTVFTFPRSGPYYFISGTRDNCNRGEKLIVVVMAERSAVGNATEPGAGLAPSPNGPYSTYSPPPPFGIDISPPAYPPPPSDAAPKVAGLAGTAALAIGALFYALV

SEQ ID NO: 12025 - DNA, 624 bp, Panicum virgatum
  misc_feature: Ceres CLONE 1760252
  misc_feature: Encodes the peptide sequence at SEQ ID NO. 12026
gcgcgcgcacacactcacgagcacaccaggcaggcgagaagcgagccaaggaaccaagcgcgcctcccgtcacgatggccgcttctcccctcgccgtgctctccgtgctcgccctcctcgccgtggccgccacggcgcaggcgcccagcggcgctcccgccgcggcgcccaaggcggccccaccgaccccggccaccccgccgccggcccccgcgccggtcgtcgcccctcccacggcggccccggccccggcccccgcggtcgacgcgcccacgccgtccgcggccgcgccggcgcccgaggcccccgtctcctcccctccggcccccacccccgacgccgcgaccccctcgccctccgccgagcccggcacgcccaccggcgccgcagccggcctccgccccgcctccgccttcgccgccgtcgccgtcgccgcggccgtctacgccttctagatgatccaggggtccccaactccccatcctctcctatgtttccttgatctctcgctgtcttctttgcttctgtttgtttaccgtcctcacaattggtgttatcttcctcgtatgagctgttgtaattatgatcattgatttaatttatccattctccattctcattctt

SEQ ID NO: 12026 - protein, 126 aa, Panicum virgatum
  misc_feature: Ceres CLONE 1760252
  misc_feature: Useful for making plants with altered carbohydrate content
MAASPLAVLSVLALLAVAATAQAPSGAPAAAPKAAPPTPATPPPAPAPVVAPPTAAPAPAPAVDAPTPSAAAPAPEAPVSSPPAPTPDAATPSPSAEPGTPTGAAAGLRPASAFAAVAVAAAVYAF

SEQ ID NO: 12027 - DNA, 849 bp, Panicum virgatum
  misc_feature: Ceres CLONE 1760276
  misc_feature: Encodes the peptide sequence at SEQ ID NO. 12028
atacgcaagcccggcgcggagccagaccgcgaggccacaccaccccttgcgcgcacaggacggcgaggatggccggaggagaggccggcgggcagctgaagctgctgggctcgtgggcgagcccgttcgtgaaccgcgtgcgggtggcgctgcacctcaagggcctcgagtacgagaacgtggaggaggacctcgccgacaagagcgagctgctcctcgcctccaaccccgtccacaagaaggtccccgtcctcctccacggcggcaagccggtgtgcgagtccctcctcatcctggagtacctcgacgacgccttccccggcgccggcccggccctcctccccgccgacccctacgaccgtgccgttgcccgcttctgggccgcctacgtcgacggcaagttacaaggcgcgatggtggcggcgctgctgggggcgacggaggaggcgcgggcggcggcgacggcggaggcgttcgcggcgctggacgcgctgcagggcgccctcgcggagcgctccggcgggaagggatcattcttcgccggcgacgcgcccggctacctggacgtggcgctgggggggttcatcgggtggctgcgcgcgtgggacatcatcaccggcggcatcaagctcctggacgccggccgggtcccgctcctcgccgcgtgggcggagcgcttcgccgcgctcgacgccgccaagggggtcatcccggacccggagcccatcgccgagtttgccaaggtgctgcaggcgcggtccgctgcagctgcaactgcgagcagctgagctcacgagtgaacgcggctgcagctgcaccgcatgttaaagattgactaataatctgttc

SEQ ID NO: 12028 - protein, 239 aa, Panicum virgatum
  misc_feature: Ceres CLONE 1760276
  misc_feature (8)..(81): Pfam Name: GST_N Pfam Description: Glutathione S-transferase, N-terminal domain
  misc_feature: SWISSPROT Homolog: EC 2.5.1.18 Glutathione transferase
MAGGEAGGQLKLLGSWASPFVNRVRVALHLKGLEYENVEEDLADKSELLLASNPVHKKVPVLLHGGKPVCESLLILEYLDDAFPGAGPALLPADPYDRAVARFWAAYVDGKLQGAMVAALLGATEEARAAATAEAFAALDALQGALAERSGGKGSFFAGDAPGYLDVALGGFIGWLRAWDIITGGIKLLDAGRVPLLAAWAERFAALDAAKGVIPDPEPIAEFAKVLQARSAAAATASS

SEQ ID NO: 12029 - DNA, 582 bp, Panicum virgatum
  misc_feature: Ceres CLONE 1760312
  misc_feature: Encodes the peptide sequence at SEQ ID NO. 12030
ctcagtcctcaccaccgcctgacctccgacctctccctgcctctgcctcgcttagctttgccgcggctagccaaccttccgcttcgtgcacctcccggtcgccgctcgcgatggcgtcccgtgctgcgttgctgctcgtggccgtggcggccgtgctgttcgccgcggcgtcggcgcaggagacggacgcgggcgtgccgcccgcgccggcccccgtcacgggcgcggcagcgggtgccgcggcgtcggccctcgccgtggcgttctccgccgtgttctccgtcctcgtcgcgggcgggctcatgcagtaggcgcagcggccgcggtggcggtggttcaattcccggctgattggggggtcaggttggaccctgtttgtatgtcttagtagtagctatagtagtagcagtcgcagtgatgggctgtgtgattgtgcctgagtcgccgtttgtgatctgatctgtgttattgcttattcttttgtaccataccgcattgttggatgtatatcgatctcctgttgaggcgtgtgctcttctatgaataaagacgatggatctcgcccgttcgtcaattgagttc

SEQ ID NO: 12030 - protein, 66 aa, Panicum virgatum
  misc_feature: Ceres CLONE 1760312
  misc_feature: Useful for making plants with altered carbohydrate content
MASRAALLLVAVAAVLFAAASAQETDAGVPPAPAPVTGAAAGAAASALAVAFSAVFSVLVAGGLMQ

SEQ ID NO: 12031 - DNA, 729 bp, Panicum virgatum
  misc_feature: Ceres CLONE 1760317
  misc_feature: Encodes the peptide sequence at SEQ ID NO. 12032
accccgtctcgccctcgcccaaatccccaccccaaaccgaaccagcgaaagctcccctgcctgagcctgcctgctccgccctccgatcgcagggaggaagaggagggagatgagctactacggccagcagccccccgtcggcgtcccgccgcagcaaggctacccggggaaggacggctacccgccgccggggtacccgccggcgcagggctacccgccgcaggggtacccgcagcagggctacccgccgccgtacgcgcagccgccgccccagcagcagcagagcagcgggccttccttcatggagggatgcttggctgctctctgctgctgctgcctcctggacgcctgcttctgagacgaccctcgccgacggattcgaggtgactgcaagtgaaatgaaactgcctcaaggaagaaacggcttgaaatgctagtgtcctagactatagctttcttgtcctgcattatcgtctatttttttcattctcttttatgaaaccctgcaatgagacttctagtactagtactctgtcggtgttgattggatgatggctggtgtgtattctgtggattgccgagtttctggtggaattcaacttgggattatggagtgcgcaacttggtttgttctaagacattttgcttggtttattcgccgttactctgttgttgatcatgttttgctcgctaagaaaaacagctcgctatgtttgtttggctgtagct

SEQ ID NO: 12032 - protein, 82 aa, Panicum virgatum
  misc_feature: Ceres CLONE 1760317
  misc_feature: Useful for making plants with altered carbohydrate content
MSYYGQQPPVGVPPQQGYPGKDGYPPPGYPPAQGYPPQGYPQQGYPPPYAQPPPQQQQSSGPSFMEGCLAALCCCCLLDACF

SEQ ID NO: 12033 - DNA, 778 bp, Panicum virgatum
  misc_feature: Ceres CLONE 1760354
  misc_feature: Encodes the peptide sequence at SEQ ID NO. 12034
tcgactctcccctctccctcgcaagcacgcaggtctcctctctcgcgccgccgccgcaaaatccacgcctccacgccggtgactcctgctgcgccgcatctcactgaattctcagcggaagcgcaagctccgcgaggggacccgagggagaatacgacctgcatcaatcggattgcggatctgtaaggatgaattctaagcgtaggaggagtcatagtccagttgaatacaaggaaggtcgtgataaagattatgagacttcaggaagaaaggataactcaagagatctagaagagtcaaaagatactaggttaggaagaggtcatgattcgggtaggcacactgataggcattcctttggaacatcgcgtgactctaagaggcatgatgactataggaggtaccatgataagtacagtgatgattatggtaggagccatccgagagcccctcggtcagatcgcgaatcaagggctgataccaattatgatcactcaaagcgtgactacacatctggtagatcacgtggtgaccagcgagatgttgacagtaggtatggagagaaatctgtcagtcgagatcagcggagtataaatgaaagaagaaagcaagactctcctcgtgcctatcaaaggaatgatattggagagtacaacaaatatacagatgcaagaaaccaagagtacagaggttatggagatgatagagatcattgcaggtttgttgataagaacaaggaaactattaaggaggatgaagtcctgaagaagagagatgg

SEQ ID NO: 12034 - protein, 196 aa, Panicum virgatum
  misc_feature: Ceres CLONE 1760354
  misc_feature: SWISSPROT Homolog: EC 5.2.1.8 Peptidylprolyl isomerase
MNSKRRRSHSPVEYKEGRDKDYETSGRKDNSRDLEESKDTRLGRGHDSGRHTDRHSFGTSRDSKRHDDYRRYHDKYSDDYGRSHPRAPRSDRESRADTNYDHSKRDYTSGRSRGDQRDVDSRYGEKSVSRDQRSINERRKQDSPRAYQRNDIGEYNKYTDARNQEYRGYGDDRDHCRFVDKNKETIKEDEVLKKRD

SEQ ID NO: 12035 - DNA, 804 bp, Panicum virgatum
  misc_feature: Ceres CLONE 1760359
  misc_feature: Encodes the peptide sequence at SEQ ID NO. 12036
gcgccgcctctaatcgcccgttcttaatctcagtttggggaaaaaagcctcgcgggtcgcaaaccactctccgctgatttgggaggcgctcgagaccttagtgacacatggctcgtactaagcagaccgctcgcaagtccactagaggaaaggctcctaggaagcaactagccaccaaggctgcccgtaagtctgcgcccacaactgggggagtgaagaagcctcaccgttaccgccctggaactgttgctcttcgtgaaatccgcaagtaccagaagagcactgacctgctcattaggaagcttccattccagaggcttgttagggagattgcccaggatttcaagactgatctgcgtttccagagccatgcggtgcttgccctgcaggaggctgcggaagcatacctggtgggtctgttcgaggacaccaacctgtgtgccatccacgccaagcgcgtgacgatcatgcccaaggacattcagctggctaggaggattcgcggcgagagggcttagtttcactgctctggtgtgcatctgtttgatgcagctgcctttgcgatgtgggtgcttaacatctgtcagtgtttttcagtgttttgaactctgaatagtaatagtgttcgttcgtggtgctaggttaggtgctgctgcaatcttactatgttttagagtttaatcatttggtacctaatacatcttaagtgctggtttcatccatccacctgatgtgtgtggtgtatctaggctctatctgaattttgaacctttaagcaagttatgaacttggttctattgtgtc

SEQ ID NO: 12036 - protein, 136 aa, Panicum virgatum
  misc_feature: Ceres CLONE 1760359
  misc_feature (58)..(132): Pfam Name: Histone Pfam Description: Core histone H2A/H2B/H3/H4
MARTKQTARKSTRGKAPRKQLATKAARKSAPTTGGVKKPHRYRPGTVALREIRKYQKSTDLLIRKLPFQRLVREIAQDFKTDLRFQSHAVLALQEAAEAYLVGLFEDTNLCAIHAKRVTIMPKDIQLARRIRGERA

SEQ ID NO: 12037 - DNA, 809 bp, Panicum virgatum
  misc_feature: Ceres CLONE 1760374
  misc_feature: Encodes the peptide sequence at SEQ ID NO. 12038
agttcgtccttggatccatctccactctccctgccccgaagcacagcagagcagagcagagctgaaacaagaccatgtcgtcgtccaaggtcttcaccctcgaggaggtcgctaagcacaacaccaaggacgactgctggctcatcatcgctggcaaggtgtacaatgtgaccaagtttcttgaggatcaccctggaggtgatgatgttctgttgtcctccactgccaaggatgctactgatgactttgaagatgtgggccacagcaccactgctcgtgcgatgatggacgagtacttagtcggtgaaattgatgcaactacaatacccactaaagtgaagtacacgcccccgaagcagccgcactacaaccaggataagacccctgagttcatcatcaagattctccagtttttggcccccttggcgatattgggcttggctgtcgccgtaaggatctacaccaagtcggaatccacctaattattgtcatcacttggccaaagattacaactgaataagttagtgaggattgtacgagcgagcatgacctgtcatgaatttggaaactttagtctctgtgatggtatgattacgtgcaacatctattggtaaattgagactcgagtgaagtggatggatattcagttttatttttccttattccttaggaatgtcgagatgcacattattgttgctctgtgccgtttgttttctatgttgtcacctgttcttagcgatatatgttttgctacatactccgaaagaagctacaacctgaattagtttgcaatttcacatgttcacagc

SEQ ID NO: 12038 - protein, 135 aa, Panicum virgatum
  misc_feature: Ceres CLONE 1760374
  misc_feature: SWISSPROT Homolog: EC 1.7.1.1 Nitrate reductase (NADH)
MSSSKVFTLEEVAKHNTKDDCWLIIAGKVYNVTKFLEDHPGGDDVLLSSTAKDATDDFEDVGHSTTARAMMDEYLVGEIDATTIPTKVKYTPPKQPHYNQDKTPEFIIKILQFLAPLAILGLAVAVRIYTKSEST

SEQ ID NO: 12039 - DNA, 580 bp, Panicum virgatum
  misc_feature: Ceres CLONE 1760379
  misc_feature: Encodes the peptide sequence at SEQ ID NO. 12040
atcacagtgagtctccccctctcttccgccaccacaacacagctccgacggcggcgggcaccccactccagaacacaaacgcgacggccatggtcacggcgctctaccgcggcctccgctccgggatccgcctcctcgccgccggcgcctaggcgtccaatcctgcttctcgcgcatcccctgccactggtgcgaccagaaggggacggcgcggccatgatgagccgtactatctcgctgccaagcgcatgtacaacttgcccaggatgaagcctcaggcgttgaacgtgactctttccgtgctgggagcccttagcagcgtggttggagtccctgtggtcgctctcattttccaccacaacaacaccgcctcaggttgagcgatcctgctctctcagcctacttatcggaaacttgtttgcaaccatattttgtgacgttaacgcttgcacttccttcttaccttgcttgttgcttatgaccatgttttcttactagaagttgtattgaaacctcgtttcttgccattatcaatgcgacactcctttctgctcttagtatctgaggcttgaactttcag

SEQ ID NO: 12040 - protein, 43 aa, Panicum virgatum
  misc_feature: Ceres CLONE 1760379
  misc_feature: Useful for making plants with modulated nitrogen use efficiency
MYNLPRMKPQALNVTLSVLGALSSVVGVPVVALIFHHNNTASG

SEQ ID NO: 12041 - DNA, 703 bp, Panicum virgatum
  misc_feature: Ceres CLONE 1760381
  misc_feature: Encodes the peptide sequence at SEQ ID NO. 12042
atatatgcacccaccagcagcaactaacgatacgccatggccgccgccgtgcccctcctccttttgctggctgccgccgccgccgcctcgccggcggcgggcggcggcaagcagacgcacatcaagctgtactttcacgacgtgctgagcgagccgagcccgacggcggtgcgggtggcgcgcgccgccgtcaccaacacctccaagacgggcttcggcctcgtgacgatcatcgacgacccgctcaccgagggccccgacctcaactcctccacgcccctcggccgcgcccagggcacctacatcgccgccggcaaggacgaggtggccctgctcatgaacatgaacttcgtcttccaggccggcacgtacaacggcagcaccgtcgccatcatgggccggaacccggtgttcgacgccgtccgggagatggccgtcatcgggggcaccggcgtgttcaggatggcgcgagggtacgcgcaggccaggacgcacaccttcgacctcaagagcggcgacgccaccgtcgagtaccacctctacatcaaccactgatcgatcgtccgagtgctctgctccactccatccaccgctgtccagtgtcatcaggcgccgcaactaccgcacttggtttccatcgtttcaaccacactgcactttgttttacatcctataaattgatttgccaaacacatccattacc

SEQ ID NO: 12042 - protein, 172 aa, Panicum virgatum
  misc_feature: Ceres CLONE 1760381
  misc_feature (7)..(172): Pfam Name: Dirigent Pfam Description: Dirigent-like protein
MAAAVPLLLLLAAAAAASPAAGGGKQTHIKLYFHDVLSEPSPTAVRVARAAVTNTSKTGFGLVTIIDDPLTEGPDLNSSTPLGRAQGTYIAAGKDEVALLMNMNFVFQAGTYNGSTVAIMGRNPVFDAVREMAVIGGTGVFRMARGYAQARTHTFDLKSGDATVEYHLYINH

SEQ ID NO: 12043 - DNA, 567 bp, Panicum virgatum
  misc_feature: Ceres CLONE 1760385
  misc_feature: Encodes the peptide sequence at SEQ ID NO. 12044
atctcgcaaaaaaatccccaaatcttcctcctcccaaatccctcgaatcctccgcgcctcgggcaagctctaggtagtcgtcgcagcagcagccatgtcgggccgcggcaagggaggcaagggcctgggcaagggcggcgcgaagcgccaccggaaggtgctccgcgacaacatccagggcatcacgaagccggcgatccggaggctggcgaggaggggcggcgtgaagcgcatctccgggctgatctacgaggagacccgcggcgtgctcaagatcttcctcgagaacgtcatccgcgacgccgtgacctacacggagcacgcccgccgcaagaccgtcaccgccatggacgtcgtctacgcgctcaagcgccagggccgcaccctctacggcttcggcggctgagcccctggcccccgcccgcgtcctgtgtgtcgcgtgcaggcgcaagctggggttcctgatgggttagagaagttgatgtgctgggttctgtcctgtgcctagctgcgttgtaatggtgaagtatggtagcctatcaattgaatgcatggatgttctgaggc

SEQ ID NO: 12044 - protein, 103 aa, Panicum virgatum
  misc_feature: Ceres CLONE 1760385
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 12045 - DNA, 614 bp, Panicum virgatum
  misc_feature: Ceres CLONE 1760392
  misc_feature: Encodes the peptide sequence at SEQ ID NO. 12046
tacggcgccagcgtggagctggtgatgcagggcaccagcatcctgggcatcgagagccacccgctgcacctccacggcttcaacttcttcgtcgtcggccaagggtacggcaactacgaccccgtcaacgacccggccaagttcaacctcgtcgaccccgtcgagcggaacaccgtcggcgtgccggccggcggctgggtggccatccggttccttgcagacaaccccggtgtctggttcatgcactgccatttggaggtgcacacgacgtggggcctcaggatggcatggctggtgctcgacggcagcctcccgcaccagaagctgctccctccaccgtccgatcttcccaagtgttaatcggactcgctctctcctgccggttgcttcgaaaggaaattgtgaattagacctgatcagaaacgttgggctttttttttctgtttactttcttcatcattgccaactgcaattctttcagacttccattttaattagtccgttcctagctgacccggattttttgtatttttttctccttctatttctttgcaactttgtaacgacaatgttttggtactcttgaatcaataaaccatggcgtgacttgcacc

SEQ ID NO: 12046 - protein, 119 aa, Panicum virgatum
  misc_feature: Ceres CLONE 1760392
  misc_feature (1)..(103): Pfam Name: Cu-oxidase_2 Pfam Description: Multicopper oxidase
  misc_feature: SWISSPROT Homolog: EC 1.10.3.2 Laccase
  misc_feature: Useful for making plants with altered carbohydrate content
  misc_feature: Useful for making plants with altered cell wall content and/or composition
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
YGASVELVMQGTSILGIESHPLHLHGFNFFVVGQGYGNYDPVNDPAKFNLVDPVERNTVGVPAGGWVAIRFLADNPGVWFMHCHLEVHTTWGLRMAWLVLDGSLPHQKLLPPPSDLPKC

SEQ ID NO: 12047 - DNA, 625 bp, Panicum virgatum
  misc_feature: Ceres CLONE 1760397
  misc_feature: Encodes the peptide sequence at SEQ ID NO. 12048
attgtgggtacctatttcttgctgaatagctgagaactataattggcagtggacttcgtttttctctgcagcatcaactgctttgtacgtgtacctatactccatctactactaccatgtgaagacaaagatgtcaggcttcttccagacaagtttctactttggctacacattgatgttctgccttggtctaggcattctttgtggtgctattgggtatgtagggtcaaccctgtttgtaaggagaatctacagaaatatcaaatgtgattaaattcctgctactcactagcagcagagagatcatatgtattgtcagtgcggaagcaaggcctcaaaatggattaatggtagatactgaataggtttttgaaactacagaggacatgctccctttgttcatattatacgcattttttgcttgcctgcttattcctgtggaatcatcgtcataatgtatacctatgtagttgaggattagcctaaagcaccggtttttattctttttctttttgtatttttgtttggtagaatgtaatcagtgaatgttcatgcggcgcgagcacaattgtcgggaattttttccctcctatgctttatgcatcataccatcccgttcaaagtt

SEQ ID NO: 12048 - protein, 47 aa, Panicum virgatum
  misc_feature: Ceres CLONE 1760397
  misc_feature: Useful for making plants with altered cell wall content and/or composition
MSGFFQTSFYFGYTLMFCLGLGILCGAIGYVGSTLFVRRIYRNIKCD

SEQ ID NO: 12049 - DNA, 839 bp, Panicum virgatum
  misc_feature: Ceres CLONE 1760412
  misc_feature: Encodes the peptide sequence at SEQ ID NO. 12050
gtctcctcctccctttcccctcccgaggccaggcttgccctcccctctccgcgtcgcctcccgtccaggaatccgccatgaagggggccaaatccaagggcgccgccaaggccgatgccaagttggcggtgaagagtaagggggcggagaagccggccaagggcaggaagggaaaggccggcaaggaccccaacaagcccaagagagcgcccagcgccttcttcgtcttcatggaggaattccgcaaggagttcaaggagaagaaccctaaaaacaagtctgttgctgcggtggggaaagctgccggtgacaggtggaaatccctgaccgatgcggacaaggctccttatgtagccaaggctaataaactcaagcttgagtacaacaaggctattgctgcctacaacaagggcgagagcactgctgccaagaaggctcctgccaaggaggaagaggaggaagaagaggagtctgacaagtcaaagtctgaggtaaacgacgaggatgatgaagagggtagtgaggaggatgaagacgatgacgagtaagctcaggtcaagctgatgctccatggaacaatggagtggcgaatgcaaaggcctagtggcgggatttaaatggagcctatccagtgtactagaattattcagtttcacttcacatcgtgatgttttacttttgtctgtcctataacggatatcgctccttgttggcgccgccggcgggctagtgtttgcgcggtgggcacaccggcaatacccgcttgtacctagattactgtttccattgtcatcggctaacattgtgataatatcagtttgggtaatgttagattaagt

SEQ ID NO: 12050 - protein, 156 aa, Panicum virgatum
  misc_feature: Ceres CLONE 1760412
  misc_feature (41)..(110): Pfam Name: HMG_box Pfam Description: HMG (high mobility group) box 220>
  misc_feature: Useful for making plants with altered alkaloid content 220>
  misc_feature: Useful for making plants with altered lignin content
  misc_feature: Useful for making plants with altered terpenoid content
  misc_feature: Useful for making plants with modulated nitrogen use efficiency
MKGAKSKGAAKADAKLAVKSKGAEKPAKGRKGKAGKDPNKPKRAPSAFFVFMEEFRKEFKEKNPKNKSVAAVGKAAGDRWKSLTDADKAPYVAKANKLKLEYNKAIAAYNKGESTAAKKAPAKEEEEEEEESDKSKSEVNDEDDEEGSEEDEDDDE

SEQ ID NO: 12051 - DNA, 655 bp, Panicum virgatum
  misc_feature: Ceres CLONE 1760417
  misc_feature: Encodes the peptide sequence at SEQ ID NO. 12052
aggcaagctcactcgcacctttatataaagcaacccaccagaagcatcagctttggtttcatctccttgtacatagcccattgcaaggcattctcaagcatagcctgtgcctttcccttcctctcctccgctctgtcttccagagctttgagatggctcagcagaaggtggtgctgagggttccaaccatgactgatgacaagatcaagcagaaggccattgaagctgttgcggacatttacggtattgactccatagcagcagatctgaaggagaacaagatgaccatcataggcgaaatggatgctgttgcaattgccaagaaattaaagaagattgggaagattgacattgtgtccattggacctgcaaaggaagaaaagaaggaagaaaagaaagaggagagaaaagaagagaagaaagaggagaagaaagaggaaaagaaagaagagaagaaatgataaaaatataaagcatatactatctatcattgtgtgacctctctcttatctgcagttgcaatagttttgagcctttgactttgtactgatgtttctatgtgaagttactatgtaaaatttatactacagagtacaaattagttaaaaataaaagcatgatttgtgcatcttttagcatacatgctccctacctc

SEQ ID NO: 12052 - protein, 102 aa, Panicum virgatum
  misc_feature: Ceres CLONE 1760417
  misc_feature (7)..(74): Pfam Name: HMA Pfam Description: Heavy-metal-associated domain
MAQQKVVLRVPTMTDDKIKQKAIEAVADIYGIDSIAADLKENKMTIIGEMDAVAIAKKLKKIGKIDIVSIGPAKEEKKEEKKEERKEEKKEEKKEEKKEEKK

SEQ ID NO: 12053 - DNA, 817 bp, Panicum virgatum
  misc_feature: Ceres CLONE 1760419
  misc_feature: Encodes the peptide sequence at SEQ ID NO. 12054
atcgagccagaggtccttttatacgatgaacctacagctgggcttgaccctattgcatcaactgttgttgaagaccttatacgttctgtgcatatgactggacgggatgctctaggcaagcccgggaaaatagcttcttatgttgttgtgacccatcagcatagcacaataagaagagctgttgataggttgctgtttcttcatgaggggaaggtagtttgggaaggaatgacacatgagttcacaacatcaactaatccaattgttcaacagtttgcatcaggtagcttggatgggcccatacaatatttctgaagacccagccacattagtgactcaaaacttaggtggttttgtatacctcagatcatcccagcactatctggagcatcaagaatctgaaacgcacttgcagcaatggctgggatatgtaaacacattcagattgccattattccattgagccttatggtatctgcaacagcatcgatcagtcacggcactcaatttgcgcgtagtagtgataccagctgctcaaataagcattagtttctacatcattctttgggggaactgcactgagccgccaatccaagccagaacatttcggtcctttacaagtgacctgatgtgaatgtatttgtcacctatagcagtatgccaatcctccagtattctcatatacttgttaatgttagtctgaacgttcagaagatggtagtcgtgtgtacccaatttgggcactcaggttgataagcagctacctgctgatttttgtagaactttattactatcttttaacaacgtcaaatgagac

SEQ ID NO: 12054 - protein, 104 aa, Panicum virgatum
  misc_feature: Ceres CLONE 1760419
  misc_feature: SWISSPROT Homolog: EC 3.6.3.27 Phosphate-transporting ATPase
IEPEVLLYDEPTAGLDPIASTVVEDLIRSVHMTGRDALGKPGKIASYVVVTHQHSTIRRAVDRLLFLHEGKVVWEGMTHEFTTSTNPIVQQFASGSLDGPIQYF

SEQ ID NO: 12055 - DNA, 618 bp, Panicum virgatum
  misc_feature: Ceres CLONE 1760442
  misc_feature: Encodes the peptide sequence at SEQ ID NO. 12056
atcgaaacgatagaacaagagaacttggaaaaggagagggcgaaaattcgaaaggaagaagaggagaacgcgaagcaaatggcggaggcccccagcaagatcgaatccatgaggaaatggatcgtcgagcacaagctccgagccgtaggttgcctctggcttactgggatcagcagttcgatcgcctataactggtcgcgccccaatatgaagcctagcgtcaagatcatccacgcaaggttgcacgcgcaggctctaacccttgctgcattggttggttctgcatgtgtcgagtactatgacaacaaatatggttcttctgggcctaaggtggacaaatacacaagccaatacttggcacattcgcataaagattaagatctccatgttggctcctgcatactggattaattttgggtgctcatgagccatgtacctcgtaatgcgaaatgacagcatacttgccagggtattcctggaaaatgacatggaggttgtagtgcagatatttatcttcataatttagcctcaggttgcgttatgtaatattacattgtggacagtcctgggatatttttttccaagaaaagcaaaggagagaaatcctgatttgtgctg

SEQ ID NO: 12056 - protein, 125 aa, Panicum virgatum
  misc_feature: Ceres CLONE 1760442
  misc_feature (30)..(97): Pfam Name: HIG_1_N Pfam Description: Hypoxia induced protein conserved region
IETIEQENLEKERAKIRKEEEENAKQMAEAPSKIESMRKWIVEHKLRAVGCLWLTGISSSIAYNWSRPNMKPSVKIIHARLHAQALTLAALVGSACVEYYDNKYGSSGPKVDKYTSQYLAHSHKD

SEQ ID NO: 12057 - DNA, 569 bp, Panicum virgatum
  misc_feature: Ceres CLONE 1760458
  misc_feature: Encodes the peptide sequence at SEQ ID NO. 12058
gcatcatcacagaggaagagcgagcggcaatcgaagcagcagcaatggcggcctccatgatctcgtcgtcagctctggtggcgccggccagggcccagggcctgccgtccctcggccgccgcgcctcctccttcgccgtcgtctgcggcaccggcaagaagatcaagaccgacaagtacggcgccaacgtcgacggatacagcccaatctacaaagaggaggactggtctcccaccggtgacgtctacgtcggtggaaccactggacttctgatctgggccgtcaccctcgccgggctccttggaggcggtgccctccttgtttacaacaccagcgctctcgccagctaagaacactattcatgcacagtccatgcaagcacttgcggttcatgtaagatcagcttgggggtgtctgtctgtaatctagcctgcagctttgatgtccaatataatgcttggttcatgtaacaatgctactacggctctccatacttttgggacagttattatattaattacttgatgctacatatttagattaatatataactggtaactttatttctc

SEQ ID NO: 12058 - protein, 101 aa, Panicum virgatum
  misc_feature: Ceres CLONE 1760458
  misc_feature (7)..(101): Pfam Name: PsbR Pfam Description: Photosystem II 10 kDa polypeptide PsbR
MAASMISSSALVAPARAQGLPSLGRRASSFAVVCGTGKKIKTDKYGANVDGYSPIYKEEDWSPTGDVYVGGTTGLLIWAVTLAGLLGGGALLVYNTSALAS

SEQ ID NO: 12059 - DNA, 647 bp, Panicum virgatum
  misc_feature: Ceres CLONE 1760493
  misc_feature: Encodes the peptide sequence at SEQ ID NO. 12060
tggtgctccggcgtgatggcggccacggcgtactccgtggcgctcctcggcggcgcgcgcctccccgccgccccgcgctccgccctcctcccgcgccgcagcgcctgccagctccgcctccagcaagatgcgccgaggctctccctgctccgcgtgagggccgcctccgaggacacctcctcggcctccgccgacgagctcatcgaggacctcaaagccaagtgggacgccgttgaggacaagcccaccgtgctcttgtacggcggcggcgccatcgtcgccctctggctgacctccgtggtcgtcggcgccatcaacgccgtgccgctgctgcccaagatcatggagctcgttggcctcggctacaccggctggttcgtctaccgctacctcctcttcaaggaaagtcggaaagacttggctagcgacattgagaccttgaagaagaagatcaccggaacagaataaacacacgctcttggagagttttgagtggttctttcatcttgggggggaaaatatgtaatgggagaaccgtctgcttgagtactactgccgatttgtgctatatatctggatacaaaggaagctttgttatgttgtgcagtaacattgtagtttgaatatatcgcactaccagtttgttt

SEQ ID NO: 12060 - protein, 150 aa, Panicum virgatum
  misc_feature: Ceres CLONE 1760493
  misc_feature: SWISSPROT Homolog: EC 6.1.1.9 Valine--tRNA ligase
MAATAYSVALLGGARLPAAPRSALLPRRSACQLRLQQDAPRLSLLRVRAASEDTSSASADELIEDLKAKWDAVEDKPTVLLYGGGAIVALWLTSVVVGAINAVPLLPKIMELVGLGYTGWFVYRYLLFKESRKDLASDIETLKKKITGTE

SEQ ID NO: 12061 - DNA, 750 bp, Panicum virgatum
  misc_feature: Ceres CLONE 1760504
  misc_feature: Encodes the peptide sequence at SEQ ID NO. 12062
acctgaagctccatcagccatggcattcacgcccgccacggcctgctgcaatccctcgctgctggcggcgccccgggcgccgtcgcgcggctcgtcgccccgcgcgcaggcggcgctcctcggcgcggtctccacctccgcgttccgcggcgtccgggcgcccgcggccgccgcggcggccccgcggtggcgccgcgcggccgcgtctacgggcatcgtctgcggcaaggtgaccaagggcagcgtgccgtccaacttcaccctcaaggaccagaacgggaggcccgtgtcgctgaacaagttcaagggcaagccggtggtggtctacttctaccccgccgacgagacgcccggatgcaccaaacaggcgtgcgcgttccgcgactcgtacgagaagttcaagaaggccggcgcggaggtgctgggcatcagcggcgacgacgcggcgtcgcacaaggcgttcgcgcagaagtaccggctgccgttcacgctgctgagcgacgaggggaaccgggtgcgcaaggagtggggcgtgcccggggacctgttcgggacgctgccggggcggcagacctacgtgctggacaagaacggcgtcgtccagtacatctacaacaaccagttccagcccgagaagcacatcggcgagaccctcaagatcctgcagggcctctgagctctgcatccgtcgctgtaaacgtaccggaactgtatgtgatgaatgaagagcctgattgtttgtccagcgat

SEQ ID NO: 12062 - protein, 218 aa, Panicum virgatum
  misc_feature: Ceres CLONE 1760504
  misc_feature (72)..(197): Pfam Name: AhpC-TSA Pfam Description: AhpC/TSA family
  misc_feature: SWISSPROT Homolog: EC 1.11.1.15 Peroxiredoxin
MAFTPATACCNPSLLAAPRAPSRGSSPRAQAALLGAVSTSAFRGVRAPAAAAAAPRWRRAAASTGIVCGKVTKGSVPSNFTLKDQNGRPVSLNKFKGKPVVVYFYPADETPGCTKQACAFRDSYEKFKKAGAEVLGISGDDAASHKAFAQKYRLPFTLLSDEGNRVRKEWGVPGDLFGTLPGRQTYVLDKNGVVQYIYNNQFQPEKHIGETLKILQGL

SEQ ID NO: 12063 - DNA, 853 bp, Panicum virgatum
  misc_feature: Ceres CLONE 1760572
  misc_feature: Encodes the peptide sequence at SEQ ID NO. 12064
actccactccactccacgccaccggtggactttaagcattgccacggggggcgccatgccggcggacgggagcaagaagaagggcgtgccgccgctgggctggtggctcatgctcgtcggctccctccgcctcgcctccgtctggttcggcttcttcgacatctgggcgctccgcgtcgccgtcttctcccaagcggagatgactgatgtacacggccgtacttttggtgtctggactcttctgacctgcacgttgtgcttcctttgtgcactcaacctggaaaataggcctctatatctggccaccttcctgtcattcatctatgcttttggtcatttcctaacggaatacttgatataccacaccatggctgtggcaaatctcagcacggttggcttctttgcaggaacgtcaattgtatggatgcttcttcagtggaattctcatggcaacccccgtggatcccatgctgtgaagcagtcatgagaaatgctcgggttgtcagcttgatgtggtctgggggaggaaggatgcgtgaagaaaccttgccataaaggcttcgttgccattcgtacttcatttgtcatcatgttatttcagttcatgaaatgtttgttccactgattagaatctggaaattcgaacgttgtaaactgcgcgcatctgagtcttgtagccaagagctgtaatttccggtttgatcacattcaggcgtgcctgggaaacagattagctgttgtttttcaaagaacagatagctgctcagattatcacatgttgagagctgatacgccaataagggatactgcagtataacgtactgctagctcttgcatttgtaccagccaaggc

SEQ ID NO: 12064 - protein, 143 aa, Panicum virgatum
  misc_feature: Ceres CLONE 1760572
  misc_feature (11)..(120): Pfam Name: Erg28 Pfam Description: Erg28 like protein
MPADGSKKKGVPPLGWWLMLVGSLRLASVWFGFFDIWALRVAVFSQAEMTDVHGRTFGVWTLLTCTLCFLCALNLENRPLYLATFLSFIYAFGHFLTEYLIYHTMAVANLSTVGFFAGTSIVWMLLQWNSHGNPRGSHAVKQS

SEQ ID NO: 12065 - DNA, 673 bp, Panicum virgatum
  misc_feature: Ceres CLONE 1760581
  misc_feature: Encodes the peptide sequence at SEQ ID NO. 12066
cgccaacgatggccctggagacgtgcttcagagcgtgggcgctgcacgccgcccccgccggcggcaaggacaggctcgccgtcggcagcagcttcgcgccgtccaagcgggccgccgccgcgccgctgtccgtcggccgcgtcgccacgcggcggccgcggcacgtctgccagtccaagaacgccgtcgacgaagtgctggtggcggacgagaagaactgggacgggatggtgatggcgtgcgagacgccggtgctggtggagttctgggcgccgtggtgcgggccgtgccggatgatcgcgccggtgatcgacgagctggccaaggactacgccggccagatcaagtgctgcaaggtgaacacggacgactgccccaacgtggcctccacctacggcatccgcagcatccccaccgtgctcatcttcaagggcggcgagaagaaggagagcgtcatcggcgccgtgcccaagaccacgctcaccaccatcgtcgacaagtacatcggcagctcgtgagccagacaactataaatacatacgtgtccgtgctcgcgcgtacacaccatgtatgtgtatctcttgtttcgtagcaaggatgatgatggcgataactcgaggctgtgtgtgttcactagtatattgtgatgatcagttgatgtgttgtttatctg

SEQ ID NO: 12066 - protein, 169 aa, Panicum virgatum; identical to SEQ ID NO: 10330
  misc_feature: Ceres CLONE 1760581
  misc_feature (62)..(165): Pfam Name: Thioredoxin Pfam Description: Thioredoxin
  misc_feature: SWISSPROT Homolog: EC 1.8.1.8 Protein-disulfide reductase

SEQ ID NO: 12067 - DNA, 848 bp, Panicum virgatum
  misc_feature: Ceres CLONE 1760596
  misc_feature: Encodes the peptide sequence at SEQ ID NO. 12068
aagcagcagctagcatcacaagtaatccgttcacacacaatcatcatccgatcctattgtcactctcgcacttgaaggttaagttccatccatggcggaggagaagcaccaccaccacctcttccaccacaagagggacgaggaggagcagcccgccggcgggtacggcggcgaggccgccaccgccgagtacacggagaccaccgtgacggaggtggtgtccaccggcgaggacgagtacgagaagtacaagaaggaggagaaggagcacaagcacaagcagcacctcggcgagtcaggcgccatcgccgccggcgccttcgcgctgtacgagaagcacgaggcgaagaaggaccccgagcacgcgcaccggcacaagatcgaggaggagatcgcggcggcggcggccgtgggctccggcggctacgccttccacgagcaccacgagaagaagaaggaccacaaggacgccgaggaggccggcggcgagaagaagcaccaccacctcttcggctgatgtgtccagtcgtcgactcagtacatacgtgtgcggcggccccaccacatgtatatgatgatctgtctatatacgtatatatgctgcgcatcttaattaatgtctccgtgtgctactgctacgtacgcgtgtactgtaagagtgagaggctgagaggtggccccgcgcgccagctgtgtgtgtgtgtttgctttcctgggtagtacatatacatgtatacgtgttgaataaggggccccggctccgtgtatgtatgtgtgtatatgttgtatctacgagtggaaaatgtgtgcaactctgatttgcgtagctatacgcatactgcttctct

SEQ ID NO: 12068 - protein, 141 aa, Panicum virgatum
  misc_feature: Ceres CLONE 1760596
  misc_feature (51)..(130): Pfam Name: ABA_WDS Pfam Description: ABA/WDS induced protein
MAEEKHHHHLFHHKRDEEEQPAGGYGGEAATAEYTETTVTEVVSTGEDEYEKYKKEEKEHKHKQHLGESGAIAAGAFALYEKHEAKKDPEHAHRHKIEEEIAAAAAVGSGGYAFHEHHEKKKDHKDAEEAGGEKKHHHLFG

SEQ ID NO: 12069 - DNA, 465 bp, Panicum virgatum
  misc_feature: Ceres CLONE 1760600
  misc_feature: Encodes the peptide sequence at SEQ ID NO. 12070
  misc_feature (128)..(128): n is a, c, t, g, unknown, or other
  misc_feature (197)..(197): n is a, c, t, g, unknown, or other
  misc_feature (242)..(242): n is a, c, t, g, unknown, or other
cacggcctccggggccgggccggggcggcgccgccgccggggagggccggcaggaagcgcgcgcagggcagccggagcgaccacaccggcccggccaccaaccagagcaggggggagacgacgacgcngaagcggggggcggggcgggccgggccggcgccggcggcgaaccggaaggcgacagcggggcagaagcncgagccccgcgacgccggccagcagaccggcgattttgccgggancacgcgcgccgacacgctggcctgcggcgccgccggccacatcagcggcggcggcatcgtgctcgggctcaagaacaccggcgcgctcaaccagatcatcggctaggtccagtgtctgcctttgccgctctcggcgccggcccggtgcccatgtaacctgcgtgtgtacatcgactccgcgctcatgcatctcgttccaatggacatagcttgtttgttgctc

SEQ ID NO: 12070 - protein, 115 aa, Panicum virgatum
  misc_feature: Ceres CLONE 1760600
  misc_feature (30)..(110): Pfam Name: PSI_PSAK Pfam Description: Photosystem I psaG / psaK
  misc_feature (43)..(43): Xaa is any aa, unknown, or other
  misc_feature (66)..(66): Xaa is any aa, unknown, or other
  misc_feature (81)..(81): Xaa is any aa, unknown, or other
HGLRGRAGAAPPPGRAGRKRAQGSRSDHTGPATNQSRGETTTXKRGAGRAGPAPAANRKATAGQKXEPRDAGQQTGDFAGXTRADTLACGAAGHISGGGIVLGLKNTGALNQIIG

SEQ ID NO: 12071 - DNA, 626 bp, Panicum virgatum
  misc_feature: Ceres CLONE 1760613
  misc_feature: Encodes the peptide sequence at SEQ ID NO. 12072
atcttctcagtagtacactcgctagctttctaagctgctatataaattaaattaaagctagcagcgcgcggcaagtagtactgatcgatcggcatcgccggccggagatcgacatgacgatgatgaagaagcagcagcaagctgtggtgctgctgctgctgctgctggtggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagcttatctgtatctatctatacatacatatatatgatcgctcgctcgctcgctcgatcttagtcgtctacgtgtggcttgctgctgttcatccagccgctcgctacgtgtgtgtgtatatagacacacacacacgcgacggataaataaaagatgcatgggttgcctccgggccgctccctatatagcc

SEQ ID NO: 12072 - protein, 94 aa, Panicum virgatum
  misc_feature: Ceres CLONE 1760613
  misc_feature (29)..(94): Pfam Name: Tryp_alpha_amyl Pfam Description: Protease inhibitor/seed storage/LTP family
  misc_feature: Useful for making plants with modulated biomass
MTMMKKQQQAVVLLLLLLVAAGGASAASCNAGQLTVCASALTSGGKPSAACCSNLKAQQGCFCQFAKNPAFARYINSPTARKVVASCGVALPRC

SEQ ID NO: 12073 - DNA, 580 bp, Panicum virgatum
  misc_feature: Ceres CLONE 1760624
  misc_feature: Encodes the peptide sequence at SEQ ID NO. 12074
cacgacgacatgatcatgctcgcgcacaaccccgcgtgttcaacgagggcatgaagaaccactcggtgatcatcaccaagaagctgctcgagttctacgccggcttcgagggcgtcggcaccctggtcgacgtcggcggcggcgtcggcgccaccctgcacgccatcacctcccgctaccccggcatcaggggggttttcttcgacctgccccacgtgatctccgaggcgccgccgttccccggcgtggagcacgtcggcggggaaatgttcaaggccgtgcccgccggcgacgccatcctcatgaagtggatcctccacgactggagcgacgcccactgcgcggcgatcctcaagaactgctacgagagggagttcgaggagctcgccaagggcgccgggttcaccgggttcaagaccacctacatctacgccaacgcatgggccatcgagttcaccaagtagatctgttgtcgcgcatgtgcttgtgcttaatttgctttcttcatcatcatcttcatcctgctgctggcctgcctgccggcctccatggccggaccaccatcgatccttgttctgga

SEQ ID NO: 12074 - protein, 153 aa, Panicum virgatum
  misc_feature: Ceres CLONE 1760624
  misc_feature (1)..(149): Pfam Name: Methyltransf_2 Pfam Description: O-methyltransferase
  misc_feature: SWISSPROT Homolog: EC 2.1.1.68 Caffeate O-methyltransferase
  misc_feature: Useful for making plants with altered carbohydrate content 220>
  misc_feature: Useful for making plants with altered cell wall content and/or composition
  misc_feature: Useful for making plants with altered lignin content
  misc_feature: Useful for making plants with modulated time to senescence
RRHDHARAQPRVFNEGMKNHSVIITKKLLEFYAGFEGVGTLVDVGGGVGATLHAITSRYPGIRGVFFDLPHVISEAPPFPGVEHVGGEMFKAVPAGDAILMKWILHDWSDAHCAAILKNCYEREFEELAKGAGFTGFKTTYIYANAWAIEFTK

SEQ ID NO: 12075 - DNA, 789 bp, Panicum virgatum
  misc_feature: Ceres CLONE 1760632
  misc_feature: Encodes the peptide sequence at SEQ ID NO. 12076
gtcggccacccgacggccactcacctcggctggctcctgtcctgcgctccccccctgcagacaaaaacgagcacacacgagcagctccgagcagacgcggcgaggattcattcgttcaacagcagaggaggaggaggaggaagagagcaagcggctccggtcccaatcatatcccatggcgctgttcgccgtcctccgcgcatctccggtggctgccgccgcggcgccgtccttctcctgcatgtccggccgtgcgtctgcgctgcgcgtcacatccggcaagaggcgcgccgtctcctccagggcggccgcccggccgctgtccatccggtgcgagcagagcgcgaagcagggcggcggcggcgccgacgtgtggctgggccgcgccgccatggtcggcttcgcctcggcgatctccgtcgaggtggccaccggcaaaggcttcctccagaacttcggcgtggcgacgccggcgccgacgctggcgctggtcgtgtcggggctcgtcgtcggcctcaccgtcttcttcctgctccagtccggctcgcgagactgaacgccggtggacgagcaatcgaacatctgcagggttcagtgctgaaggttcgtcagaggctgctctgcaaacgcatctagtttgtccctggttcactgccggtgccggcctcggatcggatcagtgacctaccagctagtactggtacagtccatattgtattgtcctgtggctttgtgtttggaccatctgtcggcgatacgaactaacatgcagtgacctaaaacgtgctc

SEQ ID NO: 12076 - protein, 126 aa, Panicum virgatum
  misc_feature: Ceres CLONE 1760632
  misc_feature: SWISSPROT Homolog: EC 4.99.1.1 Ferrochelatase
MALFAVLRASPVAAAAAPSFSCMSGRASALRVTSGKRRAVSSRAAARPLSIRCEQSAKQGGGGADVWLGRAAMVGFASAISVEVATGKGFLQNFGVATPAPTLALVVSGLVVGLTVFFLLQSGSRD

SEQ ID NO: 12077 - DNA, 1002 bp, Panicum virgatum
  misc_feature: Ceres CLONE 1760634
  misc_feature: Encodes the peptide sequence at SEQ ID NO. 12078
gagcacccagccaaaccgaacgcagccggcaaaccatttccgcaccaccgcatcgccctccgccgccagtcgcgcgcccgcgtccgccaccggcaccggcaccggcacagcaagccacgcctcctccctgtccctgaccatcccgcgcgcccgaccccgccgcgaaagccccgagatccgccgcgccgccgtcgatcgaccgggggcctgagaaagaagaagatggggcggagaggggagccctactacgtggaggcggcgccgccggtggacgtcaacaagaacaccgagtggttcatgtacccgggcgtctggaccacctacatyytgctcctcttcttcgcctggctcctcgtcctctccgtctccggctgctccccgggggccgcctggaccgtcgtcaacctcgcgcacttcgccatcacttaccacttcttccattggaagaaaggaaccccatttgctgctgatgaccagggcatctacagccgattgacatggtgggagcaaattgacaatggccagcagcttactcggaacagaaagtttttaactgtggtacctgtggtcctgtacctgattgcatcacacttgaccgactacaagcagccgatgtttttcctcaacaccgtggcggttttcgtgctggttgtagcaaagctgccaaacatgcacaaggtccgcatatttggaatcaatgcagacttctgatggccaattcaggaagtacatggattcgcatgctccaagttctgaaagagggacgtggaacaagtgaagtcgccgcctgtaatatctgtgtaggtgtagaaagaactgtaaatgttactctagcatacaaggtttgcctgcagactgctgtgtgtttgttgtcgcagcttcttcctttagagttggttcactggaagtcttcctttagtgcatggaacacagcagtatgtggataagaaagtgtgttgcaaatgctgtttgccgtcttgtatataatggaaccaagctgat

SEQ ID NO: 12078 - protein, 162 aa, Panicum virgatum
  misc_feature: Ceres CLONE 1760634
  misc_feature (18)..(161): Pfam Name: ORMDL Pfam Description: ORMDL family
MGRRGEPYYVEAAPPVDVNKNTEWFMYPGVWTTYILLLFFAWLLVLSVSGCSPGAAWTVVNLAHFAITYHFFHWKKGTPFAADDQGIYSRLTWWEQIDNGQQLTRNRKFLTVVPVVLYLIASHLTDYKQPMFFLNTVAVFVLVVAKLPNMHKVRIFGINADF

SEQ ID NO: 12079 - DNA, 936 bp, Panicum virgatum
  misc_feature: Ceres CLONE 1760692
  misc_feature: Encodes the peptide sequence at SEQ ID NO. 12080
gagcgaacgcggagaatagaaaaggattcctccaattcggaaaccggaaagaccagaagaatccagaggcagctccaggatcgtgggcgatgctgcgcgcgggaggcaggcggctcctcgccccggggctccggcggctcggctttggcgccgccggcgaggcgggcccggccgcggcggggacgagggcgtaccacgagcgggtggtggaccactacaacaaccctaggaacgtggggtcgttcgacaaggacgaccccaacgtcggcaccgggctggtcggcgcgccggcctgcggcgacgtcatgaagctgcagatccgcgtcgacgaggactccggcaagatcgtcgacgcctgcttcaagaccttcggctgcggctccgccatagcgtcctcatccgtggctactgaatgggtgaagggaaaaccaatggatgaagttttgactatcaagaacactgagattgcaaagcacttgtcgcttccaccagtaaagctccactgcagcatgcttgcagaggatgcgattaaggctgctgtgaaggactacgaagccaagaaggcgaagatggggcaaaagggcgaagacagcccttcggagaaggctgctgaagcatgaacgtgaagtttctgccatgaagacacggcacttgcatattttgattcccgaatccaccatcatgcatctgcaaagataaatgctactggccgtaaggtgggggattatgtgtaatgttcacaaactctggtactgcagcatgtatcataactcgggtacggagagggagcaatttcaaataaatctgctgccatcttagaaaagagtatgttcatgtacaagagctgtgtctagaagtgctgtttggctgtacgttatttatgtacaatacaacttgctcgtcgatgcacttcgaaaggaaattcgcacttcgacg

SEQ ID NO: 12080 - protein, 176 aa, Panicum virgatum
  misc_feature: Ceres CLONE 1760692
  misc_feature (34)..(161): Pfam Name: NifU_N Pfam Description: NifU-like N terminal domain
MLRAGGRRLLAPGLRRLGFGAAGEAGPAAAGTRAYHERVVDHYNNPRNVGSFDKDDPNVGTGLVGAPACGDVMKLQIRVDEDSGKIVDACFKTFGCGSAIASSSVATEWVKGKPMDEVLTIKNTEIAKHLSLPPVKLHCSMLAEDAIKAAVKDYEAKKAKMGQKGEDSPSEKAAEA

SEQ ID NO: 12081 - DNA, 747 bp, Panicum virgatum
  misc_feature: Ceres CLONE 1760700
  misc_feature: Encodes the peptide sequence at SEQ ID NO. 12082
  misc_feature (532)..(532): n is a, c, t, g, unknown, or other
agctcatctcggtttctttcttgctctgttccgctgctgctgctgctgctgcttcttcttcatcatctccggtgggctgcgcgatggagacggcgttagcgctggcggccgccgtgctcctcttgtcctccacgctcgctgcttcagagttctgcgtgtgccggtccgaccagccgacggcggcgctgcagaaggtgatcgacttctcgtgcggcaacgacgcggactgctcgtccatcctgcagggcggcgggtgctacaaccccaacaacgtcgccgcgcactgctcctgggccgccaacagctactaccagaacaacaaggccaagggcgccacctgcgacttcggcggcgccgccaccatctccaccgccgaccccagtttctccgggtgcactttcccttcgactgccagtgcttccgggacggcgggcaccacgaccgtgggcggcgcgacgccgacgacgggcaccctgagccccggcgtgggcaccgggttcaacggtacggcggtggggcggcggcggcctgngcccggtgggcaccatggacagcgcttcggccggcctgctgctccccggcgccttcttcctcgccgccgccatcctctcgctcctagccctgcactagctccccctagctagctcctccgttctcagtagttcttggtccaatagttgttccttctctgaaccacgtcaagaaaggaagaatgggatgtgaattggttgggagggttccagtttc

SEQ ID NO: 12082 - protein, 186 aa, Panicum virgatum
  misc_feature: Ceres CLONE 1760700
  misc_feature (22)..(106): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered alkaloid content
  misc_feature (150)..(150): Xaa is any aa, unknown, or other
METALALAAAVLLLSSTLAASEFCVCRSDQPTAALQKVIDFSCGNDADCSSILQGGGCYNPNNVAAHCSWAANSYYQNNKAKGATCDFGGAATISTADPSFSGCTFPSTASASGTAGTTTVGGATPTTGTLSPGVGTGFNGTAVGRRRPXPGGHHGQRFGRPAAPRRLLPRRRHPLAPSPALAPPS

SEQ ID NO: 12083 - DNA, 808 bp, Panicum virgatum
  misc_feature: Ceres CLONE 1760733
  misc_feature: Encodes the peptide sequence at SEQ ID NO. 12084
  misc_feature (727)..(727): n is a, c, t, g, unknown, or other
ccacacaagatagataagccttttgtagatcatactgaaccaagcagccacttcacactagagcacttgatcacacacgaaagttcaggtcagaagaagatgcaggccgccgccgctacagccgtcgggttctcggccgtggcgcccgtgaagggcaggctggcggcgaggagcacggtggtcgctcgtgtcccggccacaaggaggagcgtccgcgccgccgtggccgccgccatcgtcgcggcggagcctgccgaggtcgactacagctcgagcttctcggtgttccccatggaggcctgcgagctgctcggcggcgacgcctgcagcgcgcagatgtacccggaggctaagctcgccggcgcggcggaggcggccgcgggcaggagggaggaggaggtggagagggactacctgtcctacgacgagccgaagacggtgttccccggcgaggcgtgcgacaacctcggcggcgagttctgcgaggcgccgtaccaggccggcgtgtccagggagctggcgcacgcctgatccatcgtccatctatccgcaacatgaattgatctcgccgtcgagtcgatgggtgatgggtccatatgctgctatgcacgtacgtgttgcagatgatactcgagtggtggaggggaatctagcctacgtgtgctagaataacagcagccaagcaaggccaaggacgatgtcacgtgtgtaattgtgcatgacttgngtcgtgccagctgtgcctgtctgtagaaactaaagatgaaatactacgatccgtatcgctttacagtgtgatacgattact

SEQ ID NO: 12084 - protein, 143 aa, Panicum virgatum
  misc_feature: Ceres CLONE 1760733
  misc_feature (1)..(131): Pfam Name: Lir1 Pfam Description: Light regulated protein Lir1
MQAAAATAVGFSAVAPVKGRLAARSTVVARVPATRRSVRAAVAAAIVAAEPAEVDYSSSFSVFPMEACELLGGDACSAQMYPEAKLAGAAEAAAGRREEEVERDYLSYDEPKTVFPGEACDNLGGEFCEAPYQAGVSRELAHA

SEQ ID NO: 12085 - DNA, 734 bp, Panicum virgatum
  misc_feature: Ceres CLONE 1760757
  misc_feature: Encodes the peptide sequence at SEQ ID NO. 12086
aaccagcagcggccgcaaccagcgcggaaagcaaagagcacacacacacacaaaccaagcaaaggcgcgcgctcatcaggtggtggctatcgccgtggttgccgccgtcgtggtgctcgccgccgcggcgaccaccaccgaggccgccgtgacctgcgggcaggagaactcggccatccgcccctgcatcgcctactcccgcggcaccggctccagcccctcggcagcctgctgcagcggcgtgaggagcctcaactcggcggccaggagcaccgccgacaggcgcgccttatgcaactgcctcaagaccaccgccggcagggtgagtggcctcaaacttggaaacaccgcaagcataccgtccaagtgcggagtcagcatcccctacaccatcagcccaaacgtcgactgctccagggtgagctaaacgacgaccagtaccgtctctacctatctacttaattatcgtctatgatcgaattcgatgatgatgaataaaaatctctccgccgtcgcgtgcactgtcatcatgagctagctcagctcgcgtggtacgtcctcgctcagcatgtgatgagcgatcgagagacggagtcctctccgatccttgtgtccttttgcatgcttcgtacgttttgtgtctacatctacatagcagtgtgccctccatttccgtttgaaggagacccactctgtaccttgtccactataccttttaatacatcatacaccac

SEQ ID NO: 12086 - protein, 141 aa, Panicum virgatum
  misc_feature: Ceres CLONE 1760757
  misc_feature (52)..(137): Pfam Name: Tryp_alpha_amyl Pfam Description: Protease inhibitor/seed storage/LTP family
TSSGRNQRGKQRAHTHTNQAKARAHQVVAIAVVAAVVVLAAAATTTEAAVTCGQENSAIRPCIAYSRGTGSSPSAACCSGVRSLNSAARSTADRRALCNCLKTTAGRVSGLKLGNTASIPSKCGVSIPYTISPNVDCSRVS

SEQ ID NO: 12087 - DNA, 676 bp, Panicum virgatum
  misc_feature: Ceres CLONE 1760762
  misc_feature: Encodes the peptide sequence at SEQ ID NO. 12088
  misc_feature (148)..(148): n is a, c, t, g, unknown, or other
aacgccgctcgcgtcccctctcgccccctcgacgccccccccgccgcagccgcagccgccgcagcaagaccccaccccgccggcgccggagacaaaccccccgccgccgccagggggcgcacgcacagccgcgggaagggcaacccgncgccggcgccgccgaacaagaggacccccccgacgaggcccaagaccgccgccgccgaaggggaggagacgaccaccaaggccgcgaagaagggccagacgccggcgcagaccggcgccccccgccgcgaccagcacggcagcccgcaagacaagagcggcacaggaagcaagacccctttcttccacaaggcccaggggctcgcgccggagatcccggaggacctttacttcctgatcaagaaggcggtggcgattaggaagcatctggagaggaacaggaaggacaaggactccaaattcaggctcattcttgttgagagcaggatccaccgccttgcccgttactacaagcgcaccaagaagctcccgcccacctggaagtatgagtcgaccactgccagcactctggtggcttaagtgatctcttcagatggtgtggtctttagcttctttgagattgccttgttctagatatgaatttatgtaatgcttaatgagtctggagcgggttagatggacaaggaac

SEQ ID NO: 12088 - protein, 188 aa, Panicum virgatum
  misc_feature: Ceres CLONE 1760762
  misc_feature (102)..(188): Pfam Name: Ribosomal_S15 Pfam Description: Ribosomal protein S15
  misc_feature (39)..(97): Pfam Name: Ribosomal_S13_N Pfam Description: Ribosomal S13/S15 N-terminal domain
  misc_feature: Useful for making plants with modulated nitrogen use efficiency
  misc_feature (50)..(50): Xaa is any aa, unknown, or other
NAARVPSRPLDAPPAAAAAAAARPHPAGAGDKPPAAARGRTHSRGKGNPXPAPPNKRTPPTRPKTAAAEGEETTTKAAKKGQTPAQTGAPRRDQHGSPQDKSGTGSKTPFFHKAQGLAPEIPEDLYFLIKKAVAIRKHLERNRKDKDSKFRLILVESRIHRLARYYKRTKKLPPTWKYESTTASTLVA

SEQ ID NO: 12089 - DNA, 796 bp, Panicum virgatum
  misc_feature: Ceres CLONE 1760769
  misc_feature: Encodes the peptide sequence at SEQ ID NO. 12090
gagacctgccttcctagcctcttcaccctatgtgccccttctcctcctcttgctccgctgccgaaccagcacaagcttctgcagatgccgttgttccaggagcagggcgggaaccatggcgtgatgctctcttcgtaccaccaaggcggcctgtaccctctgcttcttcccgggatccccttctgcaactctagcgccggcgccggcgagaagcccaccggtttcgtcgtgctggacgccggcgaggcgggcacctcagcggcgaaagccgccggcgagatcgctagtaccgccgccgccgccacgttccacggctcgagttttttttggaagggctcggcggcggcggccggggagaaagcgcggatgaaggtgaggaggaagatgagggagccgaggttctgcttccagaccaggagcgacgtggatgtgctggacgacggctacaagtggcggaagtacggccagaaggttgtcaagaacagcctccatccaaggagctactaccggtgcacccacagcaactgccgcgtgaagaagcgagtggagcggctttcggaggactgccgcatggtgatcaccacctacgagggccgccacacccactccccctgcagcgacgacgacgccggcgaccacaccggcagctgcgccttcacctcgctctagagatcgacgacgcagcaatgctagctgtgtgtgagatatatgtggatgatgatgcaccaagatgttgctttgtggatcggatgcacatttttgtagaaagcaatcagcagtagtagctgccagggcc

SEQ ID NO: 12090 - protein, 222 aa, Panicum virgatum
  misc_feature: Ceres CLONE 1760769
  misc_feature (145)..(204): Pfam Name: WRKY Pfam Description: WRKY DNA -binding domain
  misc_feature: The sequence is a functional homolog of SEQ ID NO 1017 in the 10/412,699 US patent application
  misc_feature: The sequence is a functional homolog of SEQ ID NO 521 in the 10/374,780 US patent application
  misc_feature: The sequence is a functional homolog of SEQ ID NO 22 in the 10/374,780 US patent application
  misc_feature: The sequence is a functional homolog of SEQ ID NO 231 in the 11/479,226 US patent application
  misc_feature: The sequence is a functional homolog of SEQ ID NO 858 in the 10/225,066 US patent application
  misc_feature: The sequence is a functional homolog of SEQ ID NO 88 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: The sequence is a functional homolog of SEQ ID NO 86 in the 10/412,699 US patent application
ETCLPSLFTLCAPSPPLAPLPNQHKLLQMPLFQEQGGNHGVMLSSYHQGGLYPLLLPGIPFCNSSAGAGEKPTGFVVLDAGEAGTSAAKAAGEIASTAAAATFHGSSFFWKGSAAAAGEKARMKVRRKMREPRFCFQTRSDVDVLDDGYKWRKYGQKVVKNSLHPRSYYRCTHSNCRVKKRVERLSEDCRMVITTYEGRHTHSPCSDDDAGDHTGSCAFTSL

SEQ ID NO: 12091 - DNA, 788 bp, Panicum virgatum
  misc_feature: Ceres CLONE 1760783
  misc_feature: Encodes the peptide sequence at SEQ ID NO. 12092
actattcgcctttccgcacccgccgctcggtcgccttcgagttccaccagccaccaaacccgccggggagaagtcgagaggagcaagtagaagaggagatggcccgtacgaagcagaccgcccgcaagtccaccggagggaaagcccctcgcaagcagctcgccaccaaggcggcgaggaagtcggcgccgacgaccggcggcgtgaagaagccccaccgctacaggcccgggaccgtggcgctccgcgagatccgcaagtaccagaagagcacggagctcctgatccgcaagctccccttccagcgcctggtccgcgagatcgcgcaggacttcaagacggacctccggttccagagccacgccgtgctggcgctccaggaggccgccgaggcttacctcgtcgggctcttcgaggacaccaacctctgcgccatccacgccaagcgcgtcaccatcatgcccaaggacatccagctcgcccgccgcatccgcggcgagcgcgcgtaagccgcagccgccgctgccgtaccggtagtggagatgtaggaggtcaagatggaatcggcttgttgatctcctccgccgcgcttagtggatctggatttagctgtactagttgtcgttctcggtttggttagtgtaaaaacaggtttacaagtctattttgtgcttcgctgctattttggctctcgcttcgtgatgaagcgaccttgttaaagacttaattcgtgatgttacttgaagtaaaattacattgttcttaatcctcgatctatatttggtggt

SEQ ID NO: 12092 - protein, 136 aa, Panicum virgatum; identical to SEQ ID NO: 9871
  misc_feature: Ceres CLONE 1760783
  misc_feature (58)..(132): Pfam Name: Histone Pfam Description: Core histone H2A/H2B/H3/H4

SEQ ID NO: 12093 - DNA, 701 bp, Panicum virgatum
  misc_feature: Ceres CLONE 1760785
  misc_feature: Encodes the peptide sequence at SEQ ID NO. 12094
aactaagcgtaggcagaggataacatcagcgaggtgataagaggaaagcaaaacggagacggcagccgaagcgaccgtccgttgagctgcgcgcgaggcaaggccatcatccgccatgacgctctccctctccacctccttcctccccacccccgccgccgcgagggccagtgcccccaccctccgctccgtcgtcccgtcacaggggatgcgctgctcgatgcgcaagaaggggctgcacccgcagatctacaaggacgctaaggtgtactgcaacggcgagctggtgctggtgacggggggcaccaagccggagtacacggtggacgtgtggtccgggaaccacccctactacgtcggcgacacctcggcgctggtggtgatggacagccagatcgagaagttccgcaagaagtggggccacatcaaggagtactggcccgaggaccagtggagggagatgcaccccgacggggacccggagttcgagcccgagggggacaactgatcgacggcggctcccccattcatcgtcttcctcctcctcctcttcttcttcccgccctcacccggtgcgtggtcacggctcctgtttaccttgctctcttggttggaatttgagactttggcacgttcgcaatgctctccaggtgttcgattaatgttcgcaatgtaatggtaccagtatgtgatggtgtctt

SEQ ID NO: 12094 - protein, 99 aa, Panicum virgatum
  misc_feature: Ceres CLONE 1760785
  misc_feature (5)..(73): Pfam Name: Ribosomal_L31 Pfam Description: Ribosomal protein L31
MRCSMRKKGLHPQIYKDAKVYCNGELVLVTGGTKPEYTVDVWSGNHPYYVGDTSALVVMDSQIEKFRKKWGHIKEYWPEDQWREMHPDGDPEFEPEGDN

SEQ ID NO: 12095 - DNA, 646 bp, Panicum virgatum
  misc_feature: Ceres CLONE 1760796
  misc_feature: Encodes the peptide sequence at SEQ ID NO. 12096
atcctcgcagtcatccccgagaaagagccgccgccgcagccgcgcagagaaaacactatgggtcttcgccgccttcactcctcctcggggcgcaaccatggtggccacaaagaagaccaagaaggccacggacaatatcaacaacaagcttctgcttgtgatgaagagcggcaagaacactctcggctacaagagcgtcctcaggactcttaggaactccaagtcgaagcttgtgatcattgctaacaactgccctccccttcagaagtctgaaattgagtactatgaaatgctggctaacgtcactgatcaccatttccatggaaacaatgttgacctgggtacaatctgtggaaaatacttcagtgtctgctgtcttagcattattgatccagatgattcggatatcatcaagactacatcgggtgaccagtaaggaagagatgccagtaccccttggtattggtgttctgagcttttctagtgtagtagtggatctttcaggacttgtcctttcaccttatattgtgttaaacactatttgcctgcacgtaatctgactatttggaaacagtcttgcattgaaaattttgttactggaattgacactatcaatggagctgtggcctatggttgtcctcacttc

SEQ ID NO: 12096 - protein, 112 aa, Panicum virgatum
  misc_feature: Ceres CLONE 1760796
  misc_feature (12)..(106): Pfam Name: Ribosomal_L7Ae Pfam Description: Ribosomal protein L7Ae/L30e/S12e/Gadd45 family
MVATKKTKKATDNINNKLLLVMKSGKNTLGYKSVLRTLRNSKSKLVIIANNCPPLQKSEIEYYEMLANVTDHHFHGNNVDLGTICGKYFSVCCLSIIDPDDSDIIKTTSGDQ

SEQ ID NO: 12097 - DNA, 926 bp, Panicum virgatum
  misc_feature: Ceres CLONE 1760797
  misc_feature: Encodes the peptide sequence at SEQ ID NO. 12098
accccatcgcctcatcttctcttatccccgggcttcctcccgccgccgctgctcactcccgaggcccgagctccccagcggcaggttcccccatggcgtccaccaccctctcctccgccttcaccctcctctcccgcccctcctcttccccgtgcccctccgccccgctcccgaggtcctccctcgccgtgccccacggccgccggggccgccgctccgtagccgtcgcgtcgaccgccaccgagtcccccaagatcctcgagctcggggacgccatcgccgggctcacgctcgaggaggcccgcagcctcgtcgaccacctgcaggagcgcctcggcgtcaccgccgcggccttcgcgccggccgccgtcgtcgcggcgcccggggcgggcggcgcgggggccgcagaggaggcggcccccgtcgagaagacggagttcgacgtcgtcatcgatgaggtgcccagcagcgcgcgtatcgccaccatcaaggtcgtgcgcgcgctcaccagcctagcgctcaaggaggccaaggacctcatcgagggcctccccaagaagctcaaggagggcgtcagcaaggacgaggccgaggacgccaagaagcagctcgaggatgtcggcgccaaagtgtctgtcgtgtgacactaggtatactaggacttcctttttcttctccacttttgtaccctcattgccattgtcgttcacaaggaattgctgtttgatatgagatttgtgtatgcgtggattcgctagttcatatctgcatcacgtctctaccttgagttgacactgaatgtgacatgctctaaacttgtaatgtagattgtgagatgacactggcagttcatgatggtggacattgtgcttcccttgtatgagagtttgttcaggagcaatctttatagtggtttgcattgtgct

SEQ ID NO: 12098 - protein, 183 aa, Panicum virgatum
  misc_feature: Ceres CLONE 1760797
  misc_feature (115)..(183): Pfam Name: Ribosomal_L12 Pfam Description: Ribosomal protein L7/L12 C-terminal domain
MASTTLSSAFTLLSRPSSSPCPSAPLPRSSLAVPHGRRGRRSVAVASTATESPKILELGDAIAGLTLEEARSLVDHLQERLGVTAAAFAPAAVVAAPGAGGAGAAEEAAPVEKTEFDVVIDEVPSSARIATIKVVRALTSLALKEAKDLIEGLPKKLKEGVSKDEAEDAKKQLEDVGAKVSVV

SEQ ID NO: 12099 - DNA, 815 bp, Panicum virgatum
  misc_feature: Ceres CLONE 1760822
  misc_feature: Encodes the peptide sequence at SEQ ID NO. 12100
gaagcagaagaaaaggctcgattcgctgttccctgtccacagctcgccgcggaggccgtcgccgcccaagtgaggtccggagtgaagaggcttgcgatctcggctgcgcgcgcgaaagatggctgacccagagttggaagctatcaggcagaggaggatgcaagagctaatggcacagcgtggtggggcaaatcagcaaaatgcaggccaacaaaaagctcaagaagatgcaaaacaggaagctgaggaacgcagacagatgatgcttgctcagatattatcttctgaagccagagaaaggctctcccgcatagctttggtcaaacctgacaaagctagaggggtggaggatgttctgctgagagctgctcaaactggtgggatatctgaaaaggtctctgaagaaaggctcatctcacttttggagcaaattaacacccaaacaaccaagcaaaccaaagttacgattcagaggcgtcggagtgttcttgatgatgatgattagatgtgacctccaaggtttctacgattgtatgatgagctggtgatggattaagcggtgctgaattgtttacctaaaaacgatgatctgaagtgactatcaccaaccatcaaaacttgcctaaaattgatgatccgctgtgactatcatcagccatcaaaacctggtagattatttcatggatctgtggttgtatatgacccgaagtcttgttggtgtgcccattgaggacagtcgatactggctgtgtttatcccagaaacactttgctcttcctaagctatggcattaacgggtgtttgtggccactcct

SEQ ID NO: 12100 - protein, 128 aa, Panicum virgatum
  misc_feature: Ceres CLONE 1760822
  misc_feature (9)..(119): Pfam Name: dsDNA_bind Pfam Description: Double-stranded DNA-binding domain
MADPELEAIRQRRMQELMAQRGGANQQNAGQQKAQEDAKQEAEERRQMMLAQILSSEARERLSRIALVKPDKARGVEDVLLRAAQTGGISEKVSEERLISLLEQINTQTTKQTKVTIQRRRSVLDDDD

SEQ ID NO: 12101 - DNA, 853 bp, Panicum virgatum
  misc_feature: Ceres CLONE 1760832
  misc_feature: Encodes the peptide sequence at SEQ ID NO. 12102
aaatcgctccctgcctcctttcgccctccgcagccccttcctccctccctgcctgcccaatctctccggccaccccgacgccgttcgtccgctcgcgcccgcccgcccgccgctcggagagagaagaccggagaccatggcggaccagctcaccgacgaccagatcgccgagttcaaggaggccttcagcctcttcgacaaggacggcgacggttgcatcacaaccaaggagctgggaactgtcatgcgttccctgggtcagaacccaaccgaggctgagctccaggacatgatcaacgaggtcgacgctgatggcaatggcaccatcgacttccccgagttcctcaacctcatggcccgcaagatgaaggacaccgactctgaggaggagctcaaggaggcgttcagggtgttcgacaaggaccagaacggcttcatctccgctgcggagctccgccacgtgatgaccaacctcggcgagaagctgaccgacgaggaggtcgacgagatgatccgcgaggcggacgttgatggcgatggccagatcaactatgacgagttcgtcaaggtgatgatggccaagtgaggccgtgtttgatggtatactaccccccgccggaaggaggaaaccgtgcattgcgtattagtaaggcatgcggttcttgtttccttcatcttcccctgaagaaaaccgtactagctgtagctgctgaacatttgagtccctctgctgccacccctgcctgcccagtctgtcgtcgaacgaaactcttgcttcctgtgtgaatctgtacggctttgcttgttctggaccctgattgcggttgaatccagtttgtagttctatttgttc

SEQ ID NO: 12102 - protein, 149 aa, Panicum virgatum
  misc_feature: Ceres CLONE 1760832
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Useful for making plants with modulated salt sensitivity
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 12103 - DNA, 546 bp, Panicum virgatum
  misc_feature: Ceres CLONE 1760834
  misc_feature: Encodes the peptide sequence at SEQ ID NO. 12104
cgccacccctcctaccgttcatcaagtcctttcacatcccatcacacaccagctagctgccaaaatggcgtccacggtggcgagcctctctaccccggcgaccgccttcgcggccgcggacgtggacccgaggaggaaggccgccgaaggccgcgtctggttccccgtggcgcgccgcggcagcttcgcggtgaggtcgagcgggccggggacgccgccggggatctccgacaaggtgtcggagagcatcaagaaggcggaggagacgtgcgcggacgagaaggtctccggggagtgcgcggcggcgtgggacgaggtggaggatctcagcgccgcggcgagccacgcccgggacaagctcaaggacagcagcgacccgctcgagaactactgcaaggagaaccccgagaccgacgagtgccgcatctacgacaactagagcaagcctgctgtatatatcgatctgtgtatcagcaatcaaagacgttaaatttgttatagatatagataattaataaaggaataaagaatatttgaccgcgggtc

SEQ ID NO: 12104 - protein, 124 aa, Panicum virgatum
  misc_feature: Ceres CLONE 1760834
  misc_feature (54)..(124): Pfam Name: CP12 Pfam Description: CP12 domain
MASTVASLSTPATAFAAADVDPRRKAAEGRVWFPVARRGSFAVRSSGPGTPPGISDKVSESIKKAEETCADEKVSGECAAAWDEVEDLSAAASHARDKLKDSSDPLENYCKENPETDECRIYDN

SEQ ID NO: 12105 - DNA, 782 bp, Panicum virgatum
  misc_feature: Ceres CLONE 1760858
  misc_feature: Encodes the peptide sequence at SEQ ID NO. 12106
ggaagcagaagaaaaggctcgattggctgttcgctgtccacagctcgccgcggaggccgtcgccgcccaacggcccaagtgtggtccggagtgaagaggcttgcgatctccgccgcgcgcgcgaaagatggctgaccctgagttggaagctatcaggcagaggaggatgcaagagctaatggcacagcgtggtggggcaaatcagcaaaatgcaagccaacaaaaagcccaagaagatgcaaaacaggaagctgaggaacgcagacagatgatgcttgctcagatattatcttatgaagccagagaaaggctctcccgcatagctttggtcaaacctgacaaagctagaggagtggaggatgttctgctaagagctgctcaaactggtggaatatctgaaaaggtatctgaagaaaggctcatatcacttctggagcaaattaacacccagacaacgaagcaaaccaaagttacgattcagaggcgtcggagtgtccttgatgacgatgattagatgtgacctccaagctttctatgattgtatggtgagctggtgatggattaggagaattgctgaattgtttacctaaaaacgacgatctgaagtgactatcatcagccatcaaaacttgcctaaaaatgatgatccgttgtgactatcatcagccatcaaaacttggtagattatttcatggatctgttgttgtatatgatccgacgtcttattggtgtgcccagaaacatttattcctaagctatggcattaatgggtgtttgtgccc

SEQ ID NO: 12106 - protein, 128 aa, Panicum virgatum
  misc_feature: Ceres CLONE 1760858
  misc_feature (9)..(119): Pfam Name: dsDNA_bind Pfam Description: Double-stranded DNA-binding domain
MADPELEAIRQRRMQELMAQRGGANQQNASQQKAQEDAKQEAEERRQMMLAQILSYEARERLSRIALVKPDKARGVEDVLLRAAQTGGISEKVSEERLISLLEQINTQTTKQTKVTIQRRRSVLDDDD

SEQ ID NO: 12107 - DNA, 677 bp, Panicum virgatum
  misc_feature: Ceres CLONE 1760865
  misc_feature: Encodes the peptide sequence at SEQ ID NO. 12108
gacaggcaagcagacgagcaaccgcaccgggagggcggagcgggcgagcgagatgggttccttcttctcgaccatgttcacgccgccgcccgcggacgaccccaactccgccgtcgtcgccgcccactccaaggccgcctacgaccagcactgggaggccgccaagagcagcggcaagctgatggtgatcgacttctcggcgtcctggtgcgggccctgccgcttcatcgagccggccttcaaggagatggcctcccgctacaccgacgtcgtcttcgtcaagatcgacgtcgacgagctcgcggatgtggcaaggacctggaaggttgaggcgatgcctacattcgtactagccaagggtgggaaggaggtgagccgtgtggttggggcgaagaaagatgaactcgagaggaagatcggcacgttcagatcatcttagtcatactaacttaacaatgcatgcgatcccatcatagtaccggtgtctggggggtcctgtggtttgcccaggttgaaaacttgaaatgccatgttgttctcttctcttagtggtgcagaatttatgtgaaccggtcggtgacaaacgttgcctgggttaataagtttctgagacttggatgtgaatgtgtcagtctgcctgcccggtttactcgaaatgaatcatatgagtttgctgc

SEQ ID NO: 12108 - protein, 128 aa, Panicum virgatum
  misc_feature: Ceres CLONE 1760865
  misc_feature (21)..(122): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature: Useful for making plants with modulated nitrogen use efficiency
MGSFFSTMFTPPPADDPNSAVVAAHSKAAYDQHWEAAKSSGKLMVIDFSASWCGPCRFIEPAFKEMASRYTDVVFVKIDVDELADVARTWKVEAMPTFVLAKGGKEVSRVVGAKKDELERKIGTFRSS

SEQ ID NO: 12109 - DNA, 737 bp, Panicum virgatum
  misc_feature: Ceres CLONE 1760872
  misc_feature: Encodes the peptide sequence at SEQ ID NO. 12110
ctcgcactccacggccgcacgcaggcgccgccgttcgccgtcgccggcgacgagctgcagcccgccggcaaggaggggcgccggctgcaatctctggggactcagcactaaacactctactgtcgaacaatggaagccaagttcttccggtttctgaagctcgtgggggtcggtttcaaagcgaggtcagagagccaaggccgtgagctgttcctgaaactgggctacagccacgaggtgcagttcactgccccgcccgccgtccgtgtcttctgcttcaagcccaacataatctgctgcaccggcattgacaagcacagggttcaccagtttgctggtgccgtccggagctgcaaacccccagaggtgtacaaggggaagggcgtactgtacatcgacgaggtcatcaagctgaagccagggaagaagcaaaagaagtgacagcgggatggtgttgtaacattatacttggcttttagcctcttgagatctgttctgctgcgcatttgtagcgatgcgtgtttgatgcgatttcttgtgctaggcagatcagcattgtcccagatttgcctctgtgtagtgtcaggcaatgcaatgtacgtgaggcgtgtaatgatgttgtatgaccatgaataggaataaagctgccagttaaaattttgttgatggcaagctggaaccttactgagtttggatttcagtaatattggaatgtttccttccaaactacccgcaaa

SEQ ID NO: 12110 - protein, 103 aa, Panicum virgatum
  misc_feature: Ceres CLONE 1760872
  misc_feature (12)..(89): Pfam Name: Ribosomal_L6 Pfam Description: Ribosomal protein L6
MEAKFFRFLKLVGVGFKARSESQGRELFLKLGYSHEVQFTAPPAVRVFCFKPNIICCTGIDKHRVHQFAGAVRSCKPPEVYKGKGVLYIDEVIKLKPGKKQKK

SEQ ID NO: 12111 - DNA, 735 bp, Panicum virgatum
  misc_feature: Ceres CLONE 1760888
  misc_feature: Encodes the peptide sequence at SEQ ID NO. 12112
ctctcgtctcggaaaaaccctagccgccacacctcacgacccacccgagcaccagcggaggggcaggggagatggcgcgcggtgtggtggcggcgaaggccggcgcggccgggggcaagaagaagggctcggtcaccttcacgatcgactgcaccaagcccgtggaggacaagatcatggagatcgcctcgctcgagaagttcctgcaggagcgcatcaaggtcgccggcggcaaggccgggagcctcggcgactccgtcaccgtctcccgcgagaagaccaaggtctctgtcacctccgacgggcacttctccaagaggtacctgaagtacttgaccaagaagtacttgaagaagcacaacgtgcgggattggctacgcgtgattgcagccaacaaggaccgcactgtctatgagctccggtacttcaacatcgccgagaatgagggcgaggaggaagattagagtgcattcaacttatatctcagttttgaacctgttgaaatttgatacttgtacccgtagtcatttgcacctatcttctcatgttatgctgtggtgaattttggatggttaatttgaagaatccttacatttggtcgcctcaacttctgagtgcctactcttggtccaagcaagtttaagttgtcaacggagaaaagtagtgtgtagggtttctctcaacttctcgcttgtactctgattgacgcctacagtttatattgctttggtgtgc

SEQ ID NO: 12112 - protein, 130 aa, Panicum virgatum
  misc_feature: Ceres CLONE 1760888
  misc_feature (16)..(130): Pfam Name: Ribosomal_L22e Pfam Description: Ribosomal L22e protein family
MARGVVAAKAGAAGGKKKGSVTFTIDCTKPVEDKIMEIASLEKFLQERIKVAGGKAGSLGDSVTVSREKTKVSVTSDGHFSKRYLKYLTKKYLKKHNVRDWLRVIAANKDRTVYELRYFNIAENEGEEED

SEQ ID NO: 12113 - DNA, 762 bp, Panicum virgatum
  misc_feature: Ceres CLONE 1760900
  misc_feature: Encodes the peptide sequence at SEQ ID NO. 12114
gagccaaacccacgcctcccctttccccgctcgcttccgccatggcggccttcccctccgcctccccgtcgccggcgatctccgcctcgacctgttgcatggcgtccctccgggcggccctacccacgctccgaccgtccccggcgggcaggctccggtcgtccttctcgcccgcggcggcgtcggtcggctgcctcgggtcattctccggcctcgcgctcgtctcgaatcttctatcccttggtgccgagaactcaagctttgagcatcggttgttcagtgttgatgctcgtggaaggatagttgcaatgcggcatgggagacgtgttccaaaacttaacaggcctccagatcagaggaaagcacttctgcgtggtcttacaacacagttgctgaagcatggaaggataaagactacaaagccgagggcaaaggcaatgagaaagtatgttgagaagatgatcacgttggcaaaggatggatctcttcacaagaggaggcaggctctggcattcatttatgagaagcatatcgtccatgcattgtttgctgaggttgcagacaggtatggagacagagagggtggttacacaaggatcatcccaacatttccaagacggggagacaatgcaccaatggcgtacattgaacttgtctaggatcttcctttagttgcagtgatttcacgggtgatttgcaggtagagtgctgatgtctgcaaattgccctttgggagcctttttttttctgatgctcttttgt

SEQ ID NO: 12114 - protein, 205 aa, Panicum virgatum
  misc_feature: Ceres CLONE 1760900
  misc_feature (109)..(205): Pfam Name: Ribosomal_L17 Pfam Description: Ribosomal protein L17
MAAFPSASPSPAISASTCCMASLRAALPTLRPSPAGRLRSSFSPAAASVGCLGSFSGLALVSNLLSLGAENSSFEHRLFSVDARGRIVAMRHGRRVPKLNRPPDQRKALLRGLTTQLLKHGRIKTTKPRAKAMRKYVEKMITLAKDGSLHKRRQALAFIYEKHIVHALFAEVADRYGDREGGYTRIIPTFPRRGDNAPMAYIELV

SEQ ID NO: 12115 - DNA, 731 bp, Panicum virgatum
  misc_feature: Ceres CLONE 1760904
  misc_feature: Encodes the peptide sequence at SEQ ID NO. 12116
acacgcatcggatccttagcacgacccgccggattaagtttgtgaacgtacgtacccaccggaacactagtacaccggtcatacgcagcaccaaccgccatggcctccctcgccgccgtctccgtgcagccggtcgccgtgaagggcctcgccggcagctccatctccggcaggaggctcgccgccgtcaggccgtcgcgccgcgccggggccggcgcctgcgcctgccgctccgcccgcaggccccgcggcgccgccgtggtggccaagtacggcgacaagagcgtctacttcgacctcgacgacatcggcaacaccaccgggcagtgggacctctacggctccgacgctccctcgccctacaacccgctccagagcaagttcttcgagacgttcgcggggccgttcaccaagaggggcctgctgctcaagttcctgctggtgggcggcgggtcgctgctagcctacgtcagcgcgtcggcgtcgccggacctgctgccgatcaagaaggggccgcagcagccgccgcagccggggccgcgcggcaagatctaagttcagttgttccttctcctcatccatctgtctctactagctgcttgcttgtaccgccgctagctccggacgccatggatcgtccttgcctgtcgttgtgctgctgatattcgatcgcgctgcctgtttatcaatgttcataatgttgtattcatatatactctggcatacaatta

SEQ ID NO: 12116 - protein, 151 aa, Panicum virgatum
  misc_feature: Ceres CLONE 1760904
  misc_feature (5)..(151): Pfam Name: PSI_PsaH Pfam Description: Photosystem I reaction centre subunit VI
MASLAAVSVQPVAVKGLAGSSISGRRLAAVRPSRRAGAGACACRSARRPRGAAVVAKYGDKSVYFDLDDIGNTTGQWDLYGSDAPSPYNPLQSKFFETFAGPFTKRGLLLKFLLVGGGSLLAYVSASASPDLLPIKKGPQQPPQPGPRGKI

SEQ ID NO: 12117 - DNA, 744 bp, Panicum virgatum
  misc_feature: Ceres CLONE 1760910
  misc_feature: Encodes the peptide sequence at SEQ ID NO. 12118
gaacacattcatggaaccgccttttgctccagtcgcggcggaggccggcgccggcgccggcgacgcttacaccatccggccgctcgagctctcggacctctccaagggcttctgcgagcttctcgcacaggtctccccttctccgccgctctcagaggaagccttccgcgcgcgcttcgccgaactcgcggcgctgggcgccgaccacctggtcctcgtcgcggaggaagccgcgacgggccgcctcgccgcagcgggggcgattctggtggagcgcaagttcattcggcgctgcggcctcgtgggccacctggaggacgtggtggtggacgctgccgcgagggggcggggtctcggggagcgcctcgtgcgccgcctcgtggagcacgcgagagggagggggtgctacaaggtcatattgaactgcacggcggagctgaaggggttctacgccaagtgcggcttcgaggagaggaatgtccagatggggctctacttctgatccagctcagctaccttcacctacgtgatgcttgggtactccggagcagaagacgcgacgagtagtagcagggcatgcgtgtgacgcttccaagttggtgtagatgctcagacgcttccggggaggacagatggtaggagcgggacttcagaggagtggttttttctttttgtcgttcttttttttttaagaacatatcgggtgtaaaccacaatttcgtgaaaacccatacaaaccatgac

SEQ ID NO: 12118 - protein, 163 aa, Panicum virgatum
  misc_feature: Ceres CLONE 1760910
  misc_feature (71)..(153): Pfam Name: Acetyltransf_1 Pfam Description: Acetyltransferase (GNAT) family
  misc_feature: SWISSPROT Homolog: EC 2.3.1.4 Glucosamine 6-phosphate N-acetyltransferase
MEPPFAPVAAEAGAGAGDAYTIRPLELSDLSKGFCELLAQVSPSPPLSEEAFRARFAELAALGADHLVLVAEEAATGRLAAAGAILVERKFIRRCGLVGHLEDVVVDAAARGRGLGERLVRRLVEHARGRGCYKVILNCTAELKGFYAKCGFEERNVQMGLYF

SEQ ID NO: 12119 - DNA, 888 bp, Panicum virgatum
  misc_feature: Ceres CLONE 1760917
  misc_feature: Encodes the peptide sequence at SEQ ID NO. 12120
aatctcgattccatagcttccgccgctagggttttgacctgcagcttcctcgccactccaccacttcaacccctgttcgatcccggccatcggatcgatggcgtcggacgcagcggcggggaaggacaagatgctgacgctgatcagctgcgacaaggagaacttcgaggtggaggagtcggtggcgagggagtcgcggaccatcctgcacatgatcgaggatggctgcaccgacaacggcatcccggtccccaacgtcaactccaagatcctcgccaaggtcatcgagtactgcaagaagcacgtcgaggcgcgccgcggcgccgacgcggacgccgttgagccaactgccgcgaccaacaaggcctccgacgacgagctcaagaccttcgatgctgacttcgtcaaggtggaacaggccaccctcttcgacctcatcctggctgcaaactacctggacatcaaggggctcctggatctgacctgccagaccgttgcggatatgatcaaggggaagactccggaggagatccgcaagaccttcaacatcaagaacgacttcacccctgaggaagaggaggaagtgaggagggagaaccagtgggccttcgaatgaggaggctgaggctctaacgacagcaatctcctataaccaggccagcggggaacgtgttatgccaggaacttaggatgactcggatgttacgagtttggagcagctatactgtctcgggtttaacaaatcgcttagaaggtgtatgtaggttcggttggttgtgagcagactattttgctgactcccgttatttttggtgccagtgccactggtgcatgctctcttggatcgttaagaggctggttggttatcaagcattgctggttattcag

SEQ ID NO: 12120 - protein, 172 aa, Panicum virgatum
  misc_feature: Ceres CLONE 1760917
  misc_feature (95)..(172): Pfam Name: Skp1 Pfam Description: Skp1 family, dimerisation domain
  misc_feature (11)..(71): Pfam Name: Skp1_POZ Pfam Description: Skp1 family, tetramerisation domain
MASDAAAGKDKMLTLISCDKENFEVEESVARESRTILHMIEDGCTDNGIPVPNVNSKILAKVIEYCKKHVEARRGADADAVEPTAATNKASDDELKTFDADFVKVEQATLFDLILAANYLDIKGLLDLTCQTVADMIKGKTPEEIRKTFNIKNDFTPEEEEEVRRENQWAFE

SEQ ID NO: 12121 - DNA, 956 bp, Panicum virgatum
  misc_feature: Ceres CLONE 1760918
  misc_feature: Encodes the peptide sequence at SEQ ID NO. 12122
acaaagcttcctctttccgccgccgcccctcaccgcgctgcagagaaccctctcacctcgctcgcggtcgcctcccagatctccccatggcgtcggagaagaaacagtcgaacccgatgcgggagatcaaggttcagaagctcgtgctcaacatctccgtcggcgagagcggtgatcgcctcacccgcgccgccaaggtactcgagcagctgagtgggcagtcaccggtgttctccaaggcgaggtacactgtgaggtcgttcggcatcaggcgtaatgagaagattgcgtgctatgtgacagtgaggggagagaaggcgatgcagctgctggagagtggcctgaaagtcaaggagtatgagctgttgaggaggaacttcagtgagactggctgctttgggtttggtatccaggaacacattgatcttggcatcaagtatgacccatctaccggtatctacggcatggacttctacgtcgtccttgagcgtgccgggtaccgtgttgcccgccgccgcaggtgcaagtcccgtgttggtatccagcacagggtcaccaaggaggacgccatgaagtggttccaggtcaagtacgagggtgtgatcctcaacaaggcccaagccaacacctcctaagtttcacaagaccttagccccctctttagagctcgagtcaattaagtttatccggtgcttggatttgtactagaagaaaccaaatgcattgtcagttttgcctgtactggagttggatcctttttagggtgccccgtattttcatcttattttgttgttggataagcccaaatagcgtttgtttgctacaagaatggtgctaagatagacctgaacttaattgtgctaagataattgagacgttcaaccgaaactgaacctgaactcagttgtgctaaatagaacatgaagcatgagaattatgcagctcatttcttgtag

SEQ ID NO: 12122 - protein, 182 aa, Panicum virgatum
  misc_feature: Ceres CLONE 1760918
  misc_feature (66)..(165): Pfam Name: Ribosomal_L5_C Pfam Description: ribosomal L5P family C-terminus
  misc_feature (9)..(62): Pfam Name: Ribosomal_L5 Pfam Description: Ribosomal protein L5
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQANTS

SEQ ID NO: 12123 - DNA, 629 bp, Panicum virgatum
  misc_feature: Ceres CLONE 1760965
  misc_feature: Encodes the peptide sequence at SEQ ID NO. 12124
aacgagcaccccaagttccccgacggcggcctcatgacgcagcacctggagtcgctgccgatcggctcccacatcgacgtcaaggggcctctgggccacgtcgagtacaccggccgcggcggcttcgtcatcaacggcaagccgcgccgcgcgaggcgcctcgccatgatcgccggcgggagcgggatcacgcccatgtaccaggtcatccaggcggtgctgcgcgaccagccggaggacgagacggagatgcacctcgtctacgccaaccggacggaggacgacatcctcctccgcgacgagctcgaccggtgggcggccgactacccggacaggctcaaggtctggtacgtggtcgatcaggtgaagcgcccggaggaggggtggaagtacagcgtcgggttcgtcacggaggccgtcctgcgggagcacgtgccggagggcggcgacgacacgctggccctcgcctgcgggccgccgccgatgatcaagttcgccatctcgccgaacctggagaagatgaagtacgacatggccaattctttcatcgtcttctaagacatcagtacgtaccacacaccagatgtatatgtatataacaaactagtcgaattgccagcgtaaattgc

SEQ ID NO: 12124 - protein, 185 aa, Panicum virgatum
  misc_feature: Ceres CLONE 1760965
  misc_feature (55)..(168): Pfam Name: NAD_binding_1 Pfam Description: Oxidoreductase NAD-binding domain
  misc_feature: SWISSPROT Homolog: EC 1.7.1.1 Nitrate reductase (NADH)
NEHPKFPDGGLMTQHLESLPIGSHIDVKGPLGHVEYTGRGGFVINGKPRRARRLAMIAGGSGITPMYQVIQAVLRDQPEDETEMHLVYANRTEDDILLRDELDRWAADYPDRLKVWYVVDQVKRPEEGWKYSVGFVTEAVLREHVPEGGDDTLALACGPPPMIKFAISPNLEKMKYDMANSFIVF

SEQ ID NO: 12125 - DNA, 874 bp, Panicum virgatum
  misc_feature: Ceres CLONE 1760966
  misc_feature: Encodes the peptide sequence at SEQ ID NO. 12126
agcacatcccgcggccgcctccctcagatcctccgtcctcgctcggtcaagtgccgccgctaccccccctccgtcactcttctcccgtggccaccacccaccgcatccgccgctccccgcccctctccaccggccggtttggtttgtctctgaaaggcggcggcggcggcagcggagatgtccgaaaagaagcgcggcggcggcggcacccgcaaggacgaggtggtgacccgcgagtacaccattaacctccacaagcgcctccacggatgcaccttcaagaagaaagcaccaaatgccatcaaggagatcaggaagtttgcacagaaggctatgggaaccactgatgtccgaattgatgtgaagctcaacaagcacatctggagcagtggtatccggagcgttccaaggcgagttcgcgtcagaatcgcccggaagaggaatgatgaggaagatgccaaggaggagctctactctctggtcacagttgctgagatccctgcagagggtctcaaaggtttgggtactaaggttgttgaggatgaggattaagccctcccatggattgaatctgctagcacttagtgcatatcatgagagcaagtttgagaatgttaccttagcttattgttatctaccgttgatgacttatgtaatagaagattcaaaactttgctcatttctttcaagtgcttgaaattttgactactttgccaaatcgtggtatctacgtggcgtgcaatcaacttatacatggggtgtgataaccttgtcccatttttctctctcatcagtgaaacgtgttgtatgtatgacaaatgagttctagttgctttggaaacatccaatggatgcgtttctattgattgtgttc

SEQ ID NO: 12126 - protein, 124 aa, Panicum virgatum
  misc_feature: Ceres CLONE 1760966
  misc_feature (12)..(106): Pfam Name: Ribosomal_L31e Pfam Description: Ribosomal protein L31e
MSEKKRGGGGTRKDEVVTREYTINLHKRLHGCTFKKKAPNAIKEIRKFAQKAMGTTDVRIDVKLNKHIWSSGIRSVPRRVRVRIARKRNDEEDAKEELYSLVTVAEIPAEGLKGLGTKVVEDED

SEQ ID NO: 12127 - DNA, 690 bp, Panicum virgatum
  misc_feature: Ceres CLONE 1760978
  misc_feature: Encodes the peptide sequence at SEQ ID NO. 12128
aaccacagcaaccagctgaaagaaaaatctcacgcatccctgcaagatcgcaatggcggcgccggggcggccgctgacggtggactttgaggcgctgagctacatcagcagcctggtggaggcgttccaggcgttcgactccgacaacgacgggctcgtgacggcgcccgagctccgcggcctgctggcgtcgctgagcctggacaagtcggaggccgaggcgcgcgacatgctggcgcgcaccgacggcgaccgcgacgggcggctcagcgtcgaggagctcctggacgtgatgaacgccggggagctcgggctgggcgcgctcgacgacctgctgcagtcggcgctgcccgcgctcgaggcagccgggggggcgctggtcggcgcggacgagctcgccagggcgctcggcgtcataggcgccgccagcgccgaggactgcgcggccatcgtcgagtgcctggacggcgacggcgacggcgccatcaccatcgaggagttcaggctcatggccgacctgctctagatcgagcctaggctgccgcacctacgcttggaacggtgtcttatttgctctgagctcgtcgtggtgttcagctatgtactgagcttgacaataatcaagtgcgtgttcatctgtgatcctccgtggactgagcaacgtgcgagagaacgcgcgtgtttacggcc

SEQ ID NO: 12128 - protein, 157 aa, Panicum virgatum
  misc_feature: Ceres CLONE 1760978
  misc_feature (20)..(48): Pfam Name: efhand Pfam Description: EF hand
  misc_feature (56)..(84): Pfam Name: efhand Pfam Description: EF hand
  misc_feature: SWISSPROT Homolog: EC 2.7.11.1 Non-specific serine/threonine protein kinase
MAAPGRPLTVDFEALSYISSLVEAFQAFDSDNDGLVTAPELRGLLASLSLDKSEAEARDMLARTDGDRDGRLSVEELLDVMNAGELGLGALDDLLQSALPALEAAGGALVGADELARALGVIGAASAEDCAAIVECLDGDGDGAITIEEFRLMADLL

SEQ ID NO: 12129 - DNA, 114 bp, Panicum virgatum
  misc_feature: Ceres CLONE 1760999
  misc_feature: Encodes the peptide sequence at SEQ ID NO. 12130
cgccgcggcggcggcggccccgcccgggccaccgacaacgcgcccccccagcaggcccccgcccccgacggcgacgcccccgaccccaaggacaccaccgaccgagagacgggg

SEQ ID NO: 12130 - protein, 37 aa, Panicum virgatum
  misc_feature: Ceres CLONE 1760999
  misc_feature: Useful for making plants with altered cell wall content and/or composition
  misc_feature: Useful for making plants with altered carbohydrate content
  misc_feature: Useful for making plants with modulated oxidative stress sensitivity
  misc_feature: The sequence is a functional homolog of SEQ ID NO 1084 in the 10/225,066 US patent application
  misc_feature: The sequence is a functional homolog of SEQ ID NO 2530 in the 10/374,780 US patent application
  misc_feature: Useful for making plants with modulated salt sensitivity 220>
  misc_feature: Useful for making plants with modulated nitrogen use efficiency
  misc_feature: Useful for making plants with modulated flowering time
  misc_feature: The sequence is a functional homolog of SEQ ID NO 1842 in the 10/374,780 US patent application
AAAAAAPPGPPTTRPPSRPPPPTATPPTPRTPPTERR

SEQ ID NO: 12131 - DNA, 523 bp, Panicum virgatum
  misc_feature: Ceres CLONE 1761014
  misc_feature: Encodes the peptide sequence at SEQ ID NO. 12132
atggcggcgaacggcacggcggcgaggaaggagacgaataataaggtggtgcactaccgggagtgccagcgcaaccacgcggcggccatcggcgggtacgccgtggacgggtgccgggagttcatggcgtccggcgcggagggcacggccgcggcgctcatgtgcgccgcctgcgggtgccaccgcagcttccacaggcgcgaggtggagcccgacttggactgctcctccaccacctccgcctgaattgaatctcgagatggatcgatcatgggtggcaaaggcattgaaatgattggtagctgcattatattcaaccgtatatggaatggacatatttattttcttcttctttttccccttatggccttggatttgcagtagtgaaacttatgtatgtgttgatggttcgtgtatggtgcttgtaactgacgttatgtatatagtcaaagtgctttacttgctgtgtgtgtgtatatatatatatatatatatatatatatatatatatatatatatatca

SEQ ID NO: 12132 - protein, 81 aa, Panicum virgatum
  misc_feature: Ceres CLONE 1761014
  misc_feature (14)..(73): Pfam Name: ZF-HD_dimer Pfam Description: ZF-HD protein dimerisation region
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
  misc_feature: The sequence is a functional homolog of SEQ ID NO 112 in the 10/714,887 US patent application
  misc_feature: The sequence is a functional homolog of SEQ ID NO 112 in the 11/435,388 US patent application
  misc_feature: The sequence is a functional homolog of SEQ ID NO 14 in the 10/714,887 US patent application
  misc_feature: The sequence is a functional homolog of SEQ ID NO 14 in the 11/435,388 US patent application
  misc_feature: The sequence is a functional homolog of SEQ ID NO 626 in the 10/666,642 US patent application
  misc_feature: The sequence is a functional homolog of SEQ ID NO 60 in the 10/714,887 US patent application
  misc_feature: The sequence is a functional homolog of SEQ ID NO 60 in the 11/435,388 US patent application
  misc_feature: The sequence is a functional homolog of SEQ ID NO 54 in the 10/714,887 US patent application
  misc_feature: The sequence is a functional homolog of SEQ ID NO 54 in the 11/435,388 US patent application
  misc_feature: The sequence is a functional homolog of SEQ ID NO 62 in the 10/714,887 US patent application
  misc_feature: The sequence is a functional homolog of SEQ ID NO 62 in the 11/435,388 US patent application
  misc_feature: The sequence is a functional homolog of SEQ ID NO 624 in the 10/666,642 US patent application
  misc_feature: The sequence is a functional homolog of SEQ ID NO 52 in the 10/714,887 US patent application
  misc_feature: The sequence is a functional homolog of SEQ ID NO 52 in the 11/435,388 US patent application
  misc_feature: The sequence is a functional homolog of SEQ ID NO 620 in the 10/666,642 US patent application
  misc_feature: The sequence is a functional homolog of SEQ ID NO 1554 in the 10/666,642 US patent application
  misc_feature: The sequence is a functional homolog of SEQ ID NO 44 in the 10/714,887 US patent application
  misc_feature: The sequence is a functional homolog of SEQ ID NO 44 in the 11/435,388 US patent application
  misc_feature: The sequence is a functional homolog of SEQ ID NO 102 in the 10/714,887 US patent application
  misc_feature: The sequence is a functional homolog of SEQ ID NO 102 in the 11/435,388 US patent application
  misc_feature: The sequence is a functional homolog of SEQ ID NO 118 in the 10/714,887 US patent application
  misc_feature: The sequence is a functional homolog of SEQ ID NO 118 in the 11/435,388 US patent application
  misc_feature: The sequence is a functional homolog of SEQ ID NO 122 in the 10/714,887 US patent application
  misc_feature: The sequence is a functional homolog of SEQ ID NO 122 in the 11/435,388 US patent application
  misc_feature: The sequence is a functional homolog of SEQ ID NO 126 in the 10/714,887 US patent application
  misc_feature: The sequence is a functional homolog of SEQ ID NO 126 in the 11/435,388 US patent application
  misc_feature: The sequence is a functional homolog of SEQ ID NO 120 in the 10/714,887 US patent application
  misc_feature: The sequence is a functional homolog of SEQ ID NO 120 in the 11/435,388 US patent application
  misc_feature: The sequence is a functional homolog of SEQ ID NO 46 in the 10/714,887 US patent application
  misc_feature: The sequence is a functional homolog of SEQ ID NO 46 in the 11/435,388 US patent application
  misc_feature: The sequence is a functional homolog of SEQ ID NO 616 in the 10/666,642 US patent application
  misc_feature: The sequence is a functional homolog of SEQ ID NO 50 in the 10/714,887 US patent application
  misc_feature: The sequence is a functional homolog of SEQ ID NO 50 in the 11/435,388 US patent application
  misc_feature: The sequence is a functional homolog of SEQ ID NO 618 in the 10/666,642 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
MAANGTAARKETNNKVVHYRECQRNHAAAIGGYAVDGCREFMASGAEGTAAALMCAACGCHRSFHRREVEPDLDCSSTTSA

SEQ ID NO: 12133 - DNA, 675 bp, Panicum virgatum
  misc_feature: Ceres CLONE 1761017
  misc_feature: Encodes the peptide sequence at SEQ ID NO. 12134
attcacaactcacatctcgaccagtcggagttcatccccgagcagacctcgcaagtcgcacatcttcttctcctcctgctccagatctcaggcgaaagcttgtccaccatccaccgccaccgcatcccaatggctcgcttcgccgtcgtcgccgccatcgtcgcgctcctcgccgtcaccgcagccgcgcaggccccggccgcgacgcccaccccggcgcccaggatggccccgctgccgcctcctccggcgcggtccccggccaccgccccggccccggccccggccgcgaagccgcccaccgcctcggcgccgtccccgctgtcctctcccccggccccgcccgccgagggcccctccgcgatgaccccgaccacctccgtctccgccgcccccgccggcgcccccaccgccacgcccaccgggaacggcgccgcctcctccgccgtcagcttcgtcgccgtcgccgccgcggtcgccgccgccgtcgtgttctagatggggacgcgttgcgacgatgggatctcgagctgtttatactgccatatgctttttttttgcgatgcttttttactgtattagatacatttgaggggggattcacccagtgctgctagttacacatcatgcatgattcatgatgatatgattattaatggaattctttcatttgtt

SEQ ID NO: 12134 - protein, 122 aa, Panicum virgatum; identical to SEQ ID NO: 10297
  misc_feature: Ceres CLONE 1761017
  misc_feature: Useful for making plants with altered carbohydrate content

SEQ ID NO: 12135 - DNA, 673 bp, Panicum virgatum
  misc_feature: Ceres CLONE 1761020
  misc_feature: Encodes the peptide sequence at SEQ ID NO. 12136
agggtttcctcccaccactccccacccacttccaaccccagcacccggcggcggcggcgagcggcggcgatgacgacgagcctgaagaagaaccgtaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaagttctactgcccgtcggtcaacgtcgagcggctctggtcgatggtgcccgccgacaaggccgcggaggcggcgggcggcgccgacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttgcatcctgtatcgtctatctgttctaagagaacaccttaatttgttgtggatcctgagttttgagaccccggttttgtgcacttggtaacgaatgcccgttcatttactgaaatgtttccgatttatatcattgcctgagatctgttgctgc

SEQ ID NO: 12136 - protein, 147 aa, Panicum virgatum
  misc_feature: Ceres CLONE 1761020
  misc_feature (109)..(141): Pfam Name: L15 Pfam Description: Ribosomal protein L15
MTTSLKKNRKKRGHVSAGHGRIGKHRKHPGGRGNAGGMHHHRILFDKYHPGYFGKVGMRYFHKLRNKFYCPSVNVERLWSMVPADKAAEAAGGADKAPLVDVTQFGYFKVLGKGMLPPKPIVVKAKLISKVAEKKIKAAGGAVVLTA

SEQ ID NO: 12137 - DNA, 245 bp, Panicum virgatum
  misc_feature: Ceres CLONE 1761025
  misc_feature: Encodes the peptide sequence at SEQ ID NO. 12138
cgagggcccgcggcgaccgcaagcgccccaggggccgggacgcggcggagacccgggaccccaccagcaaggcccgcgggaggcccggcaccaacgacaccgccgaggccgccgcacgcgccaacgacgccgcttttttccacagccgcgggcccaaggccaagaccaacccccccgccgcgcccgccgcggacgcgcacccgccgccgcccaagaagcgggccgccagccccagcagcagcacc

SEQ ID NO: 12138 - protein, 80 aa, Panicum virgatum
  misc_feature: Ceres CLONE 1761025
  misc_feature: The sequence is a functional homolog of SEQ ID NO 1419 in the 11/479,226 US patent application
  misc_feature: The sequence is a functional homolog of SEQ ID NO 668 in the 10/412,699 US patent application
  misc_feature: Useful for making plants with modulated cold sensitivity
  misc_feature: Useful for making plants with altered lignin content
  misc_feature: Useful for making plants with altered carbohydrate content
  misc_feature: Useful for making plants with altered alkaloid content
  misc_feature: The sequence is a functional homolog of SEQ ID NO 1755 in the 10/374,780 US patent application
  misc_feature: The sequence is a functional homolog of SEQ ID NO 160 in the 10/714,887 US patent application
  misc_feature: The sequence is a functional homolog of SEQ ID NO 160 in the 11/435,388 US patent application
  misc_feature: The sequence is a functional homolog of SEQ ID NO 28 in the 10/903,236 US patent application
  misc_feature: Useful for biocontainment applications
  misc_feature: Useful for making plants with altered cell wall content and/or composition
  misc_feature: The sequence is a functional homolog of SEQ ID NO 34 in the 10/225,068 US patent application
  misc_feature: The sequence is a functional homolog of SEQ ID NO 348 in the 10/374,780 US patent application
  misc_feature: The sequence is a functional homolog of SEQ ID NO 22 in the 10/903,236 US patent application
  misc_feature: The sequence is a functional homolog of SEQ ID NO 2215 in the 10/666,642 US patent application
  misc_feature: The sequence is a functional homolog of SEQ ID NO 82 in the 10/714,887 US patent application
  misc_feature: The sequence is a functional homolog of SEQ ID NO 82 in the 11/435,388 US patent application
  misc_feature: The sequence is a functional homolog of SEQ ID NO 135 in the 11/479,226 US patent application
  misc_feature: The sequence is a functional homolog of SEQ ID NO 212 in the 10/225,068 US patent application
  misc_feature: The sequence is a functional homolog of SEQ ID NO 22 in the 10/412,699 US patent application
  misc_feature: The sequence is a functional homolog of SEQ ID NO 4 in the 10/374,780 US patent application
  misc_feature: Useful for making plants with modulated heat sensitivity
  misc_feature: The sequence is a functional homolog of SEQ ID NO 2217 in the 10/666,642 US patent application
  misc_feature: The sequence is a functional homolog of SEQ ID NO 24 in the 10/903,236 US patent application
  misc_feature: The sequence is a functional homolog of SEQ ID NO 84 in the 10/714,887 US patent application
  misc_feature: The sequence is a functional homolog of SEQ ID NO 84 in the 11/435,388 US patent application
  misc_feature: The sequence is a functional homolog of SEQ ID NO 1756 in the 10/374,780 US patent application
  misc_feature: Useful for making plants with modulated biomass
  misc_feature: Useful for making plants with modulated flowering time
  misc_feature: The sequence is a functional homolog of SEQ ID NO 1011 in the 10/412,699 US patent application
  misc_feature: The sequence is a functional homolog of SEQ ID NO 700 in the 10/666,642 US patent application
  misc_feature: The sequence is a functional homolog of SEQ ID NO 1195 in the 10/666,642 US patent application
  misc_feature: The sequence is a functional homolog of SEQ ID NO 20 in the 10/225,066 US patent application
  misc_feature: The sequence is a functional homolog of SEQ ID NO 2844 in the 10/374,780 US patent application
  misc_feature: The sequence is a functional homolog of SEQ ID NO 2224 in the 10/374,780 US patent application
  misc_feature: The sequence is a functional homolog of SEQ ID NO 502 in the 10/225,066 US patent application
  misc_feature: The sequence is a functional homolog of SEQ ID NO 4 in the 10/225,068 US patent application
  misc_feature: The sequence is a functional homolog of SEQ ID NO 406 in the 10/374,780 US patent application
  misc_feature: The sequence is a functional homolog of SEQ ID NO 90 in the 10/225,066 US patent application
  misc_feature: The sequence is a functional homolog of SEQ ID NO 1754 in the 10/374,780 US patent application
  misc_feature: The sequence is a functional homolog of SEQ ID NO 1001 in the 10/412,699 US patent application
  misc_feature: The sequence is a functional homolog of SEQ ID NO 502 in the 10/374,780 US patent application
  misc_feature: The sequence is a functional homolog of SEQ ID NO 452 in the 10/666,642 US patent application
  misc_feature: The sequence is a functional homolog of SEQ ID NO 1157 in the 10/374,780 US patent application
  misc_feature: The sequence is a functional homolog of SEQ ID NO 1360 in the 10/412,699 US patent application
  misc_feature: The sequence is a functional homolog of SEQ ID NO 106 in the 11/375,241 US patent application
  misc_feature: The sequence is a functional homolog of SEQ ID NO 2876 in the 10/374,780 US patent application
  misc_feature: The sequence is a functional homolog of SEQ ID NO 44 in the 10/903,236 US patent application
  misc_feature: The sequence is a functional homolog of SEQ ID NO 474 in the 10/225,066 US patent application
  misc_feature: The sequence is a functional homolog of SEQ ID NO 560 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: Useful for making plants with altered lutein content
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
RARGDRKRPRGRDAAETRDPTSKARGRPGTNDTAEAAARANDAAFFHSRGPKAKTNPPAAPAADAHPPPPKKRAASPSSS

SEQ ID NO: 12139 - DNA, 746 bp, Panicum virgatum
  misc_feature: Ceres CLONE 1761060
  misc_feature: Encodes the peptide sequence at SEQ ID NO. 12140
taagctgaagaagaggggctacgaggtcctttacatggttgacgccatcgatgagtatgctgttggtcagctcaaggagtttgagggcaagaagttggtctctgccaccaaggagggcctgaagcttgatgagacagaggatgaaaagaagaggaaggaggagctgaaggagaagtttgagggtctctgcaaggtcatcaaggaagtgctgggtgacaaggttgagaaggtggtggtctctgaccgtgttgtggactcgccgtgctgccttgtaactggtgagtacggctggacagccaacatggagaggatcatgaaggcgcaggccctgagggactcaagcatggctggctacatgtcgagcaagaagaccatggagatcaacccggagaacgccatcatggatgagctccgcaagcgtgctgaggctgataagaacgacaagtcagtgaaggaccttgtgatgctgctcttcgagactgcccttctcacctctggcttcagcttggatgaccccaacaccttcggcaccaggatccaccgcatgctcaagctcggcctgagcatcgatgaggatgagtcggccgaggctgaagctgagatgcctccgctggaggatgatgccggcgagagcaagatggaggaggtcgactaaagctttttatagctttttatgcttcgcttatctccagttaccagccgaagcttaatcttgactactgtttgaggttttttgcacgttatcg

SEQ ID NO: 12140 - protein, 217 aa, Panicum virgatum
  misc_feature: Ceres CLONE 1761060
  misc_feature (1)..(217): Pfam Name: HSP90 Pfam Description: Hsp90 protein
KLKKRGYEVLYMVDAIDEYAVGQLKEFEGKKLVSATKEGLKLDETEDEKKRKEELKEKFEGLCKVIKEVLGDKVEKVVVSDRVVDSPCCLVTGEYGWTANMERIMKAQALRDSSMAGYMSSKKTMEINPENAIMDELRKRAEADKNDKSVKDLVMLLFETALLTSGFSLDDPNTFGTRIHRMLKLGLSIDEDESAEAEAEMPPLEDDAGESKMEEVD

SEQ ID NO: 12141 - DNA, 615 bp, Panicum virgatum
  misc_feature: Ceres CLONE 1761061
  misc_feature: Encodes the peptide sequence at SEQ ID NO. 12142
acacgccgacgccgatcgatcgagctagctcccacttgcagtcctccgtcccgcccgccgcgcgcgcttcagcttgggttggagatccgtgatccatggctgctgagttgaccatgcagactgttgtcctcaaggtgactatgtcatgcgagggttgcgccggggcggtcaggagagtgctctcaaagatggaaggagttgagacctttgacatagacctcaaggagcagaaggtgacagtcaaaggcaatgtcaagcctgaagatgtcttccagacggtttccaagtcggggaagaagacctcctactgggagggcgaagccacagcaccgtctgctccggccccagtagcagaagcagctctcagcaccgaggcagaagcgcctgccgcggaggctgcaccagagatcaccccagtcaagcctgacgcttgatcatcacatgagatgctgtgacccctaaaccttactctagaactagctgggaaaaccgagtcttgtgcgatttgcatcatgttgttgccactctagcaagtgattgcgaattatagaataaatgatgaaacccagtatgtccgtacgtttgtgtgatttcaagatgaacacatcccttgcg

SEQ ID NO: 12142 - protein, 112 aa, Panicum virgatum
  misc_feature: Ceres CLONE 1761061
  misc_feature (10)..(71): Pfam Name: HMA Pfam Description: Heavy-metal-associated domain
  misc_feature: SWISSPROT Homolog: EC 3.6.3.4 Copper-exporting ATPase
MAAELTMQTVVLKVTMSCEGCAGAVRRVLSKMEGVETFDIDLKEQKVTVKGNVKPEDVFQTVSKSGKKTSYWEGEATAPSAPAPVAEAALSTEAEAPAAEAAPEITPVKPDA

SEQ ID NO: 12143 - DNA, 736 bp, Panicum virgatum
  misc_feature: Ceres CLONE 1761063
  misc_feature: Encodes the peptide sequence at SEQ ID NO. 12144
agctagctgaagcacacacgagctagtacactgaaggacagcatgaagacgctagccttggtcatcgtggctgcgctcaccctcatcgcccatggcgtggcgcaggagtgcggcaaccagaacggcggcgcgctgtgccccagcaacctgtgctgcagcaggtcgggtcgctgcggcctcggcagggacttctgcggcgacggctgccagagcggcgcgtgctgccccagccggcgctgcggcagcttccagacctgcgacgccaaccagtgctgcagcgcgcaagggttctgcggcctgggcaggcagtactgcggcgccggctgccagaacggggcctgctggggcgacgtgaggtgcaccgtgcagacccccaaccccaacaacctctgctgcagtagctcggggttcttcggcctcggccccgagtactgcggcgctggctgccaggccggcgcttgctgcggtggagctagcaccgccatggccgacgtcttcaaccacacagctgcttctgcagcgacgctgctgtcttcagtggtgtaggcggcagtgaacgggttgtactactgtatgctgcgatgcgactgcgactatgcatgtccactactgcgtgcctaataataaataagccaggatgatgctcgtcatcggcgtatatgttgtgtatgtatgcatggatgtttcgggcctgctatatatgtatattgtttatgaataaaatccttgtgttttg

SEQ ID NO: 12144 - protein, 167 aa, Panicum virgatum
  misc_feature: Ceres CLONE 1761063
  misc_feature (20)..(60): Pfam Name: Chitin_bind_1 Pfam Description: Chitin recognition protein
  misc_feature (63)..(100): Pfam Name: Chitin_bind_1 Pfam Description: Chitin recognition protein
  misc_feature (103)..(140): Pfam Name: Chitin_bind_1 Pfam Description: Chitin recognition protein
  misc_feature: SWISSPROT Homolog: EC 3.2.1.14 Chitinase
MKTLALVIVAALTLIAHGVAQECGNQNGGALCPSNLCCSRSGRCGLGRDFCGDGCQSGACCPSRRCGSFQTCDANQCCSAQGFCGLGRQYCGAGCQNGACWGDVRCTVQTPNPNNLCCSSSGFFGLGPEYCGAGCQAGACCGGASTAMADVFNHTAASAATLLSSVV

SEQ ID NO: 12145 - DNA, 661 bp, Panicum virgatum
  misc_feature: Ceres CLONE 1761077
  misc_feature: Encodes the peptide sequence at SEQ ID NO. 12146
tagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcttctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatatatatagtataggtatatatatatatatatatatatatatatatatatgtatgcaattcaaatataagaataacgaacgctcgctctgtctatctatatctgtctctcttgatctcgatcgatctatt

SEQ ID NO: 12146 - protein, 143 aa, Panicum virgatum
  misc_feature: Ceres CLONE 1761077
  misc_feature (52)..(127): Pfam Name: Fer2 Pfam Description: 2Fe-2S iron-sulfur cluster binding domain
  misc_feature: SWISSPROT Homolog: EC 1.14.13.7 Phenol 2-monooxygenase
MSCSLRAPACSGLSGVRAAPAPAIVAMPAAKQQVVGRGARLRAQATYNVKLITPDGEVELQVPDDVYILDQAEEEGIDLPYSCRAGSCSSCAGKVFSGSVDQSDQSFLEDDQVAGGWVLTCAAYPTSDVVIETHKEEELTSSS

SEQ ID NO: 12147 - DNA, 736 bp, Panicum virgatum
  misc_feature: Ceres CLONE 1761109
  misc_feature: Encodes the peptide sequence at SEQ ID NO. 12148
acaacaaacaagttactgccgcagatctgccatttctagcttacctctatacctatggagccatccaagctagtagttgttttgctcgtgctggccatggcggccgtgcggccttccagcgctcagaactcgcctcaagactatctctcgccccacaaccaggcccgcgcctccgtcggcgtcggcgcggtgacctggagcacgaagctgcagcaattcgcggagaggtacgccgcgcagagggccggcgactgccggctgcagcactcgggcgggccgtatggggagaacatcttctggggctccgccggcgccgactggaaggcggcggacgcggtgaggtcgtgggtggacgagaagcagtggtacgactacgccgccaacagctgcgccgccggcaaggtgtgcggccactacacgcaggtggtgtggcgtgccaccaccagcatcggctgcgcgcgcgtcgtctgcaacagcaaccgcggggtcttcatcacctgcaactacgagccccgcggcaacatcgtcggacagaagccctactgatcgctaaactgctatcttctagctcatggattatggcgtggatgcatggaactttctactatacgaaaacgaaattacgaatgcccatataataaggcatgcactgagtaaataaagggtcagtgtgccgtgtgctagctacctccatctcttaataaagccaataaaggagttttctatttttacagat

SEQ ID NO: 12148 - protein, 163 aa, Panicum virgatum
  misc_feature: Ceres CLONE 1761109
  misc_feature (31)..(151): Pfam Name: SCP Pfam Description: SCP-like extracellular protein
  misc_feature: Useful for making plants with modulated biotic stress sensitivity
MEPSKLVVVLLVLAMAAVRPSSAQNSPQDYLSPHNQARASVGVGAVTWSTKLQQFAERYAAQRAGDCRLQHSGGPYGENIFWGSAGADWKAADAVRSWVDEKQWYDYAANSCAAGKVCGHYTQVVWRATTSIGCARVVCNSNRGVFITCNYEPRGNIVGQKPY

SEQ ID NO: 12149 - DNA, 711 bp, Panicum virgatum
  misc_feature: Ceres CLONE 1761130
  misc_feature: Encodes the peptide sequence at SEQ ID NO. 12150
atccttcccatcagtctcagtccggaggcagcaggatagagaggcagaggcggagaaggcggctggccggacgggaggagcagagagcagagcacccagagccaggaggaagaagaggaaggcgaagcgaaggtccgagcctccgaggatgccgtgcctgaacgtgtcgacgaacgtcaacctggagggggtggacacctctgccatcctcggcgaagcctccacggccgtcgccaacatcatcggcaagccagaggcctacgtgatggttgttctcaagggttcagtgcctatggcatttggaggtacccaggagcctgcagcttatggtgagctggtttccattggagggctgaaccctgatgtcaacaagaagctgagtgctggcattgcttctattctggagtcaaagctgtccattcccaagtcccgcttctacctcaagtttcacgattcaaagcgctcggactttggttggaatggctccaccttctagattcgaggtccatgggtgtggctccaccgctcctgtgaaggaagatcgtcttccctaatgtcttgtccattgcataatggcctaataaggactctgttgtaagatgtcagttaatttgtgctgaactgaagtgaaaactgtcatgcggaactggggcacagacttgttcattgcaacctagcatattcgtgccgtgctgtgttggcttgcacaac

SEQ ID NO: 12150 - protein, 115 aa, Panicum virgatum; identical to SEQ ID NO: 10051
  misc_feature: Ceres CLONE 1761130
  misc_feature (2)..(115): Pfam Name: MIF Pfam Description: Macrophage migration inhibitory factor (MIF)
  misc_feature: SWISSPROT Homolog: EC 5.3.2.1 Phenylpyruvate tautomerase

SEQ ID NO: 12151 - DNA, 650 bp, Panicum virgatum
  misc_feature: Ceres CLONE 1761133
  misc_feature: Encodes the peptide sequence at SEQ ID NO. 12152
agcgcgcacggcgcacaagcacaacacgggcacgagctcgcggttcgcgcccggccggcgtacacagatcctccgtccgttggcatggaccgcggcggcgagaggaggagcggcgcgcacggggcggcggcgcccaggccctggcgcgctggcgccgcgccagcgggtgccgctccgccgccgccgccgccgccgccgaaggtctaccgcgtggagcccagggacttccgggagctggtgcagaggctcacgggcgccggcagcacgggcgccgcgccggggccagccgcgcagcggggggtggtgacgccggcgatggccccggagagcaggcgcctggaggcggctgccgccgcggccccggagcagcagttcgattacgcgtcgtggtactcggcgccgctgctcagcccggcgtacggcgcgggcggcttcggcagccaccagctctagcgtagaaacagagtctcgttgttttatttgtaaagacagattcgttcgatcacttgttcgtgttccggatctcatttcccttcgcttttgggttgtgcgacagccttcttgtaacgcgaatgaactcgatcgaggaattagacagctagtccttttttgaactatgattgaaacaaaaataaatcaagcttggtacc

SEQ ID NO: 12152 - protein, 122 aa, Panicum virgatum
  misc_feature: Ceres CLONE 1761133
  misc_feature (34)..(64): Pfam Name: VQ Pfam Description: VQ motif
MDRGGERRSGAHGAAAPRPWRAGAAPAGAAPPPPPPPPKVYRVEPRDFRELVQRLTGAGSTGAAPGPAAQRGVVTPAMAPESRRLEAAAAAAPEQQFDYASWYSAPLLSPAYGAGGFGSHQL

SEQ ID NO: 12153 - DNA, 759 bp, Panicum virgatum
  misc_feature: Ceres CLONE 1761140
  misc_feature: Encodes the peptide sequence at SEQ ID NO. 12154
atggcgtccaccctcgcgcccagcaccaccgcgtccaccctccgctcgccgttctcctcggtcccccgcgggacccgcctcccgcccacgctccgtctctcgcccgcccagcccgcttcggctggctgccgcgcggcgccaggccggcacacgtgcccgcgcgcgcgcgttcggtgcgccgcggccgtgaagttcatcgcgcagggcgagttcgcggcggaggtgctggagtcggagctgcccgtcctcgttgacttcgtcgccgactggtgcgggccgtgccgcctcatcgcgcccgtcgttgattgggcctcagaggaatatgatgggagattaaagattgtcaagatcgatcatgatgcaaatcctcagttgattgaagagtacaaggtttttggtctcccaacactcattctcttcaagaatgggcaagaggtaccaggtagccgaagagaaggtgcaataacaaaagacaagttcaagcaatacttggagcctttcttagcgacaactgtagcttaatatcagtgcccgcagtttaagccctcagaatgtcgatggcattggcttgcgcaaagcatcgggaatgttgaagaatccctccttacatgagcaacattttttagtttgtaattaactacaccatcttgcttgactatgtatgattgtcattggcaaatttagtatatataaagagctgtgatgaggatgtatcaactaattttaaatggctaatattaagcaagttcattttatgat

SEQ ID NO: 12154 - protein, 173 aa, Panicum virgatum
  misc_feature: Ceres CLONE 1761140
  misc_feature (62)..(165): Pfam Name: Thioredoxin Pfam Description: Thioredoxin
  misc_feature: SWISSPROT Homolog: EC 1.8.1.9 Thioredoxin-disulfide reductase
MASTLAPSTTASTLRSPFSSVPRGTRLPPTLRLSPAQPASAGCRAAPGRHTCPRARVRCAAAVKFIAQGEFAAEVLESELPVLVDFVADWCGPCRLIAPVVDWASEEYDGRLKIVKIDHDANPQLIEEYKVFGLPTLILFKNGQEVPGSRREGAITKDKFKQYLEPFLATTVA

SEQ ID NO: 12155 - DNA, 798 bp, Panicum virgatum
  misc_feature: Ceres CLONE 1761162
  misc_feature: Encodes the peptide sequence at SEQ ID NO. 12156
acacaggccacagcaccaccaccggagcacagagagagcagagcgccacaggccgtccgatcctccgcgcgaagcagatcagatggctctcgctctctccggctcctccgcgctccgcgccgcgctggcctcgctggcccccgccaggggctacgcggcgtcggcggcgtccggggccctgcggcgcgcggcggccgcggcggagggcgccgccgcgggggaggccaaggaggccgggcgcggcgccgcctccgagatctcctgggtccccgaccccgtcacgggccactaccgccccgccaactgggccgccgccgccgaccccgccgacctccgcgccgcgcacctcgcccgggcgtgagccccgcgcccgcccgcccccacccgtctgacataacataccaacaaaggggaaggtggggtggaggttcgtctggcgtcgtcgtcggccgcgcgcgcgagcgctcgctccgtcacggcggcgggccggcatggccgggaagtcgtctcggttggtcgctgtgggacgctcgacgccgctgcatcatctcggcctcggccaatcgggagatacggtacagggaggagcggaggagcggccgctggtcgccgtggcgtgcgtgcgtgcgtggtgtgggctggacgccctgttctagcttctcgctggtgctctcctaccagattcggatatatactactactacgctgcggagagcgagcagggtttcgctgctgttctacgttttgttagtcgctatcagttttatcaccagaaataaaaagctgcggtttgttctt

SEQ ID NO: 12156 - protein, 92 aa, Panicum virgatum
  misc_feature: Ceres CLONE 1761162
  misc_feature (1)..(90): Pfam Name: LEA_3 Pfam Description: Late embryogenesis abundant protein
MALALSGSSALRAALASLAPARGYAASAASGALRRAAAAAEGAAAGEAKEAGRGAASEISWVPDPVTGHYRPANWAAAADPADLRAAHLARA

SEQ ID NO: 12157 - DNA, 669 bp, Panicum virgatum
  misc_feature: Ceres CLONE 1761168
  misc_feature: Encodes the peptide sequence at SEQ ID NO. 12158
acctcattgtttccgagaaggacgccgtgcagcgtctccaatggcgtacaaggtgaaagggttcttcaagggcctcaaggtcatctcccggatcttcgtggtgaaggagcacgagatggagatcggttatccgacggacgtgaagcacgtcgcgcacatcggctgggatagcgcggcggggaatgcttctccaagctggatgaacgacatcatggcatcccccaatttctcgtccttgggcaactttgctgcgtccacaggggctacatgggcctctcaagattttggcgcggtttcagagaccaccggccggcgggaatcggctagttgccccgacgttccagggcctctggggaagccgagggggaagaagccggaggacggatcgccaaccgcgccgtcgacgtccatggacgagctggcgtcaccaccgccagcagaggccgccgaggctgccgacggcgctgctgcagatggcacgcgatgatctactaaaccgtgttccggtctttttcttattgtcgtgtaggcaatggcaacgattgtatttctcgactttctttgtgtcagctggagatggtattgagattggattgcagatgaaaatggaacgaatgcaacgactttttttttgagagaggaagaatgcaacgaaatggattgtttgtt

SEQ ID NO: 12158 - protein, 148 aa, Panicum virgatum
  misc_feature: Ceres CLONE 1761168
  misc_feature (27)..(65): Pfam Name: PBD Pfam Description: P21-Rho-binding domain
MAYKVKGFFKGLKVISRIFVVKEHEMEIGYPTDVKHVAHIGWDSAAGNASPSWMNDIMASPNFSSLGNFAASTGATWASQDFGAVSETTGRRESASCPDVPGPLGKPRGKKPEDGSPTAPSTSMDELASPPPAEAAEAADGAAADGTR

SEQ ID NO: 12159 - DNA, 997 bp, Panicum virgatum
  misc_feature: Ceres CLONE 1761188
  misc_feature: Encodes the peptide sequence at SEQ ID NO. 12160
gtcccctttctccatttcttaaaccttctgtatccatccacctcctccacggtggttcgcttcggtctccagagatttcgcttggagaagaaacccaagaggaatccgcagatgaagatcattcctgtaccttgtctggaggaaactatgcctacctaatcgtggacgagagcaccaagaaggcggcggccgttgacccggtggagccggagaaggttctcaaggcggccagcgaggtcggcgcctacgtcgactgcgtcctcaccacccaccaccactgggatcatgctggtggcaatgagaagatgaggctgcaggtgccagggataaaggtctttggtggatccctggacaatgtgaaaggctgcactgatcaggtggagaatggaacaaagttgtcacttggaaagggcattgagatactatgcctacacaccccttgtcacacaaaaggtcatattagctactttgttactagtaaagagggggaagatccagcggtcttcactggagacactttgtacactgtgaagaacctgaagttcatgctgacactcgagccggagaacgagaagatgaaacagaaactggaatggtctgaaaagcagcgtgaagcgaatcagcctacagttccctcaactataggagatgagtttgagatcaataccttcatgcgcgttgatcttccagaaatacaggcaaagttcagtgccaagtctccagttgaagcgctgagagaggtcaggaagatcaaagataactggaaaggttgatacccatgtcggctgtcactctgttggacggccagcaactcaaagtgagctaattcagaaaccttgcctgtaggtgggaatgaggtttactgccgcgcaatgctttgataggtatggcgtcgggaaggagaagactcttataataagcaccgtgttgataaaaacaataatcatgtaacttctgaactgtttgtttgcgaacagtaatgcatgaactattttat

SEQ ID NO: 12160 - protein, 256 aa, Panicum virgatum
  misc_feature: Ceres CLONE 1761188
  misc_feature (47)..(185): Pfam Name: Lactamase_B Pfam Description: Metallo-beta-lactamase superfamily
  misc_feature: SWISSPROT Homolog: EC 3.1.2.6 Hydroxyacylglutathione hydrolase
  misc_feature: Useful for making plants with modulated biomass
PLSPFLKPSVSIHLLHGGSLRSPEISLGEETQEESADEDHSCTLSGGNYAYLIVDESTKKAAAVDPVEPEKVLKAASEVGAYVDCVLTTHHHWDHAGGNEKMRLQVPGIKVFGGSLDNVKGCTDQVENGTKLSLGKGIEILCLHTPCHTKGHISYFVTSKEGEDPAVFTGDTLYTVKNLKFMLTLEPENEKMKQKLEWSEKQREANQPTVPSTIGDEFEINTFMRVDLPEIQAKFSAKSPVEALREVRKIKDNWKG

SEQ ID NO: 12161 - DNA, 999 bp, Panicum virgatum
  misc_feature: Ceres CLONE 1761196
  misc_feature: Encodes the peptide sequence at SEQ ID NO. 12162
aacaaagaaattcacgctgccccgaaaacccttccatcgcctctcctccgcgcgccgccacttcccctctctcgagctccccacggtttcgcgcaagatctagctagggttcgggttcttctcgggaccggcggcgatggcgaccgagcaagcggcggagaactacacggtggaggacctcgtggccctgaatccctacaaccccgacatcctcaacgacctcgagaagtttgtcaacgagcaggtctcatctcaaacatataatttggatgcaaatctcagcctccttcgcctgtaccagtttgagccagaaagaatgagcattcagattgtagcccgcatattgattaaggctctcatggcaatgccagcccctgacttcagtctgtgcttgttcttaatccctgaacatgtgcaaatgaaggagcaattcaagacattgatagttctttctcactacctggagactgctagattccgtcagttttgggatgaagcagcaaagaaccgccacatattggaagttgttccaggatttgagcaggcaatccaagcctatgcaattcatctgctttccttgacataccagaaagttccgaggcctgttcttgcggaggctatcaacattgaaggcctcgcgttggacaagtttctggagtaccatgccgcgaactcaggttgggtgattgagaagggtggacagtctcaagtgattgttcttccgcgcaacgagttcaatcaccctgagctcaagaagaacacagctgacactgttccattcgagcatgtaacacgcatattccctgtccttagctgattcaagcgtactgagagatttctataactcagagggagtgaagtttctctaagcacttgtatcttctgttttgtggtgtactgcctttttgagattatcttggtatacctcttttgaggttaaatagtacttgcaactgatggtgcctactccgttactcttagcaaaatgctcagtttgtc

SEQ ID NO: 12162 - protein, 226 aa, Panicum virgatum
  misc_feature: Ceres CLONE 1761196
  misc_feature (19)..(164): Pfam Name: SAC3_GANP Pfam Description: SAC3/GANP/Nin1/mts3/eIF-3 p25 family
MATEQAAENYTVEDLVALNPYNPDILNDLEKFVNEQVSSQTYNLDANLSLLRLYQFEPERMSIQIVARILIKALMAMPAPDFSLCLFLIPEHVQMKEQFKTLIVLSHYLETARFRQFWDEAAKNRHILEVVPGFEQAIQAYAIHLLSLTYQKVPRPVLAEAINIEGLALDKFLEYHAANSGWVIEKGGQSQVIVLPRNEFNHPELKKNTADTVPFEHVTRIFPVLS

SEQ ID NO: 12163 - DNA, 797 bp, Panicum virgatum
  misc_feature: Ceres CLONE 1761209
  misc_feature: Encodes the peptide sequence at SEQ ID NO. 12164
atcacctgcaacgagcaatcaatccccagatttttcacaggcggaaacacgcaaagccctaactagcagctcatcgaccggctagcaatggcggcggcggaggggacgacgacgaagaagagcggcggcgagatgacggtggtgcgcgggctggacgtggcgcggtacatgggccggtggtacgagatcgcgtcggtcccgtccttcttccagccccgggacggccggaacacgcgcgccacgtacgcgctgctggaggacggcgcgacggtgcacgtgctcaacgagacgtggagcaagggcaagcgcgactacatcgaggggacggcgtacaaggccgaccccggcagcgacgaggccaagctcaaggtcaagttctacctcccgccgttcctccccatcatccccgtcgtcggcgactactgggtgctctacgtcgacgccgactaccagtacgcgctcgtcggcgagccgcgccgcaagaacctctggatcttgtgcaggaagacgagcatcgacgaggaagtgtacagccagctgctggagcgggcgagggaggaaggctacgacgtaagcaagctgcacaggacgccgcaggacgacccgccgccggagagcgacgccgcgcccaccgacaccaagggggtctggtggttcaagtcgctcttcggcaaatgatcgtccatcgcgtgctgcgctttgctctgcttctcgcttgcttgctagctagctagtacactagtgtatctctctgctataatccgtgccgcgcgcggcgaataaaattggattgctgc

SEQ ID NO: 12164 - protein, 196 aa, Panicum virgatum
  misc_feature: Ceres CLONE 1761209
  misc_feature (22)..(170): Pfam Name: Lipocalin_2 Pfam Description: Lipocalin-like domain
MAAAEGTTTKKSGGEMTVVRGLDVARYMGRWYEIASVPSFFQPRDGRNTRATYALLEDGATVHVLNETWSKGKRDYIEGTAYKADPGSDEAKLKVKFYLPPFLPIIPVVGDYWVLYVDADYQYALVGEPRRKNLWILCRKTSIDEEVYSQLLERAREEGYDVSKLHRTPQDDPPPESDAAPTDTKGVWWFKSLFGK

SEQ ID NO: 12165 - DNA, 679 bp, Panicum virgatum
  misc_feature: Ceres CLONE 1761225
  misc_feature: Encodes the peptide sequence at SEQ ID NO. 12166
atcatcgcatcggcactcctctctgcctttagagctatcggaggaggagagcttttgggcttttgggggtgcgtggtgcgccatgggggaggtgaagcacctgtgcctggtgaagttcaaggagggcgtcgtggtggaggacgtcctcaaaggcatgaccgaccttgtcgcccagatggacatggtcaaatccttcgagtggggccaggacgtgctgaaccaggagatgctgacgcagggcttcacgcacgtcttctcgctcaccttcgcctccgccgacgacctcaccacctacatgggccacgacaagcacgccgcgttcttttccacgttcatggccgcactcgagaaggtggtcgtcatcgacttccccgtcgtcatcgccaagccaccgccatcggcatgatcgacctgccacagcatctgtcggccattgtacggtgccttttcaggtagcagatcatcgcctatttgcagcggtgatgtactgcgtgtctaagtacgtactatgtactaagctccttattactactcgttctgcctgatgctgtgtcccgtactctaggacgtctattgtagctgtaaggcaaagatatatatagcgtacgtgcagcactccgtgctccacagtccctaatggttggttatctttggaataaattttggtgatctttctggt

SEQ ID NO: 12166 - protein, 107 aa, Panicum virgatum
  misc_feature: Ceres CLONE 1761225
  misc_feature (4)..(98): Pfam Name: Dabb Pfam Description: Stress responsive A/B Barrel Domain
MGEVKHLCLVKFKEGVVVEDVLKGMTDLVAQMDMVKSFEWGQDVLNQEMLTQGFTHVFSLTFASADDLTTYMGHDKHAAFFSTFMAALEKVVVIDFPVVIAKPPPSA

SEQ ID NO: 12167 - DNA, 920 bp, Panicum virgatum
  misc_feature: Ceres CLONE 1761230
  misc_feature: Encodes the peptide sequence at SEQ ID NO. 12168
ctcttccctgcgagacccaaccagaggagcggcggcgcgggcggaccaggcggaggaggcggagcagcagcagtcgggcgaggccaccgacgccaccatgggtatctcgcgtgactcgatgcacaagcgccgggccaccggtgggaagcagaaagcctggaggaagaagcgaaagtatgagctcggccgccagcctgctaacaccaagctgtccagcaacaagacagtgaggagggtccgtgtccgtggaggtaatgtgaagtggagggctctccgcctggataccggtaactactcatggggtagtgaggcggttactcgcaagacccgtatcctggatgttgtctacaacgcgtcaaacaatgagcttgttcgaacccagaccctcgtgaagagtgccattgtgcaagttgatgctgccccattcaagcagtggtacctcactcactatggagtggacattggtaggaagaagaaggccccggctgctaagaaggatgctgctgagggtcaagagggtgaggccacagctgaagaaacaaaaaagagtaaccatgtcctgaggaaggttgagaagcgccagcagggacggacacttgacccgcacattgaggagcaatttggcagtggaaggttgttggcatgtattgcttctcgccctgggcagtgtggccgagctgacggttacatccttgagggtaaagaactcgagttctacatgaagaagctccagaggaagaagggcaagggtgccgcagcatagaagcattgtattgtctggaagcgggtggcctatcttatcctttactctgggttttgtcagtcctcaagtatgttatgtcgtgttgcagaccagatgaacacctattttctgaaagtgaatcaactctatcttcaaagaactgagaattttcaccttc

SEQ ID NO: 12168 - protein, 221 aa, Panicum virgatum
  misc_feature: Ceres CLONE 1761230
  misc_feature (1)..(199): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAAEGQEGEATAEETKKSNHVLRKVEKRQQGRTLDPHIEEQFGSGRLLACIASRPGQCGRADGYILEGKELEFYMKKLQRKKGKGAAA

SEQ ID NO: 12169 - DNA, 679 bp, Panicum virgatum
  misc_feature: Ceres CLONE 1761236
  misc_feature: Encodes the peptide sequence at SEQ ID NO. 12170
tgatggctgcggccaccacctcctgctccccgcgccgcgcggcgccgctcctgatgaagccggtggcctcctcctcgtctagctcggcgcggccgcggcggcccttggcgcagcagctcccgcggctgctggcgacggcggcggcggcggtggcggccgcgccgctcccggcgctggcggagcagatggagaaggcggcgctcttcgacttcaacctgacgctcccggcgatcgcgaccgagttcctgctgctcatggtcgcgctggacaagctctacttcacgccgctcgttttgttcatggacgagcgggacgcggcgctcaacaagatgaagaaggagaccaccgccgagctggaggccaagctggacgagggccgccgccgcgtcgaggccgagctcgtcgaggcgctcgccaacctcgaatcccagaaggaggaggccgtcaaggcgctcgacgcgcagatcgcctcgctcagcgacgagatcgtcaagaaggtgctcccatccgcgtgagggggaatcgaaacagcgagccagccttcttccttgctcagctttctgatctgtgtgtatacgcttgttgggccgccgtccgttgccggccctgctttatcctatgatgactgtaactgcatcaacattttgtggcaagtataaatgaatcaatcatatttttg

SEQ ID NO: 12170 - protein, 170 aa, Panicum virgatum
  misc_feature: Ceres CLONE 1761236
  misc_feature (73)..(168): Pfam Name: ATP-synt_B Pfam Description: ATP synthase B/B' CF(0)
  misc_feature: SWISSPROT Homolog: EC 3.6.3.14 H(+)-transporting two-sector ATPase
MAAATTSCSPRRAAPLLMKPVASSSSSSARPRRPLAQQLPRLLATAAAAVAAAPLPALAEQMEKAALFDFNLTLPAIATEFLLLMVALDKLYFTPLVLFMDERDAALNKMKKETTAELEAKLDEGRRRVEAELVEALANLESQKEEAVKALDAQIASLSDEIVKKVLPSA

SEQ ID NO: 12171 - DNA, 783 bp, Panicum virgatum
  misc_feature: Ceres CLONE 1761237
  misc_feature: Encodes the peptide sequence at SEQ ID NO. 12172
atccactcccacactcccccatggccgccactttcctcgctggcctcaacgcaccaccggcggctgctgctgctacaggctgcggccatgccttctccgcgtccgggagcagccgagcaacgccaccgcgcgcagtgacgtgccaggcgtccaggagatcagcctccgtccacctcggcctcgccgctgcaaccgccgtcctgctccggcagcctgatgccgcccgcgccaccgaggacgagccggccaacaacggctggtggcttaccgagttccccttgcccgtgcccaagatcctcaacaaggagatcaacaacccggagacggggacgcgctccttcctcaagaacggcatcttcatggcggacatcggccccagcttcgcggcgcacgcgtaccgcctgcgcagcacggccttcgacctgctggcgctggaggacctgctcggcagggaagcctccaactacgtcaacaagtacctccgcctcaagtccaccttcatgtactacgacttcgacaagctcatcaccgccgccgacgacaagccgcccttcgtcgacctcgccaaccgcctcttcgacagcttcgagaccctgcagcaggccgtcaccgccaaggacgacaccaagataggcgaacgctacgccgagacaaaggtcatcctccaggagcttatggcgaaaatggcatagcatagcagcagctctcccgattcaattcataatgtaaatcctagtatcgccgtcagaatttgcaaatccagagattgtacgagtttgtacc

SEQ ID NO: 12172 - protein, 223 aa, Panicum virgatum
  misc_feature: Ceres CLONE 1761237
  misc_feature (24)..(223): Pfam Name: PsbQ Pfam Description: Oxygen evolving enhancer protein 3 (PsbQ)
MAATFLAGLNAPPAAAAATGCGHAFSASGSSRATPPRAVTCQASRRSASVHLGLAAATAVLLRQPDAARATEDEPANNGWWLTEFPLPVPKILNKEINNPETGTRSFLKNGIFMADIGPSFAAHAYRLRSTAFDLLALEDLLGREASNYVNKYLRLKSTFMYYDFDKLITAADDKPPFVDLANRLFDSFETLQQAVTAKDDTKIGERYAETKVILQELMAKMA

SEQ ID NO: 12173 - DNA, 812 bp, Panicum virgatum
  misc_feature: Ceres CLONE 1761240
  misc_feature: Encodes the peptide sequence at SEQ ID NO. 12174
cgccacccccctcaagtccccaagatccccaacctcttcgccttcattcctcccgccgccgccgaagccccgctcgaagaaatggtgagagtaagtgtgctcaatgatgcccttaagagcatgtacaatgctgaaaagcgtggcaagcgccaggtcatgatcaggccatcatcgaaggtcatcattaagttcctcatcgtcatgcaaaagcacggatacattggggagtttgagtttgttgatgatcatcgttctggtaagatagtagttgaactcaatggaaggctcaacaaatgtggtgtgatcagcccacgctttgatgttggtgtgaaggaaattgagtcctggacagcgaggctgctcccctcacgtcagtttggctacatcgttctaaccacctctgctggcatcatggaccacgaagaggcgaggagaaagaatgtgggagggaaggtccttggcttcttctactaggaaaacctagtatccacatatcagattatcccagtaattgttaagttaaaagaacatagttttgtagctgtctagaagccaaaagcacgcagagatcacctattctgcattgtcttgttctggattttgttgacccatttagtttttgtcactaagttgttgcttggccccctttttagctcgtgcatcagttggatgcaatctgctggtgtacctggtatgttagttctgaatcttggtactatgatgcactcacttgagcggagtgcatgtggagcgatttgctgattcatcctgtatcactgtatttccctactgagagtgttgatgttttgttg

SEQ ID NO: 12174 - protein, 130 aa, Panicum virgatum
  misc_feature: Ceres CLONE 1761240
  misc_feature (5)..(130): Pfam Name: Ribosomal_S8 Pfam Description: Ribosomal protein S8
MVRVSVLNDALKSMYNAEKRGKRQVMIRPSSKVIIKFLIVMQKHGYIGEFEFVDDHRSGKIVVELNGRLNKCGVISPRFDVGVKEIESWTARLLPSRQFGYIVLTTSAGIMDHEEARRKNVGGKVLGFFY

SEQ ID NO: 12175 - DNA, 828 bp, Panicum virgatum
  misc_feature: Ceres CLONE 1761242
  misc_feature: Encodes the peptide sequence at SEQ ID NO. 12176
cgcaaaccctaccccggctatcgccatccttggcctccgcccgcgccgccctcctcctgcggcgccagtgcctcggcgccgccgcggccaacccgtacctcttctccgggcatggcctccgctaccgcaagctcgaggtcatcctcaccacgacgattgataagctggggaaagcaggggaggtggtgaaggtggctcctggccacttccgcaaccaccttatgcccaagatgctcgctgtcccaaacatggacaaattcgccatactcatccgagagcaacgcaagctctatcaacgtgaagaggaagtggtgaaagaagtcacaaaggaagatgatgatgctcggctcctggaagagagactgaagcagtaccaaacagcagcaaagcggctagataatgcacttttggtgttgaggcggtttatctcgactggaaacgaactgcgcactcctataacaaaagatgaaattgtctccgaggtggcaaggcaactcaacatcaacatccacccggacaatctgcatctgccgtcacctttgacatcccttggtgaatttgaactgccccttcgcttaccgcaggatataccacgcccagaaggcaagctacaatggactctgaatgtcaagatcaggaggaaatagcgcagtaattggggaaatttaattcaccacccgatccattgtagctttcagatctagggacctatggaataggttttcagatcaaatgatttgctgatcaaatatatctgatccccaagcttccttcatgcctttgtttttgctgtttgaacttcttgcccatctttggacaggatgccat

SEQ ID NO: 12176 - protein, 214 aa, Panicum virgatum
  misc_feature: Ceres CLONE 1761242
  misc_feature (44)..(92): Pfam Name: Ribosomal_L9_N Pfam Description: Ribosomal protein L9, N-terminal domain
QTLPRLSPSLASARAALLLRRQCLGAAAANPYLFSGHGLRYRKLEVILTTTIDKLGKAGEVVKVAPGHFRNHLMPKMLAVPNMDKFAILIREQRKLYQREEEVVKEVTKEDDDARLLEERLKQYQTAAKRLDNALLVLRRFISTGNELRTPITKDEIVSEVARQLNINIHPDNLHLPSPLTSLGEFELPLRLPQDIPRPEGKLQWTLNVKIRRK

SEQ ID NO: 12177 - DNA, 796 bp, Panicum virgatum
  misc_feature: Ceres CLONE 1761256
  misc_feature: Encodes the peptide sequence at SEQ ID NO. 12178
tcacacgtacactccctcccgaccacccaagcgagccacagccaccggagcagagcgccgagccccaggcaggatcccatggccgccaccgccgtcgcggcgtctctgcccgtggcccgggggctcgggaagcccctccgcgccggcggcagcagcggcgcgtcgtcgctccgcgtcgtctcgccccgtggcagggtggccgtcgtccgggcgtcgtcgtccgcgcagagcccggccaaggagtgggcggccgcggcggccgtcgcggcggcgctggtgctgccggaggtcgcggaggccgcgcagccggggatctcaccctcgctcaagaacttcctcctcagcatcgtctccggcggagtcgtgctcgtcgccatcgtcggcgccgtcgtcgccgtctccaacttcgaccctgtcaagcggggctgagctccaccacaagcacggccgccggccgcgccatggctgtgcgtatacctatgtactgatgagactgagagcggtcggtctggtctcttctccgtgtgcttccgaacgaaacacagtgtctgatgcgtccatcttttgccgtgtaaatttcatttcctgctcgtgaaatctcgtgttcattgagaccccccacaggttcatctaggatcgatcggttcaatttaattttaccgtgggtctgctagagtttcactttgcgacacatgccgcatcggaattcgatcgggctattattataggcgagcaattcaggttgagctctagtagtatatcactggagcgaaaaaccacgtttctctgaagaaat

SEQ ID NO: 12178 - protein, 116 aa, Panicum virgatum
  misc_feature: Ceres CLONE 1761256
  misc_feature (79)..(116): Pfam Name: PsbX Pfam Description: Photosystem II reaction centre X protein (PsbX)
  misc_feature: Useful for making plants with modulated nitrogen use efficiency
MAATAVAASLPVARGLGKPLRAGGSSGASSLRVVSPRGRVAVVRASSSAQSPAKEWAAAAAVAAALVLPEVAEAAQPGISPSLKNFLLSIVSGGVVLVAIVGAVVAVSNFDPVKRG

SEQ ID NO: 12179 - DNA, 734 bp, Panicum virgatum
  misc_feature: Ceres CLONE 1761278
  misc_feature: Encodes the peptide sequence at SEQ ID NO. 12180
atacagaagttcacacacagccgcgcagtgcgtgcctcgttgtgtccaccgacatcgccggcctcaccccgtgcaaggagtccaaggcgttcgccaagcgcgagaagaactcgatcaagaagctgaccgcctcgctcaacaagtacgcccccgacagcgcccccgcgctcgccatcaacgccaccatcgagaagaccaagcgccgcttcgagaactacggcaagttcggcctgctctgcggcgccgacggcctgccgcacctcatcgtcagcggcgaccagcggcactggggcgagttcatcaccccgggcctgctcttcctctacatcgccggctggatcgggtgggtcggcaggagctacctcatcgccatcagcggcgagaagaagcccgccatgagggagatcatcatcgacgtcgagctcgccacgaggctcctccccagggggttcatctggcccgtcgcagcctaccgcgagctcatcaacggagagctcgtcgtcgacgacaaggacatcggctactactaagcgcacctgcatggctggtggcgaccggcgagttgggcagcgactgtgttggggaagatgcatgtcttgtggtgtaggagctaataggatgatggaggaatggaagctctgttgtacttaagaaactggatgaagcctagtataactgtacctctctcttgtgtgtattcacctccttgaaaattcttgagaacgatttcattt

SEQ ID NO: 12180 - protein, 175 aa, Panicum virgatum
  misc_feature: Ceres CLONE 1761278
  misc_feature (7)..(170): Pfam Name: PSI_PsaF Pfam Description: Photosystem I reaction centre subunit III
TEVHTQPRSACLVVSTDIAGLTPCKESKAFAKREKNSIKKLTASLNKYAPDSAPALAINATIEKTKRRFENYGKFGLLCGADGLPHLIVSGDQRHWGEFITPGLLFLYIAGWIGWVGRSYLIAISGEKKPAMREIIIDVELATRLLPRGFIWPVAAYRELINGELVVDDKDIGYY

SEQ ID NO: 12181 - DNA, 899 bp, Panicum virgatum
  misc_feature: Ceres CLONE 1761288
  misc_feature: Encodes the peptide sequence at SEQ ID NO. 12182
agaggcagccaccatctaccaagtaccaacccgtgaccaaccagagcagaggcagctctcttggcgtgctctgctcacctcagctcagcttacctcggcttgttccaagattttccctcacctgctcgatatctgtctccttcccccatcccaccgtaaggacaaggggcggagaagcaagaagggtacaacaagagcgcccgtcggcggtcgtccatggcgggggaggccaagcagctcttcgacgcgtccgaggtcgccctccactcgtccaagaaggactgctgggtagccatcggcggaaaggtttatgatgtgaccaagttcttggaggaccaccctgggggagaggatgtgctcctccatgcatcagcctctggggatgccacggaggcatttgaagaggtggggcacagcacgtcagccatcagcatgatggacagcttcctgataagaagcatcaagggctacgtgcgtccaagtgcatcaaaggccacagatccctggggcctggatgcgccaccaaattccaggtcgatgcaagggaacaaaggccctcctaatccgaatacattcctggacttcctactcccgttatttgtgcttggcctggcatttgcagcttggtattacctaaccttcgtctccaagaactattaagctcagtgaggattgtaattattgctcactattagattgctagggttatataagcaaaacatttaaagaatgtaaaccttgtcgtacagtaacttgtacttgaagaggttactggctatgttttagagagacagagaagagaaagaaatgattgtattttgcttaattttcacgaagctgtagttttcttggaaatcctgttcttacatgtaacacctatgtcaacacacagatgtttg

SEQ ID NO: 12182 - protein, 147 aa, Panicum virgatum
  misc_feature: Ceres CLONE 1761288
  misc_feature (8)..(87): Pfam Name: Cyt-b5 Pfam Description: Cytochrome b5-like Heme/Steroid binding domain
MAGEAKQLFDASEVALHSSKKDCWVAIGGKVYDVTKFLEDHPGGEDVLLHASASGDATEAFEEVGHSTSAISMMDSFLIRSIKGYVRPSASKATDPWGLDAPPNSRSMQGNKGPPNPNTFLDFLLPLFVLGLAFAAWYYLTFVSKNY

SEQ ID NO: 12183 - DNA, 615 bp, Panicum virgatum
  misc_feature: Ceres CLONE 1761290
  misc_feature: Encodes the peptide sequence at SEQ ID NO. 12184
cctaccagagcctgagcccggaatcgacggcgccgccggagatggagacggaggcggctgcggcgaggcaggccaaggagtccctggagctggcgttccagatgtcccagatcctcgacaccggcctcgaccgccacaccttgtcgctgctcatggcactgtgcgaccgcggcgccaaccccgaggccctcgccgccctcgtccgcgagctctcctccgccgctcccccaacctcagcggtgtcgacccctctactgtgagcaacggcaccgcggccccggccccggccccatcatccgtgtctctgttcccctccggctccggccttcgccgttcctagggtattgctgaatactgaacgggactatgtcatcattgtgtaacaaaagcaaatgtaaagctggaattgctggatgaaaaggagtgccttctgcattgttgtggcttttgttgagacaagaaatctgtggttcacagaggcactgaaattgacgtatccttccaaggacttgtgcgggttaacagttgtgatcatgaggagtcgttttctttttcattcatcattagattacgtacatcagttgtatgcatcagtttcgcagtcggtcttccgtc

SEQ ID NO: 12184 - protein, 85 aa, Panicum virgatum
  misc_feature: Ceres CLONE 1761290
  misc_feature: Useful for making plants with modulated nitrogen use efficiency
YQSLSPESTAPPEMETEAAAARQAKESLELAFQMSQILDTGLDRHTLSLLMALCDRGANPEALAALVRELSSAAPPTSAVSTPLL

SEQ ID NO: 12185 - DNA, 913 bp, Panicum virgatum
  misc_feature: Ceres CLONE 1761295
  misc_feature: Encodes the peptide sequence at SEQ ID NO. 12186
ctctcccagccggccgcgcgcacccggcgttgcggctcctctcagctagggttcgcctctcctccgccgccctcgtcttcgctttgcagccgcgaccagagcgctccaagtcgagtgtttcgaccagatacgtttgggggaagccggtagggcggcgccaacgaaggaggcggcgccatgaggttggagaagtgctggttctgctcctccaccatctaccccggccatgggatccagttcgtccgcaacgacgccaagatctttcgcttttgccgatcaaagtgtcataaaaatttcaagatgaagaggaatcctcgtaaggttaagtggacaaaagcatacagggccttgcatggcaaagacatgacccaggattcaacctttgagtttgagaggaagaggaacaggcctgagcgctatgatcggaatatgaccgagcaaactctaaaggccatccctgtcattataaaggctaggcatgaacgtctgaagaagcacattaaagacagacacgatcctggtaaaaagaaggcgctggagagagataacaaggagctggagcaggacatcaacatgcttcctaagaagcttttcagtaatgaggctccagctaagaaacaaaaggtcacggtcaaagttgttcagcagcagacagaagatcggatggaagagtagccggatggtattgtgttgcttgtgttcatgtcgtatgcagacctttacttttgagtttcttgagattgccctggtgccatgtagtccatggaagatgttaacatttgtggactgagtatcagagttttgcatgtggtggcagagacatatactggagtggagtcaaaaggatgtgtactctagtggttgttttgtggtactcgcatttaccgaatactggatccttatagctattgcg

SEQ ID NO: 12186 - protein, 165 aa, Panicum virgatum
  misc_feature: Ceres CLONE 1761295
  misc_feature (1)..(75): Pfam Name: Ribosomal_L24e Pfam Description: Ribosomal protein L24e
MRLEKCWFCSSTIYPGHGIQFVRNDAKIFRFCRSKCHKNFKMKRNPRKVKWTKAYRALHGKDMTQDSTFEFERKRNRPERYDRNMTEQTLKAIPVIIKARHERLKKHIKDRHDPGKKKALERDNKELEQDINMLPKKLFSNEAPAKKQKVTVKVVQQQTEDRMEE

SEQ ID NO: 12187 - DNA, 728 bp, Panicum virgatum
  misc_feature: Ceres CLONE 1761325
  misc_feature: Encodes the peptide sequence at SEQ ID NO. 12188
aaaaccctacccgccgccggcgcttgctcctcctccaagcagcgcctccgctcccatctcccgcgcccgcctcgtctcgaacccccgctctccccttcgaccatggcggacgtggaagtggatgcggaggtggcggccgcggggcagccgaagaagaggacgttccgcaagtacagctaccgcggcgtggacctcgacgcgctcctcgacatgtccaccgacgacctcgtccagctcttccccgcgcgtgcacgccggaggttccagaggggtctgaagaggaagcccatggcgctcatcaagaagctgcgcaaggcgaaaaaggatgcacctgccggtgagaagccagagcccgtgaggacccacctccgcaatatgatcattgtgcctgagatgattggtagcatcatcggtgtctacaatggcaagaccttcaaccaggttgagatcaagcctgagatgattggccactacctcgcagagttctccatctcgtacaagcctgtcaagcacggtaggcctggtatcggtgctacccactcctcgaggttcattcccctcaagtgaggccagatatggggttttgttcacttccagagtttggttctccatgtagtttgggcagtcaagttgaactccatatacctgctatgtactgagcgttctattcagaaccttttattaactgttatgttattttgacgtattattttaatcaccttttcacc

SEQ ID NO: 12188 - protein, 154 aa, Panicum virgatum
  misc_feature: Ceres CLONE 1761325
  misc_feature (56)..(137): Pfam Name: Ribosomal_S19 Pfam Description: Ribosomal protein S19
MADVEVDAEVAAAGQPKKRTFRKYSYRGVDLDALLDMSTDDLVQLFPARARRRFQRGLKRKPMALIKKLRKAKKDAPAGEKPEPVRTHLRNMIIVPEMIGSIIGVYNGKTFNQVEIKPEMIGHYLAEFSISYKPVKHGRPGIGATHSSRFIPLK

SEQ ID NO: 12189 - DNA, 863 bp, Panicum virgatum
  misc_feature: Ceres CLONE 1761335
  misc_feature: Encodes the peptide sequence at SEQ ID NO. 12190
gcagaaaaattctctccaaatagcatcccaaaaaagaggaaggaaaaaaaaaagctcgtctccttccccgcagcttgccagcacccggtagtcggcgagcgagagcggccgggcgcgaggatggggtcgagcgaggcggacaagccgctgcggcggatcgcggcgtcgttcgaggagctcgccgccgtcgccaagcagcagcccccaggggccatggacgccgcggcgttctctcgcgcctgctccaacgtctcggtcctcttcggctgcctcggcatcgccttcaagttcgccgagagggactacgtcgccaaggttgatgatttgctggaagcatccaattcaatttcaacattgccctcgatggttgagttagacattcagaaggacactgtcagggcagtagggagccatacaaggaatctgcttagagtgaagcgtggtattgatatggttaaggttctgtttgagaaaatgctggttacagagggcaactcgcttagggatgcagcatcagtagcttatgctcaggtgtttgctcctcatcatggatgggccataaggaaagcagttgctgctggaatgtacgctcttccctcaaagtcccaacttttgaagaaactgaatgaagatgaggagtcggcaaaggctcaagtgcaaaacttcgtcaggtcatcagcaccagtaatccgctacgtcgaagacctgttcacctcaaggaatttgggcatagattggtgaagagaacttgcagatacctttgatgtacttatctagtcagatgatctgcgagctggtgtcacacccggtttcaaggacaaaaccgaatgcatagctatatgtatgccaggatcaagtttcat

SEQ ID NO: 12190 - protein, 206 aa, Panicum virgatum
  misc_feature: Ceres CLONE 1761335
  misc_feature (25)..(204): Pfam Name: GLTP Pfam Description: Glycolipid transfer protein (GLTP)
MGSSEADKPLRRIAASFEELAAVAKQQPPGAMDAAAFSRACSNVSVLFGCLGIAFKFAERDYVAKVDDLLEASNSISTLPSMVELDIQKDTVRAVGSHTRNLLRVKRGIDMVKVLFEKMLVTEGNSLRDAASVAYAQVFAPHHGWAIRKAVAAGMYALPSKSQLLKKLNEDEESAKAQVQNFVRSSAPVIRYVEDLFTSRNLGIDW

SEQ ID NO: 12191 - DNA, 879 bp, Panicum virgatum
  misc_feature: Ceres CLONE 1761341
  misc_feature: Encodes the peptide sequence at SEQ ID NO. 12192
gagacacacccgtcacactcacactccacttcgcactggcagctcaaagatggacaagaaaggagcgaccctgctgctcttcctcgtgctgctcgccgccgcagccgaagccgacgccgtccacggcgccgggcagcgcaaggaggaagtcgctgccgccgctccgacaacgacgcacctccacttctacttccacgacacggtgagcggcaagtcgccgacggcagtgcgcgtggtggagccgccgccggccgcggcgtcgtcgtcgtcgccgacgtccatgttcgggatggtgaacgtgatggacgacccgctgacggcggggcccgagcggggctccgcccccgtcggccgcgcccagggcctgtacatgggctccgaccaggcccggctcggcttcctgcaggccatgaacctcgtcttcacctccggcgcccacaacggcagcacgctggcgctgctcggccgcaactgcccgctcgacgccgtgcgcgagctccccgtcgtcggcggcaccggcgccttccgcttcgcccgcggctacgccctgctgcgcacgcgctggctcgacgcccgcaccggcgatgccaccgtcgagtacgacgtctacgtcatgcactagcacggacggagggagtttggccgacatgagattaccatttgcaaagatgataatggactaatggtgtcactgatgaaggcttttcaagcgtgatgctgtaccatcagaaagtgtttgctttttttatttttcacaaatcagccttcctcttttcacggcttgtagcttgcgtgttccgtgtccatcagaaggttctgagcttttttttttcggaaaagaagcttcacgcaaatctgatggagattatgttggcctct

SEQ ID NO: 12192 - protein, 190 aa, Panicum virgatum
  misc_feature: Ceres CLONE 1761341
  misc_feature (10)..(190): Pfam Name: Dirigent Pfam Description: Dirigent-like protein
MDKKGATLLLFLVLLAAAAEADAVHGAGQRKEEVAAAAPTTTHLHFYFHDTVSGKSPTAVRVVEPPPAAASSSSPTSMFGMVNVMDDPLTAGPERGSAPVGRAQGLYMGSDQARLGFLQAMNLVFTSGAHNGSTLALLGRNCPLDAVRELPVVGGTGAFRFARGYALLRTRWLDARTGDATVEYDVYVMH

SEQ ID NO: 12193 - DNA, 649 bp, Panicum virgatum
  misc_feature: Ceres CLONE 1761349
  misc_feature: Encodes the peptide sequence at SEQ ID NO. 12194
accagaacagctagcaagaaaagcacaccagccatggcgatccggggcgtcgcctcctcccgcgaggacatgacactggaggagttcaaggagtggctcaagcagttcgacggcgacggcgacggccggatcagccggaacgagctccgggaggcgctccgccgccgcggcggatggttcaccacctggaggagcggccgcgcccttcgccacgcagacaagaacaacagcggcttcctggacgactccgagatcgagaacctcgtcgccttcgcccagaaagatctcggcatgaaggtatccacctggtagaagagaacaacgaaccaagcagcgcagggggacagacagctgcaccatcctccagcatcgatctggtgacagaatctggctatgaactgatcgatgagccaccagtgtgtcgttgtattgtagcgcctagtgttaagtttagtgtttacgtgtgtaaccagctgcatgaggatgggcctcctccacggtactgcagagggactcaccctactaatgcatgggtcccccagatcagtgggagtagtgtgtttgcagtactgcagaggaaccccttccgctacatgcatgatgtagagttgtgtgcggctatggctatatccagaaatataagaaattg

SEQ ID NO: 12194 - protein, 92 aa, Panicum virgatum
  misc_feature: Ceres CLONE 1761349
  misc_feature (17)..(45): Pfam Name: efhand Pfam Description: EF hand
  misc_feature: SWISSPROT Homolog: EC 2.7.11.1 Non-specific serine/threonine protein kinase
MAIRGVASSREDMTLEEFKEWLKQFDGDGDGRISRNELREALRRRGGWFTTWRSGRALRHADKNNSGFLDDSEIENLVAFAQKDLGMKVSTW

SEQ ID NO: 12195 - DNA, 721 bp, Panicum virgatum
  misc_feature: Ceres CLONE 1761354
  misc_feature: Encodes the peptide sequence at SEQ ID NO. 12196
actctactacccgtatcacaatcccccgtgaccgctgctccattcttggaagccccggagggagagcggagacgcccggcgcccgcgcgcttggcctcgaggtcccagacacccaaacaaagatggcaacttcgacatctccagttctctgcaacttcatggccatcgcacagaacaacacgcttgtgctgaacaagagcacaaagcggtccctgctgcagctgagcttcccgaggggcacgccgacactgccggacttgagagcgaggcaggacgtccgcgtcgccgccgtctacaaggtgaagctcatcgggccggaggggaaggagagcgtggtcaaggtgccggaggacagctacatcctggacgcggccgaggaggccgggctcgacctgccctactcctgccgcgccggcgcctgctcctcgtgcgccggcaaggtcctgcagggctccgtcgaccagtcggaccagtcgtacctcgacgacgagcaggtcggcgccgggtacctgctcacctgcgtcgcgtacccgacctccgactgcgtcatccagacgcaccgggaggcggacctgtactagctagtagtagccctgtgccactcccgcagctccattcagactcgagcttgagttctcttgacattgcgatttcgcatcgatctgtacttgtcgctggatcttagctactagactccttaatcgtcatcctccatccacgt

SEQ ID NO: 12196 - protein, 152 aa, Panicum virgatum
  misc_feature: Ceres CLONE 1761354
  misc_feature (63)..(139): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase
MATSTSPVLCNFMAIAQNNTLVLNKSTKRSLLQLSFPRGTPTLPDLRARQDVRVAAVYKVKLIGPEGKESVVKVPEDSYILDAAEEAGLDLPYSCRAGACSSCAGKVLQGSVDQSDQSYLDDEQVGAGYLLTCVAYPTSDCVIQTHREADLY

SEQ ID NO: 12197 - DNA, 481 bp, Panicum virgatum
  misc_feature: Ceres CLONE 1761373
  misc_feature: Encodes the peptide sequence at SEQ ID NO. 12198
atcgctaggcgatcgaacagaacctgctcctcctccatcgtgatccgcgagccgccgcttcctcagccatgggtaaggtgcacggatcgttggcccgtgccgggaaggtccgcggccagacgcccaaggtggcgaagcaggacaagaagaagaagccccgcggccgcgcgtacaagaggatgcagtacaaccgccgattcgtcaccgccgtcgtcggcttcggcaagaagcgcgggcccaactcatcagagaagtaggcgccgcgccgcgcagccgccggctcgccccgctccggttcctcctttccgttctcagtatgcttatgctcttgttggtagtagtttcgttgtgcaagcaaaggaagaaccttttgtagtttcagtttcgttgttcatgtgatgtgatgggaacttgagatggtatgtttaccccgtttaagagtttgagatgtgatgatatgagcccataactttattgtgct

SEQ ID NO: 12198 - protein, 62 aa, Panicum virgatum; identical to SEQ ID NO: 10043
  misc_feature: Ceres CLONE 1761373
  misc_feature (3)..(61): Pfam Name: Ribosomal_S30 Pfam Description: Ribosomal protein S30

SEQ ID NO: 12199 - DNA, 888 bp, Panicum virgatum
  misc_feature: Ceres CLONE 1761376
  misc_feature: Encodes the peptide sequence at SEQ ID NO. 12200
atccatatccaggcagaagcaaacggcaaccgcttcctttttcttcctggaacgtgccgcccgcgctgcctgcgatagtgctatccactcccacactccccatggccgccactttcctcgcaagcctcaacgcaccaccggcggcggcggctgctgctgctacaggctgcggccatgccttctccgggtctgggagcagccgagcaacgccgccgccgcgcacggtgacatgccaggcgtccaggagatcagcctccctccacctcggcatcgccgctgcagccgccgtcctgctccggcagcccgacgccgcccgcgccgccgaggacgagccggccaacaacgggtggtggctcaccgagttccccttgccggtgcccaagatcctcaacaaggagatcaacaacccggagacggggacgcgctccttcctcaagaacggcatcttcatggcggacatcggccccagcttcgcggcgcacgcgtacaggctgcgcagcacggccttcgacctgctggcgctggaggacctgctcggcaaggaagcctccaactacgtcaacaagtacctccgcctcaagtccaccttcatgtactacgacttcgacaagctcatcaccgccgccgacgacaagccgcccttcgtcgacctcgccaaccgcctcttcgacagcttcgagaccctgcagcaggccgtcaccgccaaggacgacaccaagataggcgaacgctacgccgagacaaaggtcatcctccaggagctcatggcgaaaatggcatagcatagcaccagctctcccgattcaactcataatgtaaatcctaatatcgccagaatttgcaaatccagagttgcaccagaatcagtggtttacgagtttgtaccag

SEQ ID NO: 12200 - protein, 226 aa, Panicum virgatum
  misc_feature: Ceres CLONE 1761376
  misc_feature (26)..(226): Pfam Name: PsbQ Pfam Description: Oxygen evolving enhancer protein 3 (PsbQ)
MAATFLASLNAPPAAAAAAATGCGHAFSGSGSSRATPPPRTVTCQASRRSASLHLGIAAAAAVLLRQPDAARAAEDEPANNGWWLTEFPLPVPKILNKEINNPETGTRSFLKNGIFMADIGPSFAAHAYRLRSTAFDLLALEDLLGKEASNYVNKYLRLKSTFMYYDFDKLITAADDKPPFVDLANRLFDSFETLQQAVTAKDDTKIGERYAETKVILQELMAKMA

SEQ ID NO: 12201 - DNA, 488 bp, Panicum virgatum
  misc_feature: Ceres CLONE 1761393
  misc_feature: Encodes the peptide sequence at SEQ ID NO. 12202
attgtgtcgtccttacgcatagctagggtttgcgactgcagcgctcgtggcctctcccaagcgcagcaagcatgccgaagcaaatccatgagatcaaggacttccttctcacagcgagaaggaaggatgcccgctccgtgaggatcaagaggagcaaggatgccgtcaagttcaaggttcgctgctccaagtacctctacacactgtgtgtctatgacactgagaaggccatcaagctgaagcagtctctgcctcctggcttgagcgtgcaggaggtttaagctttggaaatagtgactacagcaccgatgctggttgcttcaaagatttgccaatctaccttaaatttagtttctgtatgtgacctccgactgttttaaatgaattgctgtgattgagacgaaatgttatgtggaagtaatgtgatggctggcgagcctcgaatgactcgttcttctcttttctcttttcaaaacagcgcatttctc

SEQ ID NO: 12202 - protein, 69 aa, Panicum virgatum
  misc_feature: Ceres CLONE 1761393
  misc_feature (2)..(69): Pfam Name: Ribosomal_L38e Pfam Description: Ribosomal L38e protein family
MPKQIHEIKDFLLTARRKDARSVRIKRSKDAVKFKVRCSKYLYTLCVYDTEKAIKLKQSLPPGLSVQEV

SEQ ID NO: 12203 - DNA, 790 bp, Panicum virgatum
  misc_feature: Ceres CLONE 1761424
  misc_feature: Encodes the peptide sequence at SEQ ID NO. 12204
agccgaccacaccactccaccccgccgccgcaggcgagaagcagctccagctcaggtaagggcggccgccgccggggagggcgcgcctgcgaagatgcagatcttcgtgaagacgctgacggggaagaccatcacgctggaggtggagtcctcggacaccatcgacaacgtgaaggccaagatccaggacaaggagggcatcccgccggaccagcagcggctcatcttcgccggcaagcagctggaggacgggcgcaccctcgccgactacaacatccagaaggagtcgacgctgcacctggtgctccgcctccgcgggggagccaagaagcgcaagaagaagacgtacaccaagcccaagaagatcaagcacaagcacaagaaggtgaagctcgccgtgctccagttctacaaggtggacgacgccaccggcaaggtcacccgcctccgcaaggagtgccccaacaccgagtgcggcgcggggaccttcatggccaaccacttcgaccgccactactgcggtaagtgcggcctcacctacgtctacaaccagcaggcgtaggatggatgctccgctgttgtggtgagggaaaggaaaaaaaatggaaagtcttgctagatgataaatcttatttctttttttgtcgcatgttaagttaaagtagtttgttggaacagaacacctgcatctctcatggtgatgcgtacttttggttttgatgatatgatgtcgttatggatcgcaccaaacactgttgaattcaacctatgtttgtgttaatcttatact

SEQ ID NO: 12204 - protein, 155 aa, Panicum virgatum; identical to SEQ ID NO: 10031
  misc_feature: Ceres CLONE 1761424
  misc_feature (6)..(74): Pfam Name: ubiquitin Pfam Description: Ubiquitin family
  misc_feature (101)..(148): Pfam Name: Ribosomal_S27 Pfam Description: Ribosomal protein S27a
  misc_feature: Useful for making plants with modulated nitrogen use efficiency
  misc_feature: Useful for making plants with modulated cold sensitivity
  misc_feature: Useful for making plants with modulated flowering time

SEQ ID NO: 12205 - DNA, 787 bp, Panicum virgatum
  misc_feature: Ceres CLONE 1761429
  misc_feature: Encodes the peptide sequence at SEQ ID NO. 12206
aaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggccctccggctg

SEQ ID NO: 12206 - protein, 224 aa, Panicum virgatum
  misc_feature: Ceres CLONE 1761429
  misc_feature (31)..(224): Pfam Name: Beta-lactamase Pfam Description: Beta-lactamase
  misc_feature: SWISSPROT Homolog: EC 3.5.2.6 Beta-lactamase
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALR

SEQ ID NO: 12207 - DNA, 894 bp, Panicum virgatum
  misc_feature: Ceres CLONE 1761444
  misc_feature: Encodes the peptide sequence at SEQ ID NO. 12208
gcccctgcacaatacacacccacacagcagggagagcccctcggcggcggagaagatggtgtcgctcaagctgcagaagcgcctcgcggccagcgtgctcaagtgcggcaagggcaaggtctggctcgaccccaatgaagtcagcgagatctccatggccaactcccgccagaatatccgcaagttggttaaggatggtttcatcatcaagaagcctcagaagatccactccaggtcccgtgcaaggagggcgcatgaggccaagcagaagggacgtcattctggatatggtaagcgcaggggtaccagggaggctaggctccccaccaagattctttggatgaggaggatgcgtgtgctgaggcgcctgctgcgcaagtaccgtgaagccaagaagatcgacaagcacatgtaccatgacatgtacgtgaaggtcaagggtaacatgttcaagaacaagagggtgctcatggagagtatccacaagtccaaggctgagaaggtcagagagaagacgctctctgatcagtttgaggcgaagcgcgccaagagcaaggcaagccgtgagaggaagattgccaggagggaggagaggttggcccagggcccgagggaacctgcagctccagcagctgcagctccggctgcagcggcgccaaagaaggccaagaagtgaagggttgatctgaagctttagctctctggtaccaggagtagcctaattttggagcgcctctaaactgttttgctgttattgttatatatatccaaactcttgtaccttgatatctctgaatatcaactttgtttatgttgggttggataatgtagtggacttgtttatgcagggttttctttgcaacagatcaatgagaatcccattacgttttatgg

SEQ ID NO: 12208 - protein, 206 aa, Panicum virgatum
  misc_feature: Ceres CLONE 1761444
  misc_feature (2)..(149): Pfam Name: Ribosomal_L19e Pfam Description: Ribosomal protein L19e
MVSLKLQKRLAASVLKCGKGKVWLDPNEVSEISMANSRQNIRKLVKDGFIIKKPQKIHSRSRARRAHEAKQKGRHSGYGKRRGTREARLPTKILWMRRMRVLRRLLRKYREAKKIDKHMYHDMYVKVKGNMFKNKRVLMESIHKSKAEKVREKTLSDQFEAKRAKSKASRERKIARREERLAQGPREPAAPAAAAPAAAAPKKAKK

SEQ ID NO: 12209 - DNA, 715 bp, Panicum virgatum
  misc_feature: Ceres CLONE 1761455
  misc_feature: Encodes the peptide sequence at SEQ ID NO. 12210
tcatcacttcccgtccgccgcagcctgccgccaggaggggtaagtccaggaggtagttttgagaagcgcaaaatggctcctaaagctgctcctgtgaagaaggatgccaagacccaggccttgaaggttgccaaggctgtgaagtctggggcagtgaagaagaagaccaagaagatcaggacgtcggtgacatttcaccgccccaagaccctgaagaaggctagggacccgaagtacccaagagtcagcgctcctggaaggaacaagcttgatcagtaccaaatcctgaagtatccccttaccacggaatcagcaatgaagaagatcgaagataacaacactctggtcttcatcgtggacctcaaggcggacaagaagaagatcaaggctgctgtcaagaagatgtatgacatccaggcaaagaaggtcaataccctgatcaggcctgatggtaagaagaaggcatatgtgaagctgacaccggactacgatgctcttgatgtggccaacaaaatcggcatcatctaaggctactttgttaggcatctgtgtcctagttctatgtgaaacgagagttttgtagctattccttatttagggccgcagtggctccattaccttgtcttgatgcacacttgaatttggtaccgtccaagtgaccagttgagctaatttgagctttgcacttgcttatactatcagttactttattagc

SEQ ID NO: 12210 - protein, 151 aa, Panicum virgatum
  misc_feature: Ceres CLONE 1761455
  misc_feature (69)..(148): Pfam Name: Ribosomal_L23 Pfam Description: Ribosomal protein L23
  misc_feature (10)..(63): Pfam Name: Ribosomal_L23eN Pfam Description: Ribosomal protein L23, N-terminal domain
  misc_feature: Useful for making plants with modulated nitrogen use efficiency
MAPKAAPVKKDAKTQALKVAKAVKSGAVKKKTKKIRTSVTFHRPKTLKKARDPKYPRVSAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 12211 - DNA, 902 bp, Panicum virgatum
  misc_feature: Ceres CLONE 1761471
  misc_feature: Encodes the peptide sequence at SEQ ID NO. 12212
atactcccgaaaacctcacaaaaccctcgctccccaccacccgccgccgcccgcgccgccgcctccacctgccgcgacaaagatgagtcggcaccctgaagtgaagtgggctcagaggattgacaaggtttacatcacagtacagttatctgatgcaaaggatgctaaggtcaatttggagccagatggtgtcttcacattctctggcagtgctggtacaaacttgtatgaattgaaactagatctgaatgacaaagtcaacgtggaggctagcaagataagtgtgggtgacaggtccatattctgtgtcgtagaaaaagctgaagccaaatggtggaagaagcttgttcgggatgatcaaaaggcacctcactttgtgaaagtcgattgggacaaatgggtggatgaagatgatgatggtggtgatgtcaacttggatgggatggacttctcgaattttggtggcatgggcggtatgggcagcatgggtgatatggctggtctgggcggcatgggtggtatgggtggtctgggcggcatgggtggtatgggtggtctgggcggcatgggtggtatgggaatggatgagtttgaagatgagagtgatgatgaagaagaggtgtcaaagcctcaagctgcggagaaggctgttgaggctgagaagacggaggcagctgaagccaagacagagactgctcagagcagttgaagagggttctggcatgatccaaaatagattgtatccgcatgttctatggattccacctagcctggaggaaaaccttttacgctgtggcactggctggcatgtcccagtgacttgccaagagaactagcgttggtctttcgactgggcatcctactgttgcgcccagcatattatggatttctgatattgtttc

SEQ ID NO: 12212 - protein, 208 aa, Panicum virgatum
  misc_feature: Ceres CLONE 1761471
  misc_feature (5)..(79): Pfam Name: CS Pfam Description: CS domain
  misc_feature: SWISSPROT Homolog: EC 5.3.99.3 Prostaglandin-E synthase
MSRHPEVKWAQRIDKVYITVQLSDAKDAKVNLEPDGVFTFSGSAGTNLYELKLDLNDKVNVEASKISVGDRSIFCVVEKAEAKWWKKLVRDDQKAPHFVKVDWDKWVDEDDDGGDVNLDGMDFSNFGGMGGMGSMGDMAGLGGMGGMGGLGGMGGMGGLGGMGGMGMDEFEDESDDEEEVSKPQAAEKAVEAEKTEAAEAKTETAQSS

SEQ ID NO: 12213 - DNA, 710 bp, Panicum virgatum
  misc_feature: Ceres CLONE 1761482
  misc_feature: Encodes the peptide sequence at SEQ ID NO. 12214
ctgaagtccaaaggggcaaaccagaagttgcagttcgcctcctcctcctcttctccgtcggctcagatctctctgcgtgcgcgcggctgcgatggcgtctttctcggaggctccccccggtaaccccaaggcgggcgagaagatcttcaagaccaagtgcgcgcagtgccacaccgtcgagaagggcgccggccacaagcaaggtccaaacttgaatggtctctttgggaggcagtccggtaccactgctggatactcctactctgcaggaaacaagaacaaggctgtggtctgggaggagaacactttgtatgagtacctgcttaaccctaagaagtacattcctggaaccaagatggtcttccctgggctgaagaaaccgcaggagcgtgctgatctcattgcatacctgaaggaagccactgcatagaaaaatggcatgctgaaccatgaagcaattcgttttacagtttaataaagaggtttagacaattcgggtcactctggttgaacagggtgcaatccacgagacaattattgagcattttggttcttatgtttgtttcgaatgtctaggtgtttagctgaacaaaaaacagtcaaaactttgactgctgcttgtttcaactgctggagaaatcccagcgccctatttttgaccaccgggtggtggaactggaaatctggaatgcacccattttgaaggatcg

SEQ ID NO: 12214 - protein, 112 aa, Panicum virgatum
  misc_feature: Ceres CLONE 1761482
  misc_feature (12)..(111): Pfam Name: Cytochrom_C Pfam Description: Cytochrome c
  misc_feature: SWISSPROT Homolog: EC 1.9.3.1 Cytochrome-c oxidase
MASFSEAPPGNPKAGEKIFKTKCAQCHTVEKGAGHKQGPNLNGLFGRQSGTTAGYSYSAGNKNKAVVWEENTLYEYLLNPKKYIPGTKMVFPGLKKPQERADLIAYLKEATA

SEQ ID NO: 12215 - DNA, 725 bp, Panicum virgatum
  misc_feature: Ceres CLONE 1761495
  misc_feature: Encodes the peptide sequence at SEQ ID NO. 12216
ctgaagtaccgcacgttcagttcagggaacagagcagcagcacaggcgtcgccatggcctcccagctctccgccgccgcgtccatgtccgccgccgtgccgcagttccacggcctccggggccggtccgtggcggcgctgccgccggcgagggccggcaggaagcgggcgcagggcatccggtgcgactacatcggctcggccaccaaccagatcatggtggtgtcgacgacgctgatgctggtggcggggcggttcgggctggcgccgtcggcgaaccggaaggcgacggcggggctgaagctcgagtcccgcgactccggcctgcagaccggcgaccccgccgggttcacgctcgccgacacgctggcctgcggcgccgtcggccacatcatcggcgtcggcatcgtgctcgggctcaagaacaccggcgcgctcgaccagatcatcggctaggtccagtgtctgcctttgccgctctcggcgccggcccggtgcccatgtaacctgcgtgtgtacatcgactctgcgctcatgcatctcgttccaatggacatagcttgtttgttgctcagaaaaaaaaaaaaaaaaaaaactcgaggtcgacggtatcgataagcttgatatcgaatacttccttttcctgttttccctcttgcataagagctgttccattgtgggtccggtttttcatctggctagcctacctaggcagcgatgccatgg

SEQ ID NO: 12216 - protein, 133 aa, Panicum virgatum
  misc_feature: Ceres CLONE 1761495
  misc_feature (48)..(128): Pfam Name: PSI_PSAK Pfam Description: Photosystem I psaG / psaK
MASQLSAAASMSAAVPQFHGLRGRSVAALPPARAGRKRAQGIRCDYIGSATNQIMVVSTTLMLVAGRFGLAPSANRKATAGLKLESRDSGLQTGDPAGFTLADTLACGAVGHIIGVGIVLGLKNTGALDQIIG

SEQ ID NO: 12217 - DNA, 873 bp, Panicum virgatum
  misc_feature: Ceres CLONE 1761501
  misc_feature: Encodes the peptide sequence at SEQ ID NO. 12218
accgttcatttctattctagctccgccactgaggagctcctcctcctcctcgtcatcttcctcctcgtaccacctcggggaggtttggtccgatgcaaagaagctgttgcgcaaggtggtggctatgttgaaaagatggcactgtctctgcacggaaggaaatgcgctgcaactaaaggaggttgtccggcagatggagggtgaattattatcaagagggggatcatgtacatccccatctggactcctctactgctttccgaagagcactaaccacctgggcatcatgggttgaccgttacatctatccacggccaaaagtgtttttccgaagctcatccccatcacatttcagcggtggagagtggaattcagggggacactgcaaagagagcacgtggccccttaatgatacccgagctaggcaggtgcctgagagaaacttgatcctggaacaagtcacaaagcaaatgaagaatcctgtgacaattctgaacattaccaatctatctgggataaggatagacggtcacccatctgtatatggccggatggtggttgatttaacagcatcaagcgttcaggattgcagccattggtgcctccctggagtcccggatacatggaatgagctgttattctaccatcttgtattgtcgcaagaaaaggatgtagcaagttagtgactgaattaattggcatcttttttttattagatagggtctttattctcgtctgtaaatgtatatttgatctggaagcacagtacaaatgtgctatcatgcttgtccccgtccctaacgtgtcatgcattgctgtcaggttcagaagtacttgcaacaataaattgaaaaccttatgattgaactggtc

SEQ ID NO: 12218 - protein, 70 aa, Panicum virgatum
  misc_feature: Ceres CLONE 1761501
  misc_feature: Useful for making plants with altered cell wall content and/or composition
  misc_feature: Useful for making plants with modulated nitrogen use efficiency
MKNPVTILNITNLSGIRIDGHPSVYGRMVVDLTASSVQDCSHWCLPGVPDTWNELLFYHLVLSQEKDVAS

SEQ ID NO: 12219 - DNA, 848 bp, Panicum virgatum
  misc_feature: Ceres CLONE 1761506
  misc_feature: Encodes the peptide sequence at SEQ ID NO. 12220
gcaagcaaccatccatccacagcaagagaaggaagcaagcagcgacacagcgagcgaaacccgtgtctcgaagcaacctggtgcctagcttgccagttgccactcgacctctccgctccaccgccccgtgcacaactccaacggcagccacggtgatggcctccctcgccttcgccaccgccggcgcgcgtgccggcgtcctccccgtccgcgtcccggcggccgccgcgctcgcgccgcgccgacgcgccctggtcgtcagagcccaggccgaggatgctaagccaacaacggaggagacaaccgcggcgtcctcggcctcgccttctccggcgccctccactcccctgacggcgaagccaaaggcggcgagccccgggctgtgggacgcgctggcgttcagcggcccggcccccgagcgcatcaacgggcggctcgccatggtgggcttcgtgtccgcgctcgccgtcgaggcgtcccgcggcgggggcctcctctcgcaggccggcagcgggtccgggctggcctggttcgcggccacggccgccgtgctctccgtggcgtccctagtgccggtcctcaggggggagagcgccgaggcccgcagcggcggcgtcatgagcgccgacgccgagctctggaacggccgcttcgccatgctcgggctcgtggcgctcgccgtcaccgagtacatctccggcgcgcccttcatcaacgcgtaggtgccaacggtcttgcgtggagttggaccccgtgtggtgtgcattcaatttgtacctgtaaaccctgcaggttctctgttctgtccttgtacatcaactagctaggaaaattcaacatgttattcc

SEQ ID NO: 12220 - protein, 188 aa, Panicum virgatum
  misc_feature: Ceres CLONE 1761506
  misc_feature: SWISSPROT Homolog: EC 4.99.1.1 Ferrochelatase
MASLAFATAGARAGVLPVRVPAAAALAPRRRALVVRAQAEDAKPTTEETTAASSASPSPAPSTPLTAKPKAASPGLWDALAFSGPAPERINGRLAMVGFVSALAVEASRGGGLLSQAGSGSGLAWFAATAAVLSVASLVPVLRGESAEARSGGVMSADAELWNGRFAMLGLVALAVTEYISGAPFINA

SEQ ID NO: 12221 - DNA, 850 bp, Panicum virgatum
  misc_feature: Ceres CLONE 1761524
  misc_feature: Encodes the peptide sequence at SEQ ID NO. 12222
gagccgcacgcagcctctgcgttccgccggcaggtcaactcagacagagcaagcgccgccgccgcggacttgccggtggtttcgggcccccgaccggaccggaccggacgggatgcagtcgctgcaggacaaggcgtcggagtggagcggcgtggcggccgccgacgccttcgccatcgacgacggcaacatcttcgaggccctcggcggcatcccgcagcccttcgtcgacctctccaccaatttctacaccagggtgtacgaggatgaggaggagtggttccgcgagatattcgcggtgttgaagaaggaggacgccacccagaaccagtacgagttcctgatccagcgcatgggcggcccgccgctcttctcccagaggagaagacatcctgcccttataggacgacatcgaccattcctggtaacccaccgagctgcagagcggtggctgcaccacatgcagcaagctttggatacaactgaaagcatagatgctgactcaaaaaccaaaatgatgaactttttcaggcacactgcttacttcctcgttgctggcaatgagatgactaggcagcagagccaaggagtagcctgcaagcatgcaacaagcaaacgagctgagtaaccatcctagccttggagctagtaaccatctgaatagaatcatggaagcctttgcccactgcgccattatagaatccatatacaatggagttcgaaacgccttcacattcaaagaaacaattgcactgactctttgtaggctttatagccacttttgagcagagacagagtactcaaaattgataatcttaattagcttgttccaatatatgttattctgctt

SEQ ID NO: 12222 - protein, 171 aa, Panicum virgatum
  misc_feature: Ceres CLONE 1761524
  misc_feature (26)..(146): Pfam Name: Bac_globin Pfam Description: Bacterial-like globin
MQSLQDKASEWSGVAAADAFAIDDGNIFEALGGIPQPFVDLSTNFYTRVYEDEEEWFREIFAVLKKEDATQNQYEFLIQRMGGPPLFSQRRRHPALIGRHRPFLVTHRAAERWLHHMQQALDTTESIDADSKTKMMNFFRHTAYFLVAGNEMTRQQSQGVACKHATSKRAE

SEQ ID NO: 12223 - DNA, 690 bp, Panicum virgatum
  misc_feature: Ceres CLONE 1761567
  misc_feature: Encodes the peptide sequence at SEQ ID NO. 12224
atcgctcgcataggcaatctgctccctcttcctctcggctagccggcctcaattcgtggcgtagggcaaaggcggcggcgagcgagcgaggatgctggagagccgggcggtgatcggggacacggacatgctgcaggcgatgcagcaggaggcgctgcggctggccgggaaggcgctggactacttcgaggccgtcgactccaccgagatcgcccggttcatcaagaaggagtttgaccggtcgtacgggcccggttggcagtgcatcgtgggcaccgacttcgggtccttcgtgacgcaccactccggctgcttcatctactttggcatcggcaacctggccatcctgctgttcaacggcggcgacggcgcggctcctcacggtgccgccggtgagaaggcgcggctcacggcgcggtgaaggctgctgtcagaggcgtgagggaatgttatgatcacttattgtggacttgtggtgtcactcgaaggggatgatagtgtagtgatcaaacatacaagtccttacttggtaaaaaaaaactaaaaatccttgttctcgcggcatgtctgctgggtaaactagaagaaagtgatggcaaatacgcagtggaaattcacatgcattttcattttcgccagcgtctagtgtggcttttgtctaatcacacaccactccgggtccttcagttc

SEQ ID NO: 12224 - protein, 109 aa, Panicum virgatum
  misc_feature: Ceres CLONE 1761567
  misc_feature (1)..(91): Pfam Name: Dynein_light Pfam Description: Dynein light chain type 1
MLESRAVIGDTDMLQAMQQEALRLAGKALDYFEAVDSTEIARFIKKEFDRSYGPGWQCIVGTDFGSFVTHHSGCFIYFGIGNLAILLFNGGDGAAPHGAAGEKARLTAR

SEQ ID NO: 12225 - DNA, 485 bp, Panicum virgatum
  misc_feature: Ceres CLONE 1761586
  misc_feature: Encodes the peptide sequence at SEQ ID NO. 12226
ttaacagacaatatcaacaatggcaaacttgattattactattatcttattgccatcctgggagtactgaatcttttctacttccttgtatgctctcactattatcaatataaggacatgtcattccatgatgaagagtccatcaaaacccatgccaaggaagaagcagctacagagattgagatcgagatcgtcacaagtgcaacaagcaaatgaaaatttcaatggtgatttatagtatgcagacttagtgacaattaagattcagtttgtaagatgccttatagtaacatattatcttatgaagaagtgaattacagttcagccagccatggtgactctgttatcaaaacaacagtaaataaggtctattattttggaactacattaagttttaacaaagtctgtcatactccagtagaagctaagggtgcctgtaatatgtgtaacatgtaagcacaggcagaatgcaccaatttcttcac

SEQ ID NO: 12226 - protein, 71 aa, Panicum virgatum
  misc_feature: Ceres CLONE 1761586
  misc_feature: Useful for making plants with altered carbon content
  misc_feature: Useful for making plants with altered nitrogen content
  misc_feature: Useful for making plants with modulated carbon-nitrogen partitioning
LTDNINNGKLDYYYYLIAILGVLNLFYFLVCSHYYQYKDMSFHDEESIKTHAKEEAATEIEIEIVTSATSK

SEQ ID NO: 12227 - DNA, 863 bp, Panicum virgatum
  misc_feature: Ceres CLONE 1761587
  misc_feature: Encodes the peptide sequence at SEQ ID NO. 12228
gagagaggagaacaggggagagagagctgtggggagggagagagcgcgcgcgtttggatcggcgatggatgccggagcgaaggtgccgaggaaggccgcggcggggcgtcgcggcggcggcgggcccaagaagaagccggtctcccgctccgtgaaggccggcctccagttccccgtcggccgtatcggccgctacctcaagcagggccgctactccaagcgcatcggcaccggcgcccccgtctacctcgccgccgtcctcgagtacctcgccgccgaggtcctcgagcttgcggggaatgcggcgcgggacaacaagaggaaccggatcatcccgcggcacgtgctgctggcgatccgcaacgacgaggagctcgggaagctgctggccggcgtcaccatcgcgcacggcggggtgctgcccaacatcaaccccgtgctcctccccaagaaggccgcctctgccgccaccaaggaagtcaaggagggtaaggggacgaaatcacccaagaaggccgccaccaagtcgcccaagaaggcggccgccgcgtaggtccgggcaaatggtggtgccctgtctctcgctatctccctgtgcgctctgaattgaaacgctcctatctgtcgtcgtcatcgtgatctttactgcttgtcgtggttgtttgtgtgtaattgcgtgccctttgctcaatcatcatgcactgtgtaggttgacactggtgtctaggttcgatctgaaaaccaccggtttaggtttggaggagtgtgaactgtgaagggcaatggaggcgtgggaactgtgaatcattaggtgctgtttgtaataagattgtgaagatgtgtaaaatgatgggcctccattc

SEQ ID NO: 12228 - protein, 162 aa, Panicum virgatum
  misc_feature: Ceres CLONE 1761587
  misc_feature (28)..(101): Pfam Name: Histone Pfam Description: Core histone H2A/H2B/H3/H4
MDAGAKVPRKAAAGRRGGGGPKKKPVSRSVKAGLQFPVGRIGRYLKQGRYSKRIGTGAPVYLAAVLEYLAAEVLELAGNAARDNKRNRIIPRHVLLAIRNDEELGKLLAGVTIAHGGVLPNINPVLLPKKAASAATKEVKEGKGTKSPKKAATKSPKKAAAA

SEQ ID NO: 12229 - DNA, 723 bp, Panicum virgatum
  misc_feature: Ceres CLONE 1761594
  misc_feature: Encodes the peptide sequence at SEQ ID NO. 12230
agcaacgcctcgtacagtttcttcgtgacagcaagtaaaagccataccaaaactaccacaagaaaagtttttgtagcagctagctgttgcaaatggcgtcgacggtggcgagcctcaccaccccggcgaccttcgcggccgccgacgtggtcccgaggagaaaggtcgtcgccggccgcgtctggttccccgtggcgcgccgcggcggcttcgccgtgatgaggtcgagcgggcctgcgacgccgccggggatctccgacaaggtgtcggagagcatcaagaaggcggaggagacgtgcgcggaggagacggcctccggggagtgcgcggcggcgtgggacgaggtggaggagctcagcgccgcggcgagccacgcccgggacaagctcaaggagaacagcgacccgctggagaactactgcaaggagaaccccgaggccgacgagtgccgcacctacgacaactagagcgcgcatgtatatatgctaaatttgccgtacacgatcgaaggatagcgaagtgaagaagtggctatgtaagccggtgaatttgcacgaagcttcatatctctccgcctgtatcatcctgcatattacttgcttgcgtgttgcaaattatatatagttataattttaaaagtaaaatacacggccagtcctcgaacttgttgggtgtgtgtcatcccgatccctaaatttataaaggtagaaatctggattttcg

SEQ ID NO: 12230 - protein, 124 aa, Panicum virgatum
  misc_feature: Ceres CLONE 1761594
  misc_feature (54)..(124): Pfam Name: CP12 Pfam Description: CP12 domain
MASTVASLTTPATFAAADVVPRRKVVAGRVWFPVARRGGFAVMRSSGPATPPGISDKVSESIKKAEETCAEETASGECAAAWDEVEELSAAASHARDKLKENSDPLENYCKENPEADECRTYDN

SEQ ID NO: 12231 - DNA, 616 bp, Panicum virgatum
  misc_feature: Ceres CLONE 1761595
  misc_feature: Encodes the peptide sequence at SEQ ID NO. 12232
tcccggctcagcctcttccgttgcagcgccgccgccgcctccatctcgggcgcattccccactcctctccgccgccgccgagctcgagcaagccctgcaagatggtgctccagaacgatatcgacctgctcaaccccccggctgagctcgagaagctcaagcacaagaagaagcgcctcgtgcagtccccgaactctttcttcatggacgtcaagtgccagggatgcttcagcataaccactgttttcagccactcccagactgttgtggtgtgcccgggctgccaaactgtcctctgccagcccactggaggaaaggctaggctcacggagggctgctccttccgccggaagggagactagaatgtactctggaagatgatgtttgtactgagccaagtttttcacttgagtatgtagccttcaaattttgcgctatgtgaaatgttagggtcctgaactgctgcttaggctttcaatatctattccaatgttatgtgctggatgctactcaatgttctgtttgacacctcctttgtctaattagctggggttgttttggattataatgaacacaagtggtgaaattgttaaattattgctctcggttggcttgc

SEQ ID NO: 12232 - protein, 86 aa, Panicum virgatum; identical to SEQ ID NO: 9875
  misc_feature: Ceres CLONE 1761595
  misc_feature (30)..(84): Pfam Name: Ribosomal_S27e Pfam Description: Ribosomal protein S27

SEQ ID NO: 12233 - DNA, 884 bp, Panicum virgatum
  misc_feature: Ceres CLONE 1761609
  misc_feature: Encodes the peptide sequence at SEQ ID NO. 12234
gcatagagcttgatgctcgtgttgaataaaaaaaaaagcacgcgcaagagggtgcgcccgtccgaggaggcctcgtcgccgcccgtgtacctgacggcgtgcgggtgcggcgcccgtgcagcccgctccgtcgttcctcacgctgccgctgcctgcctcggagccgatcgagctcggaacctctcgcccccgcaccgagggatagagcttgcccgctcggcagggcccgccgccgtccgcttctacgcgcaaccctaggaaggattcatttgggtgagaaagaagaaccgattctgcgcgtcgtcgccgagctttgtccgtagaggagacaagggcgagcagaggcgccgagatgactcgcggcaaccagagggatcgcgaccgcgagcgcgcggcggcgcggaagcccaacgccaaggggccccaggacgggcttaccccggagcagcgccgcgagagggacaagaaagcgctggaggagaaggcggccaagaaggcgcagcaggcggcggccggcgccgccggtacctccactgacaacaagaacaagggcggcggcaagaagtagggcgccgccaacgcgcgaggcgcaacctctgtacgattatcgatgccattagcttgtaccttcgcatctacatagatgcgatgtttgttgggtcataaactcgtcgtctgcaagctttcagttacccgatacatcatgaattgatgatgacaatacaataatacatggtgatgacaataattctgtgactttggtattgatgaatcttttgagtatcataagcatacagggtgcatgagctattctaagagaactcttgccatatgtaaacaacagtctactagcatgttgaaacaggaaaccaaaaacaaaaagc

SEQ ID NO: 12234 - protein, 71 aa, Panicum virgatum
  misc_feature: Ceres CLONE 1761609
  misc_feature (1)..(56): Pfam Name: 4F5 Pfam Description: 4F5 protein family
MTRGNQRDRDRERAAARKPNAKGPQDGLTPEQRRERDKKALEEKAAKKAQQAAAGAAGTSTDNKNKGGGKK

SEQ ID NO: 12235 - DNA, 687 bp, Panicum virgatum
  misc_feature: Ceres CLONE 1761628
  misc_feature: Encodes the peptide sequence at SEQ ID NO. 12236
agatctgcggccgctccccccacgactcccaccgcagcaagagcacgattgtagcaggaggtcggaggagctacggcagcggaggcacagatgagcccgatgagagcggctcctcctccctgccttaccgcccccgtgagctgaagcacacaagggtcaccctcccccggtcttcatggtctcgattggaatcccaggtctgaattgttccgattcgtgtgcgccgctttctgattcggtgatgtggtagctttctcttcctgcagtatcatcacagaggtgatgcgcagcaccagcgtcgataaattcttcatagtgatggagcccctcatcaggaaagtggcactttattcctaatctgactattttggggttccagtgatccagagcttgagggaacataccaaagcatatttggactgccatcttatggtcacaaacccttcagattatatagaaccatttggaaaggctggtgcctcaagattcacattccatatagaagtagctagagacaacttgcaagagctctccaaagcattaaatctcacatgtgttgagtcatgttctgtccatttggtcctccagggtgttaatggtgtatccatttcatgcaatgtttaaaagagacatcttctatggatgatagtatacctgcaggttcatacttattgacacatgtttcat

SEQ ID NO: 12236 - protein, 64 aa, Panicum virgatum
  misc_feature: Ceres CLONE 1761628
  misc_feature: SWISSPROT Homolog: EC 5.1.3.1 Ribulose-phosphate 3-epimerase
MVTNPSDYIEPFGKAGASRFTFHIEVARDNLQELSKALNLTCVESCSVHLVLQGVNGVSISCNV

SEQ ID NO: 12237 - DNA, 548 bp, Panicum virgatum
  misc_feature: Ceres CLONE 1761629
  misc_feature: Encodes the peptide sequence at SEQ ID NO. 12238
gacctgtagcctagccgcccactgttccgtcggatcccagcggcggcgccgccctcccccgagtcctcatcgtccggccgtcgtcatcccccgggccgcgcgaaatgaggtggggcgccgccgctgctgccgtgtccgccgcggccaccgccgccgcgtccgccgcgtgcccctccaccacggtgcagcagggatccccaccggcgagggaggagggcgccgccggaaggaggcggcggagcggcgccgcggcggcggcggacgagaggttcgcgccgcggttcgacgggctgcgcttcatcgagaccctcgtcacggcgcaccgctgacggacgggcgcgcgcgccagcaactgcgggggctgtgatctgtggtccaggtcgccggccggagcatttggtagctctagcctgtatccagctgacgtcgccgccgctgttcaccatgtgcttgttgttggttaacaaaggctaatcagaaaagaatatgctactgcttgtgttacttctaattaaactactgtgggtggccggtgctactatttcttt

SEQ ID NO: 12238 - protein, 74 aa, Panicum virgatum
  misc_feature: Ceres CLONE 1761629
  misc_feature: Useful for making plants with modulated cold sensitivity
MRWGAAAAAVSAAATAAASAACPSTTVQQGSPPAREEGAAGRRRRSGAAAAADERFAPRFDGLRFIETLVTAHR

SEQ ID NO: 12239 - DNA, 577 bp, Panicum virgatum
  misc_feature: Ceres CLONE 1761648
  misc_feature: Encodes the peptide sequence at SEQ ID NO. 12240
ctcaaacccttcccttctctcgaagagaatctctctcctgatctcctcccttgctcgagatcttccttccctggcgacgacgactgggcgggcggtggcccagccctttaccggcgacgagcgcatcctccaggtcatggcagagaccatagatttatcaggggacggaggtgttcttaagacggtggtccggaaagcaaaggatggtgctatagcgccatctgatagtctgcccctggttgatggcacacttgctgagaatggtgaagtttttgacaccacccatgaagacaactctattttctcatttgaaattggacagggggctgtcatcaaagcatgggatatagccttaagaactatgaaggttggcgaggttgcaaaacttacgtgcaagccagaatatgcatatggaactgcgggctcaccaccggagatagctcctaatgcaaccctcatttttgaggtggagttagttgcttgcaggccgaggaaaggttcaagtgtgggcagtgtctctgatgagaaagccaggcttgaggaacttaagaagcagcgagagctagctgctgctacc

SEQ ID NO: 12240 - protein, 146 aa, Panicum virgatum
  misc_feature: Ceres CLONE 1761648
  misc_feature (22)..(114): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
  misc_feature: Useful for making plants with modulated biomass
MAETIDLSGDGGVLKTVVRKAKDGAIAPSDSLPLVDGTLAENGEVFDTTHEDNSIFSFEIGQGAVIKAWDIALRTMKVGEVAKLTCKPEYAYGTAGSPPEIAPNATLIFEVELVACRPRKGSSVGSVSDEKARLEELKKQRELAAA

SEQ ID NO: 12241 - DNA, 677 bp, Panicum virgatum
  misc_feature: Ceres CLONE 1761652
  misc_feature: Encodes the peptide sequence at SEQ ID NO. 12242
atccgatccgaatcctactactactacgactaccacaccagctgacttccgagaggcatcatgaagcagccggcgcatcatctgctgctcgccgccttcgcggtggtcctgctgctgtgcgcgagggtcgtcgccgacgcggcgacgtgcgacgcgacgcagctgaccccgtgcgcgggcgccatcatcgggaacgcgccgcccacctcggcgtgctgcagcaggttgaaggagcagcagccgtgcctgtgcacgtacgcgcgcgaccccaacctgcagcgctacgtcaactcgcccaacggcaagaaggccatggccgcgtgcaggctgcccgtgccgtcctgctaattggttaacttcttcgattcgcgtcggcaccgcgcgcgtgcggccggccggccgctaccttgttcccgacgtcttgatctccgttgtgttgtgctggtctccgctgcttcctgtatctgccgtgccgagctagctcctcgggctcttcgcgtgtatgaataaaggatgtaataattacgtacgctgtatttatgtgtcttcgtggcctcgtggcttttctcattaagatcagtaaaggatgcatggtggcaaaaactagtgccgacagtgatagctaaaagtgtaggcaaaatttgcaacaacagtgagcaaacaaatgttggtggtgg

SEQ ID NO: 12242 - protein, 95 aa, Panicum virgatum
  misc_feature: Ceres CLONE 1761652
  misc_feature (20)..(95): Pfam Name: Tryp_alpha_amyl Pfam Description: Protease inhibitor/seed storage/LTP family
MKQPAHHLLLAAFAVVLLLCARVVADAATCDATQLTPCAGAIIGNAPPTSACCSRLKEQQPCLCTYARDPNLQRYVNSPNGKKAMAACRLPVPSC

SEQ ID NO: 12243 - DNA, 780 bp, Panicum virgatum
  misc_feature: Ceres CLONE 1761669
  misc_feature: Encodes the peptide sequence at SEQ ID NO. 12244
ctcttcacgcggccactccaagccaggattatggatgccttctggccgacgaacccacccacattcaggcacgcgctcgacaggtactccgcggagatcgagaatctcgcgaggcgcctggtgagctccatggcagccgaccttggcgtcagccaggaggcgctcctaggcgccttcttcggcggcggcgacggcaagggccagagcgtgtccatgcaccactacccgccgtgccggcaccgggacacggtggtgggcatcccgccgcacaccgacaccctgggcctgaccctgctgctccaggtcgacgacacgccgggcctgcaggtcaagagggccgggcggtggttccccgtgcggccgctgccgggcgccctggtcgtcaacgtcggcgacatgctcgacgtcctcaccaacggcgcctacgccagcgtcgagcacagggtggtcccggacgcccgggggcgccgggtcaccgtcgcgacgttccatgaggcgtgcgttgacgggcgggtggcgccgctgccggagctcctcaggggaggcgaggcgccggcacggtacaggtccgtcggaatactcgagtaccataagggcagcggcgaagcattgggccaaggcacacggttcctggacagcctgaaggcgtagctagcttattcaagttcagggtacctcccatttcccatgtaataaaacgtatcctggtgggacaaaatcaaatcagcttgaattgggttataatttatgaatattttcaatccgatgccgtgaacttcg

SEQ ID NO: 12244 - protein, 206 aa, Panicum virgatum
  misc_feature: Ceres CLONE 1761669
  misc_feature (56)..(156): Pfam Name: 2OG-FeII_Oxy Pfam Description: 2OG-Fe(II) oxygenase superfamily
  misc_feature: SWISSPROT Homolog: EC 1.14.17.4 Aminocyclopropanecarboxylate oxidase
MDAFWPTNPPTFRHALDRYSAEIENLARRLVSSMAADLGVSQEALLGAFFGGGDGKGQSVSMHHYPPCRHRDTVVGIPPHTDTLGLTLLLQVDDTPGLQVKRAGRWFPVRPLPGALVVNVGDMLDVLTNGAYASVEHRVVPDARGRRVTVATFHEACVDGRVAPLPELLRGGEAPARYRSVGILEYHKGSGEALGQGTRFLDSLKA

SEQ ID NO: 12245 - DNA, 588 bp, Panicum virgatum
  misc_feature: Ceres CLONE 1761671
  misc_feature: Encodes the peptide sequence at SEQ ID NO. 12246
ctgcgccgcctccctccgccctcctctcccgcaagcagttcgtgctcgaggttatccaccccggccgccccaacgtctccaaggcggagctgaaggagcggctggcgaaggtgtacgaggtcaaggaccccaactgcatcttcgtcttcaagttccgcacccacttcggaggcggcaagtccaccggcttcggtctcatctacgacaacctcgaggccgccaagaagttcgagcccaagtatcgcctcatcaggaatggtcttgctaccaaagtagagaaatctcgtaagcagatgaaggagcggaagaacagggcaaagaagatccgtggtgtgaagaagacaaaggctggcgatgccaagaagaagtaaggctggaaacttgccttgccgtcttgatcttgtctgcctcgggcttgttgaggacggtgtccttttggcaatgctgaatgtttaattagacctagaaaggattttgccagaattatgttgaggctctcgtagtactttgtggtcagttttgaggaacattgtcaggcactagcatatatacttgatcgtcattgcttattctgctatccttcatttt

SEQ ID NO: 12246 - protein, 122 aa, Panicum virgatum
  misc_feature: Ceres CLONE 1761671
  misc_feature (13)..(96): Pfam Name: Ribosomal_S24e Pfam Description: Ribosomal protein S24e
APPPSALLSRKQFVLEVIHPGRPNVSKAELKERLAKVYEVKDPNCIFVFKFRTHFGGGKSTGFGLIYDNLEAAKKFEPKYRLIRNGLATKVEKSRKQMKERKNRAKKIRGVKKTKAGDAKKK

SEQ ID NO: 12247 - DNA, 755 bp, Panicum virgatum
  misc_feature: Ceres CLONE 1761673
  misc_feature: Encodes the peptide sequence at SEQ ID NO. 12248
aaaaaccctatcgtctctcgcgcgcccctaccaccaccgaacccggcggcgcacgcggaggagcccagcgagaggcggaggaagaaggcgatggcgcgcggcgtggcggcgggggcgaagggcggcgcggccggcgggaagaagaagggctccgtcaccttcacgatcgactgcaccaagcccgtggaggacaagatcatggagatcgccacgctcgagaagttcctgcaggagcgcatcaaggtcgccggcggcaaggccggcaacctcggcgagggcgtcaccgtctcccgcgacaagaccaaggtcaccgtcacctccgaggggcctttctccaagaggtacctcaagtacttgaccaagaagtacctgaagaagcacaatgtgcgtgactggctccgggtcatcgcgtcgaacaaggaccgcagcgtctatgagctacggtacttcaacattgccgagaatgagggtgaggaggaggattaggcgcactaccttatctatgtcttgtgaacttttggacgtgttggaacagtcttgctgtagcctttcaagggatgagttttgatgtttaaattgatgtcctgatgtgtttgaagagtggttaacttccatgtgatgcttagataatctgagtccaaaaatgtttgttcttgcttgtctgtgaaacacatcatcagcgatttatcgttaggttgtcgctatgattgtctatcgactggttatatcagtatggaaactccggttgtcaaatt

SEQ ID NO: 12248 - protein, 131 aa, Panicum virgatum
  misc_feature: Ceres CLONE 1761673
  misc_feature (17)..(131): Pfam Name: Ribosomal_L22e Pfam Description: Ribosomal L22e protein family
MARGVAAGAKGGAAGGKKKGSVTFTIDCTKPVEDKIMEIATLEKFLQERIKVAGGKAGNLGEGVTVSRDKTKVTVTSEGPFSKRYLKYLTKKYLKKHNVRDWLRVIASNKDRSVYELRYFNIAENEGEEED

SEQ ID NO: 12249 - DNA, 787 bp, Panicum virgatum
  misc_feature: Ceres CLONE 1761696
  misc_feature: Encodes the peptide sequence at SEQ ID NO. 12250
gcacggcgcacctcatcagagagacgcccccccccccccccccctaccaccaccactcgcaaggccacgacggcgagatgttcctgcggcggatcctgaccagcgggggcggcctggcggcgctgcgtgcggcgcgcgccgtcaaggagacgacggggatcgtgggccttgatgtggtgcccaacgcgcgggaggtgctcatcggtctctacacgcgcacgctcaaggagatggaggcggtccccaaggacgagggctaccgcaagaccgtcgagtccttcaccaaccaccgcctccagatctgccaggaggaggacgactggaagcgcatcgaggaccgaatcggatgcgggcaggtcgaggagctcatcgaggaggccgaggacgagctcaagctcatcgcaaaaatgattgaatgggatccctggggtgttcctgaagactatgaatgcgaggtgattgaagatgacaccccagttcctaagcatgttcctcagcacaggcctgttgcgcttcctgaggagttcttcaagacactagatgctgtcaaatctgatcccgctctgcagggcgatgctcctcctcaagtgaaggcataaagatggggagtcttcatgattatggcatttcacattttgctgcgttgagtagactagtttcttgtgccatttgccagcaatgtgcttgttgttccaagcagaataaatttctggtgagtactatcaaatagtgactttcaaactcagtggtttgacacagtaaatttgttgtccatgaatccataata

SEQ ID NO: 12250 - protein, 173 aa, Panicum virgatum
  misc_feature: Ceres CLONE 1761696
  misc_feature (35)..(91): Pfam Name: ETC_C1_NDUFA5 Pfam Description: ETC complex I subunit conserved region
MFLRRILTSGGGLAALRAARAVKETTGIVGLDVVPNAREVLIGLYTRTLKEMEAVPKDEGYRKTVESFTNHRLQICQEEDDWKRIEDRIGCGQVEELIEEAEDELKLIAKMIEWDPWGVPEDYECEVIEDDTPVPKHVPQHRPVALPEEFFKTLDAVKSDPALQGDAPPQVKA

SEQ ID NO: 12251 - DNA, 615 bp, Panicum virgatum
  misc_feature: Ceres CLONE 1761699
  misc_feature: Encodes the peptide sequence at SEQ ID NO. 12252
  misc_feature (49)..(49): n is a, c, t, g, unknown, or other
  misc_feature (52)..(52): n is a, c, t, g, unknown, or other
  misc_feature (55)..(55): n is a, c, t, g, unknown, or other
attcagctgagtgtgctcgatcatcccttaaacaacaaagccccccaancanccncacaacagatcatcttccttcttccaagatgtcttgcagctgcggatcaagctgcaactgcggctccaactgcaagtgcggcaagatgtaccctgaccttgaggagaagagcagcggcggcgctcaggccaccatcgtcctcggcgtggccccggagaagaagactggccagttcgaggcggcagcggagtccggcgagaccgcccacgcctgcaagtgcggtaacagctgcagctgcgacccctgcaactgctgatttcgatgggggtttttcagaacacacctgcatgcatgcatgctagctactacctactactctgcttgtgtgtgacttgatgattgaacaagaataaggatgagcctgagccatcatgtctcatgtatcggtttggctccggcctcatcaagcatgcatgcgtcgcctgcccctctgtgtgctttgcgtccgtcctgtgtctgtatgtgttgatcattacaaagaaaccatgcaggcatacatctctgcatgtgtctctgtaatgatcggtccagagtgatgaatatataaaactggtttgctt

SEQ ID NO: 12252 - protein, 75 aa, Panicum virgatum
  misc_feature: Ceres CLONE 1761699
  misc_feature (1)..(75): Pfam Name: Metallothio_2 Pfam Description: Metallothionein
MSCSCGSSCNCGSNCKCGKMYPDLEEKSSGGAQATIVLGVAPEKKTGQFEAAAESGETAHACKCGNSCSCDPCNC

SEQ ID NO: 12253 - DNA, 593 bp, Panicum virgatum
  misc_feature: Ceres CLONE 1761701
  misc_feature: Encodes the peptide sequence at SEQ ID NO. 12254
atcttcccaattctctccgcgcccctcacccctctccgccgcccgccgcgtcggctgcggcgccggcgacccgaccagcgtcactcgccatgactacctcaaggcgtcttgctgataggaaaattgcacgatttgagaagaatgtcacaaagaggggagctgttcctgagacaatcaagaaagcaaatgattatccttttggacctattctgcttgggttcttcgtcttcattgttgttggatcatctctctttcagatcatcaggactgcctcaaatgctggtctattctgagaatggttcttcacctaacttacagattatatttttttagtggaggaacatggttgatatatgcagtttgtcacttagaaaacaaaagtgcatggcatagctggtactctatgatgctaccctataatatattgtagtactatggtgaaatggagaagtttaagttatatggtgacaatatatgtgtaacataggggtaactgggtaacccaagtcgctcggtgataggaaagatgattccgtaatacatattgcgaagttatagctcgtgttatatcttcatatgccatggcttattcc

SEQ ID NO: 12254 - protein, 67 aa, Panicum virgatum
  misc_feature: Ceres CLONE 1761701
  misc_feature (1)..(63): Pfam Name: RAMP4 Pfam Description: Ribosome associated membrane protein RAMP4
  misc_feature: Useful for making plants with modulated nitrogen use efficiency
MTTSRRLADRKIARFEKNVTKRGAVPETIKKANDYPFGPILLGFFVFIVVGSSLFQIIRTASNAGLF

SEQ ID NO: 12255 - DNA, 709 bp, Panicum virgatum
  misc_feature: Ceres CLONE 1761721
  misc_feature: Encodes the peptide sequence at SEQ ID NO. 12256
aagaagcagcagaacagagaaggggaagaagcttgtgttctcaggccgtatggagatccagcagccccggggggttggcaattcgaaggtcgtgaaggttcagagcgaggaggcgtgggagctgttcaccaatcaagcaagcaacgaagggcgccctgttgttgcccatttcggggcatcatggtgtgtgacatcgctgtccatgaactacaagtttgaggagctagctcagacccaccctgagatcttgttcctctatgtggatgttgacgatatccagagtgtttcatccaagtacggagtgaaggccatgccgacatttttcctgatcaagaacaaggaggtggtgaggaagatcgttgaggcgaatccagatgagttgaagaagctggtggatgcttctgctgatcccttcgaaactcagatagtcgtcaaatagccgttcgtcgccatcatgtcctccgaaactgctctgtgaccgtgagcactgcctggtcaggtttctgaattgcgtctggatgttccaaactgtacattgtcgcacttgtgactctgatgggtgtcgctttatagctcagtagtcttgcctgttggtcctgcaactgtgacagcagtgtgtgtaactctgatttttttttttttttgaaagagtgtgactctgaatgttgcatgcgtttgaggttgaaaaataaaggtcgcttatcagctc

SEQ ID NO: 12256 - protein, 129 aa, Panicum virgatum
  misc_feature: Ceres CLONE 1761721
  misc_feature (14)..(118): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MEIQQPRGVGNSKVVKVQSEEAWELFTNQASNEGRPVVAHFGASWCVTSLSMNYKFEELAQTHPEILFLYVDVDDIQSVSSKYGVKAMPTFFLIKNKEVVRKIVEANPDELKKLVDASADPFETQIVVK

SEQ ID NO: 12257 - DNA, 801 bp, Panicum virgatum
  misc_feature: Ceres CLONE 1761726
  misc_feature: Encodes the peptide sequence at SEQ ID NO. 12258
accccacccccacaacccgctccggccgcctccgcccgatcgatcgcccggagatcgccgcgaatctaacccctgctgcgttcgtagccttcgacgacgatgtcgggagccggagaggaggacaagaagccggcggagggcggcgcccacatcaatctcaaggtcaagggacaggatggcaatgaggtgttcttccgtatcaagaggtccacccagctgaagaagctgatgaacgcctattgtgaccgccagtctgtggacatgaatgccattgcattcctttttgatggccgcaggcttcgcggtgagcagaccccagatgagctggagatggaggacggcgatgagattgacgccatgcttcaccagaccggaggctacatgcctagtgtttagaaagcccttgtcgcagccttgttttgcagcgctgtgcgctctgccttcagtagtaaactaaagaagtcatgaaggaacttgtgaggctctggccctcagtgtgccattgctgaaggacatcggtagtcttgtgtttagtaagatttggtactttggcgtgtcatgactcgtttatctatcccctaatatatcctcccctgtgtgtactcccaatgatcgcccatggtttgtttatcctgcttgaagtgcgcattgctttgctcacctggagctggggttcatggttagttttgtgttgctgaggtgccggaaaacgtgcgctgcacgtgtcaccactatcatttcgatgtaataagcctgtgatagcctgtgatcaccatgagcaggccatggggatataatggc

SEQ ID NO: 12258 - protein, 98 aa, Panicum virgatum
  misc_feature: Ceres CLONE 1761726
  misc_feature (21)..(91): Pfam Name: ubiquitin Pfam Description: Ubiquitin family
MSGAGEEDKKPAEGGAHINLKVKGQDGNEVFFRIKRSTQLKKLMNAYCDRQSVDMNAIAFLFDGRRLRGEQTPDELEMEDGDEIDAMLHQTGGYMPSV

SEQ ID NO: 12259 - DNA, 802 bp, Panicum virgatum
  misc_feature: Ceres CLONE 1761734
  misc_feature: Encodes the peptide sequence at SEQ ID NO. 12260
atcgccgttgagcaggctgctgacagcgtcagggaatagtaaggaggagcttggtggagctacacgatgactatgaccgtggccatgccgtcgtcggaggcgtcgtcgtccccttccaagaggggcctccgggggccgcggccgcagccgctgaaggtgacggcgtcgtcgaagggctcgtcgccgacggcggcgtcgtcgtccaagccggcgtccggctccaagaagccggtgatcgtgtacgagcacacgcccaaggtcgtccacgccaggccgcaggagttcatgaccgtcgtgcagcggctcaccggcaagcccgcgcccgccacgtcatcgtcggccttgccgacgtacgtgccaggcttctcgccggcggcggcggccgaggagggcggcgacccgctgctgctcacgctcgggcagggccaggccgcgccgccgccagcaccgacgctgccgtcccccatggcggccgggctgctgctgtccccgggcttcatcttctcccccaacaccatgcaggccatccaggacctcagccccttgttctaatcacaagttattccatagagtatattagagtgtacaataatttctattttttcccgcgctgttcgtgcaaaatttttcacacagggggcaaatttcacacgcacagcggcttgcttgcttgtatctgctttgcattattgtacgcagaaatgggcaaaaataccttttttgaaaactatgggcaaaaatacctgtaaatttcgtctttcatggaagtttcagcttcctgatatgaatatcctgacaagtc

SEQ ID NO: 12260 - protein, 161 aa, Panicum virgatum
  misc_feature: Ceres CLONE 1761734
  misc_feature (59)..(89): Pfam Name: VQ Pfam Description: VQ motif
MTMTVAMPSSEASSSPSKRGLRGPRPQPLKVTASSKGSSPTAASSSKPASGSKKPVIVYEHTPKVVHARPQEFMTVVQRLTGKPAPATSSSALPTYVPGFSPAAAAEEGGDPLLLTLGQGQAAPPPAPTLPSPMAAGLLLSPGFIFSPNTMQAIQDLSPLF

SEQ ID NO: 12261 - DNA, 738 bp, Panicum virgatum
  misc_feature: Ceres CLONE 1761757
  misc_feature: Encodes the peptide sequence at SEQ ID NO. 12262
agctggcagttgtgaggcgcatcatcacagaggaagagcgagtggaaatcgaagcagcagcagcaatggcggcatccatgatcacgtcgtcagctctggtggcgccggccagggcccagggcctgccgtcccacggccgccgcgcctcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggaaccaccggacttctgatctggtccgtcaccctcatcgggctccttgccggcggcgccctccttgtttacaacaccagcgccctcgccagctagcaacattattcatgcatagtccatgaaagcgcttgcggccggtccatatataagatttatcatcagcccggatgtctgtgtgtaatctagcctgcagcttcgatgcccaatataatgcttggttcatgcaacaatgctactacggctctccatacttttggaacaattaattattatattacttcatgctatatatttagattaataactggtaactttatttctctgtgccttgcattgtgagcctttgtgaagaagatgatgctgatgctacttg

SEQ ID NO: 12262 - protein, 131 aa, Panicum virgatum
  misc_feature: Ceres CLONE 1761757
  misc_feature (35)..(131): Pfam Name: PsbR Pfam Description: Photosystem II 10 kDa polypeptide PsbR
MAASMITSSALVAPARAQGLPSHGRRASSFAVVCGTGKKIKTDKPFGIGGGLTVDHDASGRKVKGKGVYQFVDKYGANVDGYSPIYKEEDWSPTGDVYVGGTTGLLIWSVTLIGLLAGGALLVYNTSALAS

SEQ ID NO: 12263 - DNA, 614 bp, Panicum virgatum
  misc_feature: Ceres CLONE 1761771
  misc_feature: Encodes the peptide sequence at SEQ ID NO. 12264
gaggcgtacccgtacctgatggaggaggacttttgcgacctgaaggccggcgacgagcaggtggtcaccatctccgggtacgaggacgtgccggccaacgacgagcaggccctggtcaaggccctcgcgcaccagcccgtcagcgtcgccatcgaggcgtccggcaggcacttccagttctacaaagggggcgtgttcgatggcccgtgcggcgcggagctggatcacggcgtggcggcggtgggctacggcaccagcaaggggcaggactacatcatcgtcaagaactcgtggggcccgcactggggcgagaaggggtacatccgcatgaagaggggcaccggcaagccggagggcctctgcggcatcaacaagatggcgtcctacccaaccaaggaccagtagtcactactactgtgtgcatgaccataaaaaatcgatcatagcctctctctctctttttaccttctcatcatgttttatttcttctttcccttttgtgttgatcgtttttaatttctcgattgatttgatcgaagagcaaaaggcactcatgcaccacgacctgcttggttgaaatgatggatggaataaactttaccttaatttgtttc

SEQ ID NO: 12264 - protein, 134 aa, Panicum virgatum
  misc_feature: Ceres CLONE 1761771
  misc_feature (1)..(131): Pfam Name: Peptidase_C1 Pfam Description: Papain family cysteine protease
  misc_feature: SWISSPROT Homolog: EC 3.4.22.6 Chymopapain
EAYPYLMEEDFCDLKAGDEQVVTISGYEDVPANDEQALVKALAHQPVSVAIEASGRHFQFYKGGVFDGPCGAELDHGVAAVGYGTSKGQDYIIVKNSWGPHWGEKGYIRMKRGTGKPEGLCGINKMASYPTKDQ

SEQ ID NO: 12265 - DNA, 474 bp, Panicum virgatum
  misc_feature: Ceres CLONE 1761777
  misc_feature: Encodes the peptide sequence at SEQ ID NO. 12266
agcgcccaccgcccaaacaagcacccgttttttcaagtcattgatgatacaaagcaatgcactttggcttcggcttcaaccatgcacaaatctctctccaaggaattggaatactccgctggaccaacaatcgaagtagcacaaaagattggtgaagtgattgccaagtcttgcctggagaaaggaattaccaaagttgtcttcgaccgaggtggtttcctctaccacggccgcataaaagctcttgctgatgctgctagagagcacgggcttgagttctgaatctttaccccgaatgtttgttcatatttcaatgatcacctgtaatcttttcttttcaccccctcgatgttgaacagagtttgtagtcacctgccttgttttgcagagtgcagattgggccaaactttgatggcatcagatttttgccccagtcttgcattcaaaagcttctcaacatgatattatgaatct

SEQ ID NO: 12266 - protein, 93 aa, Panicum virgatum
  misc_feature: Ceres CLONE 1761777
  misc_feature (1)..(93): Pfam Name: Ribosomal_L18p Pfam Description: Ribosomal L18p/L5e family
SAHRPNKHPFFQVIDDTKQCTLASASTMHKSLSKELEYSAGPTIEVAQKIGEVIAKSCLEKGITKVVFDRGGFLYHGRIKALADAAREHGLEF

SEQ ID NO: 12267 - DNA, 852 bp, Panicum virgatum
  misc_feature: Ceres CLONE 1761789
  misc_feature: Encodes the peptide sequence at SEQ ID NO. 12268
gtgcgaccattcttcattctgctgcttgccacctcttcacaaagcaggccttcttcttctgtagctctaagcctcttgcaagctcagctgctgcttgtgacaagatccccatccgcttgagttcagcatcgatggcggcggaggcaaagaaggtggaggcggaggcgaccaaggacatcgccgaggagaaggcgattgtgccgctgccgactccaccggctgcgcccaaggtcgacaagccggccgacgactccaaggccatcgttgttgtcaaggacgctgctgagaaacctgcagctacaggaggttcaactgaaagagatgcttatctggcgaaaattgtatccgagaagagattgactctgatcactgcatgggaggagagtgagaaggcgagagctgagaacagggctgccaagaagcttgcctacatcacatcttgggagaaggcgaagaaagcagagatggaggccgagcttaaaaagatggaggagcaactggagaagaagaaggcggcgtacgaagagaagctgaagaacaagctggcgatgctccacaagacggcggaggagaagagggcgctgacggaggcgaagcgcggggaggagatgatcatggcggaggagctggccgccaagtaccgcgccaagggtgaggctcccaccaagctcttcggcctcttgaaagcataagaaacgtcatctcgatcttctatgccgatccaagacatgcatacatacatacgttgggatggattattattgttacctatatatatatatatatatatatatatatatatatatatatatatatatatatatatatacatatacttggtgcctggcctgt

SEQ ID NO: 12268 - protein, 186 aa, Panicum virgatum
  misc_feature: Ceres CLONE 1761789
  misc_feature (72)..(181): Pfam Name: Remorin_C Pfam Description: Remorin, C-terminal region
  misc_feature (14)..(70): Pfam Name: Remorin_N Pfam Description: Remorin, N-terminal region
  misc_feature: The sequence is a functional homolog of SEQ ID NO 1773 in the 11/479,226 US patent application
  misc_feature: The sequence is a functional homolog of SEQ ID NO 20 in the 10/286,264 US patent application
  misc_feature: The sequence is a functional homolog of SEQ ID NO 876 in the 10/412,699 US patent application
  misc_feature: The sequence is a functional homolog of SEQ ID NO 438 in the 10/666,642 US patent application
  misc_feature: The sequence is a functional homolog of SEQ ID NO 1492 in the 11/479,226 US patent application
  misc_feature: The sequence is a functional homolog of SEQ ID NO 644 in the 11/435,388 US patent application
  misc_feature: The sequence is a functional homolog of SEQ ID NO 716 in the 10/412,699 US patent application
  misc_feature: The sequence is a functional homolog of SEQ ID NO 496 in the 11/435,388 US patent application
MAAEAKKVEAEATKDIAEEKAIVPLPTPPAAPKVDKPADDSKAIVVVKDAAEKPAATGGSTERDAYLAKIVSEKRLTLITAWEESEKARAENRAAKKLAYITSWEKAKKAEMEAELKKMEEQLEKKKAAYEEKLKNKLAMLHKTAEEKRALTEAKRGEEMIMAEELAAKYRAKGEAPTKLFGLLKA

SEQ ID NO: 12269 - DNA, 737 bp, Panicum virgatum
  misc_feature: Ceres CLONE 1761814
  misc_feature: Encodes the peptide sequence at SEQ ID NO. 12270
tcatcgaccgatcccgcaaggaacccttttttgggttggccgagggagcgcggccgccgtaaaaccctagcctcgagatcgcgaaccgcggccccggtgagatgcagatcttcgtgaagacgctgacggggaagaccatcacgctcgaggtcgagagcagcgacaccatcgacaatgtcaaggccaagatccaggacaaggagggcattccccctgaccagcaaaggctgatttttgctggtaagcaattggaagatgggagaacattagctgattacaacattcagaaggagtcgacacttcatttggtcctgaggctcaggggtggaactatgatcaaggtgaagacacttacagggaaggaaattgagattgacattgagcccactgacacaattgataggatcaaggagcgtgttgaggagaaagagggtatcccacctgttcagcagaagctcatttatgctggcaagcaacttgctgacgacaaaactgccaaggattacaacatcgaaggtggttcggtgctccatcttgtgcttgctctgaggggtggccagtagattcaacttctacccgcagtttatgttattgcgatttctacctatagttggttgagactttaagccttgtattgggtggttgattgaagtggattagtggactaagagtcaggtgccatctgtgctggatatgaaatgcttgaactatgtttatcagctgtcatctgattgccc

SEQ ID NO: 12270 - protein, 153 aa, Panicum virgatum
  misc_feature: Ceres CLONE 1761814
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQKLIYAGKQLADDKTAKDYNIEGGSVLHLVLALRGGQ

SEQ ID NO: 12271 - DNA, 797 bp, Panicum virgatum
  misc_feature: Ceres CLONE 1761815
  misc_feature: Encodes the peptide sequence at SEQ ID NO. 12272
gtgctctcttcagaggtgggttggcttctcctccccctccggttcggttcggttcgggttcgtgagattcttggggttccgttcgggggcgagaggaagagatggaggcgtcggatgttgagtaccgctgcttcgtcggcggccttgcctgggccaccgacgacaactcgctccacaacgccttcagcacctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcggcggcggctacggtcgccgcgagggcggtggcggctacggcggcggcggcggcggctacggtggccgtggaggctacggtggcggcggcggcggcggctacggtggcaaccgcggcggcggctacggcaactccgatgggaactggaggagctgagcggtggggcccgcgtggccaaagttatcctgtgctttctactgtgacccgagttatcctgtgtcatgatctacctgtgtttggtgtctgtttcgtgttcgttgttgcccatctgtgtttttgatcgcaagctccgtcgtgctgttgtctgtcagagctatcttgatctccatcccatgaacttgggtgttgggattggaagctgttatcttgctgtaacttgttaccgtttcagttaatcaaatgggaaaaaaaggtgctacttggtgctgc

SEQ ID NO: 12272 - protein, 140 aa, Panicum virgatum
  misc_feature: Ceres CLONE 1761815
  misc_feature (10)..(81): Pfam Name: RRM_1 Pfam Description: RNA recognition motif. (a.k.a. RRM, RBD, or RNP domain)
  misc_feature (48)..(135): Pfam Name: GRP Pfam Description: Glycine rich protein family
  misc_feature: SWISSPROT Homolog: EC 5.2.1.8 Peptidylprolyl isomerase
  misc_feature: Useful for making plants with modulated flowering time
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with altered terpenoid content
MEASDVEYRCFVGGLAWATDDNSLHNAFSTYGEVLESKIILDRETQRSRGFGFVTFSSEQAMRDAIEGMNGKELDGRSITVNEAQSRGGGGGYGRREGGGGYGGGGGGYGGRGGYGGGGGGGYGGNRGGGYGNSDGNWRS

SEQ ID NO: 12273 - DNA, 763 bp, Panicum virgatum
  misc_feature: Ceres CLONE 1761822
  misc_feature: Encodes the peptide sequence at SEQ ID NO. 12274
atcctcctcccccatctagggtttggccaccctcaccccaaactccgcgtcctctaatccttttcctatctctatccttcatcccaatggcctccgcggcggcgaagcggaagccggtgttcgtcaaggtggaccagctgaagcccggcacgaccggccacacgctcgtcgccaaggtgctcagctccaagaccgtcctccagaagggccgccccggcgctgccgccgccggccctgcggcgcggcccaccaggatcgccgagtgcctcatcggcgacgagaccggttgcatcctcttcactgcccgtaacgagcaggttgacttgttgaagcctgaaagcactgttattatccgcaatgcaaagattgatatgttcaaaggttcaatgaggcttgctgtggacaaatggggccgcatcgaagtcactgaaccggcaagcttcaatgtgaaggaggacaacaatctctcacttgtggagtatgagcttgtcaacgttgccgaagagtgaaggccttgttgatctcattcgataaccagaatttctgctggtaaaaaaactctacttgttgcatcaagaatgagaactcgaggagatggagaagcttatgaagtaggttggagctgttgggtcgaactagtgcaagtttctcgttatcatgcattatgtctatcaatggatattagttgctgcagcggtgtggttgtacgaacaaatatgatgtgctgagcagttaatacgctaatggttcttgagctctttgg

SEQ ID NO: 12274 - protein, 140 aa, Panicum virgatum
  misc_feature: Ceres CLONE 1761822
  misc_feature: Useful for making plants with modulated drought sensitivity
  misc_feature: Useful for making plants with modulated water use efficiency
MASAAAKRKPVFVKVDQLKPGTTGHTLVAKVLSSKTVLQKGRPGAAAAGPAARPTRIAECLIGDETGCILFTARNEQVDLLKPESTVIIRNAKIDMFKGSMRLAVDKWGRIEVTEPASFNVKEDNNLSLVEYELVNVAEE

SEQ ID NO: 12275 - DNA, 752 bp, Panicum virgatum
  misc_feature: Ceres CLONE 1761826
  misc_feature: Encodes the peptide sequence at SEQ ID NO. 12276
acccttacgccgccgccgccgctagctccagcgccctcgccgtcgtccgcccttctcccgctacgagctaggcgtcaccttcgcctatccaacatgggtaagacacgtggtatgggagctgggcgcaagctcaagacccacagaaggaaccagaggtgggctgacaaagcctacaagaagagccatctcggcaatgagtggaagaaaccttttgctggctcatcacacgcaaagggaatcgtccttgaaaagattggcattgaggctaagcaaccaaactctgctatccgtaagtgtgcccgtgtccagctcgtgaagaatgggaagaagattgctgcctttgtgcctaacgatggttgcttgaattacattgaggaaaatgatgaggtgctgattgctgggttcggtcgtaagggtcatgctgtgggagatattcccggtgtccgtttcaaggtcgtgaaggtctctggagtttccctgctggccctcttcaaggagaagaaggagaagccgagatcttaaaaatctgtttccctcttgccacaatgaaacctgtaatgttttggggcctgtggcgcggctgaaggtctatctcatgtaagaactcatgctatgtctagatgagccttaccatcagcaagacagtacctgctggccatagttttgttgagaagcatcagaatttgaattctaaactgcttgtcggtgtgatgttatatatgatcaagtcttgccatcgtggcgtgtttccg

SEQ ID NO: 12276 - protein, 142 aa, Panicum virgatum
  misc_feature: Ceres CLONE 1761826
  misc_feature (8)..(141): Pfam Name: Ribosomal_S12 Pfam Description: Ribosomal protein S12
MGKTRGMGAGRKLKTHRRNQRWADKAYKKSHLGNEWKKPFAGSSHAKGIVLEKIGIEAKQPNSAIRKCARVQLVKNGKKIAAFVPNDGCLNYIEENDEVLIAGFGRKGHAVGDIPGVRFKVVKVSGVSLLALFKEKKEKPRS

SEQ ID NO: 12277 - DNA, 784 bp, Panicum virgatum
  misc_feature: Ceres CLONE 1761830
  misc_feature: Encodes the peptide sequence at SEQ ID NO. 12278
gtttcagcccctgtgcgaccattcttcattcttcttctgtagctctaaacgtcttgcaagctcagctgctgcttctgcttgtgagaaggtccccatctggttgaattcagcatcgatatatggcggcggaggaggcgaagaaggtggaggtggaggcgaccaaggacatcgccgaggagaaggcgattgtgccgctgccgactccgccggctgcagccaagatcgacaagccggccgacgactccaaggctatcgttgctgtcaaggacgctgctgagaaacctgcagctacaggaggttcaactgaaagagatgcttatctcgcgaaaattgtatccgagaagagattgactctgatcactgcatgggaggagagtgagaaggcgagagctgagaacagggctgccaagaagcttgcctacatcacatcctgggagaacgcgaagaaagcagagatggaggccgagcttaaaaagatcgaggagcaactggagaagaagaaggcggcgaacgaagagaagctgaagaacaagctggcgatgctccacaagacggcggaggagaagagggcgctgacggaggcgaagcgcggggaggagatgatcatggcggaggagctggccgccaagtaccgcgccaagggtgaggctcccaccaagctcttcggcctcttgaaagcataagatgaagcgcccacgatctctgccgaagaatatgcatacgttggaattgttacctgtagtagacttggtgcgtggcatgtttgtgctttgtgaatgtgtat

SEQ ID NO: 12278 - protein, 187 aa, Panicum virgatum
  misc_feature: Ceres CLONE 1761830
  misc_feature (73)..(182): Pfam Name: Remorin_C Pfam Description: Remorin, C-terminal region
  misc_feature (15)..(71): Pfam Name: Remorin_N Pfam Description: Remorin, N-terminal region
  misc_feature: The sequence is a functional homolog of SEQ ID NO 1773 in the 11/479,226 US patent application
  misc_feature: The sequence is a functional homolog of SEQ ID NO 20 in the 10/286,264 US patent application
  misc_feature: The sequence is a functional homolog of SEQ ID NO 876 in the 10/412,699 US patent application
  misc_feature: The sequence is a functional homolog of SEQ ID NO 438 in the 10/666,642 US patent application
  misc_feature: The sequence is a functional homolog of SEQ ID NO 496 in the 11/435,388 US patent application
  misc_feature: The sequence is a functional homolog of SEQ ID NO 1492 in the 11/479,226 US patent application
  misc_feature: The sequence is a functional homolog of SEQ ID NO 644 in the 11/435,388 US patent application
  misc_feature: The sequence is a functional homolog of SEQ ID NO 716 in the 10/412,699 US patent application
MAAEEAKKVEVEATKDIAEEKAIVPLPTPPAAAKIDKPADDSKAIVAVKDAAEKPAATGGSTERDAYLAKIVSEKRLTLITAWEESEKARAENRAAKKLAYITSWENAKKAEMEAELKKIEEQLEKKKAANEEKLKNKLAMLHKTAEEKRALTEAKRGEEMIMAEELAAKYRAKGEAPTKLFGLLKA

SEQ ID NO: 12279 - DNA, 718 bp, Panicum virgatum
  misc_feature: Ceres CLONE 1761862
  misc_feature: Encodes the peptide sequence at SEQ ID NO. 12280
atcacgccgcgacgcctcctctccctatccctccctccctccccccgcccagagctcgaaaccctaggcgcgcgcggcgggggcggcgacgcatggccatggacccggacgcggtggccaaggccttcgtggagcactactaccggacgtttgacaccaaccgcgccgcgctggtgtcgctgtaccaggacacctccatgctcaccttcgagggccagaagctccagggccccgccgccatcgccggcaagctcggctcgctccccttccagcactgcgagcaccagatcgtcaccgtcgactgccagccgtcggggccccagggaggcatgctcgtcttcgtctccggctccatccgcaccgcccccgacgagcaccccatgaagttctcccaggcgttccatttgatgccggctggaaattccttctacgtgcagaatgacatgttccgcctgaactatggttaaagacagtcaagagttgctggaagcgaagtgattaagggtttcatgttggattgatgaatatgaatgatgctgctactcttgcccctttgttggctgctgttgtttattgcaagaaaattgctagacttgatatgcttgttggataatttcttattttggatcatgtactctggttgcgtgggcaccgattctctgtggattgtgaatgaaaacggtccagatctattcatgtgagggatctcggtttgccc

SEQ ID NO: 12280 - protein, 124 aa, Panicum virgatum
  misc_feature: Ceres CLONE 1761862
  misc_feature (8)..(121): Pfam Name: NTF2 Pfam Description: Nuclear transport factor 2 (NTF2) domain
MAMDPDAVAKAFVEHYYRTFDTNRAALVSLYQDTSMLTFEGQKLQGPAAIAGKLGSLPFQHCEHQIVTVDCQPSGPQGGMLVFVSGSIRTAPDEHPMKFSQAFHLMPAGNSFYVQNDMFRLNYG

SEQ ID NO: 12281 - DNA, 834 bp, Panicum virgatum
  misc_feature: Ceres CLONE 1761870
  misc_feature: Encodes the peptide sequence at SEQ ID NO. 12282
atcgcgcgagtctgcactagggtttttgccgccgccgccgctctgccccccgcatcccctcccacccaccgagacgccaagatgacggcgcagaccgccgaggagctcgccgaccagatcaccgccgaggagctcgccgcccagatcgagcagcagaagctcgaggagcagaagaccgaggcagatgaggttgtggttgaggatgaggaggatgacgatgaggatgatgacgatgatgacaaggatgatgatgagggacaagaaggcgatgccagtggcaaatcaaagcaaagcaggagtgagaagaagagccgcaaggccatgctgaaacttggcatgaagccgatcactggtgtcagccgtgtcactgtgaagaaaagcaagaatatactgtttgtcatctccaagccagatgtgttcaagagcccaaactcagacacctatgtcatctttggtgaggccaagatcgaggacctcagctcccagctgcagacccaggctgcggaacagttcaaggctcctgacttgagccagatgatctccaagcctgagacatctggcctaggccaggaggacaatgaggaggaggttgatgagactggtgtcgagccaaaggacattgagctggtgatgacgcaggcatccgtatcgaggcccaaggctgtcagggccctcaaggctgccgatggggacattgtctctgccattatggagctgaccacttagagcgttatttttggcatggtctaaacattttccctctctgagtgttctgcagcttgagtgttatctgtgggaccataatgcttcgataatttcatcatgtttgcttgc

SEQ ID NO: 12282 - protein, 214 aa, Panicum virgatum
  misc_feature: Ceres CLONE 1761870
  misc_feature (72)..(131): Pfam Name: NAC Pfam Description: NAC domain
  misc_feature (175)..(212): Pfam Name: UBA Pfam Description: UBA/TS-N domain
MTAQTAEELADQITAEELAAQIEQQKLEEQKTEADEVVVEDEEDDDEDDDDDDKDDDEGQEGDASGKSKQSRSEKKSRKAMLKLGMKPITGVSRVTVKKSKNILFVISKPDVFKSPNSDTYVIFGEAKIEDLSSQLQTQAAEQFKAPDLSQMISKPETSGLGQEDNEEEVDETGVEPKDIELVMTQASVSRPKAVRALKAADGDIVSAIMELTT

SEQ ID NO: 12283 - DNA, 714 bp, Panicum virgatum
  misc_feature: Ceres CLONE 1761885
  misc_feature: Encodes the peptide sequence at SEQ ID NO. 12284
gcggtatggcgattcgcccattccatcgcttcccccctagcttccatccctccgtagtgacgccgagcttgaactccggccacgggcaccccgccggggcccacccgtcatctcagatctgcgcctggacggcgtcatctggccacccaccgccggtcctctccgtccttgactggccgtgggagaccccgaaactgaccgcgtccgggttgcgaagcttcaggcgaagcattcggcactcgacacgcaccgcctgttcgacgaaatgtcgagccgccagagcaagaaggcgtcgagtgcggacggcggcctgccggacgaggtcctccaccgcgtgctgtcgcacctgccggcgcccgaggccgcgcggaccagcgttctagccaggcgctggcgggacctctggaagtcgagccgccgcctgagcgtcgctttcccttgggcgtcggtgcctgacagcaggaccgagagacaggatggtgggattgctggcaactatccggggaggtgtgtggatgaagtttgtggccttggtgtttgcgccactgtgttttgtagttctcagatgtacctttacctggtttaaacggttgctcacctctcttgctctttggtttatgtatgtatagctttgcaagactagcgtacgttgctcaagtatgtagtcaccaactatttctaatatttgaaatttgaagaaccaactgttgggat

SEQ ID NO: 12284 - protein, 106 aa, Panicum virgatum
  misc_feature: Ceres CLONE 1761885
  misc_feature (11)..(58): Pfam Name: F-box Pfam Description: F-box domain
MSSRQSKKASSADGGLPDEVLHRVLSHLPAPEAARTSVLARRWRDLWKSSRRLSVAFPWASVPDSRTERQDGGIAGNYPGRCVDEVCGLGVCATVFCSSQMYLYLV

SEQ ID NO: 12285 - DNA, 454 bp, Panicum virgatum
  misc_feature: Ceres CLONE 1761920
  misc_feature: Encodes the peptide sequence at SEQ ID NO. 12286
tcttcccgtgggatcccagccgccgcctttgccgccgccgccgccgcgagaagaagagctcggcgactccccggtcgtacgagaagatgccgaagcagatccatgagatcaaggacttccttctcaccgcgaggaggaaggatgcccggtctgtgaagatcaagaggagcaaggatgttgtcaagttcaaggtgcgctgctccaagtacttgtacaccctctgcgtcttcgatgctgagaaggcaaacaagttgaagcaatcccttcccccaggtttgaccgtccaggaggtttgaagggacacaagacaacatcaagatgtgaactatcaaagcttccttatcatcagcagagcattctcttcgatgtacctttggaacctaagcttttagacctgtcagtcatggatttgtagatcttggatttttggagaaataccattttaccgtattcc

SEQ ID NO: 12286 - protein, 69 aa, Panicum virgatum
  misc_feature: Ceres CLONE 1761920
  misc_feature (2)..(69): Pfam Name: Ribosomal_L38e Pfam Description: Ribosomal L38e protein family
MPKQIHEIKDFLLTARRKDARSVKIKRSKDVVKFKVRCSKYLYTLCVFDAEKANKLKQSLPPGLTVQEV

SEQ ID NO: 12287 - DNA, 810 bp, Panicum virgatum
  misc_feature: Ceres CLONE 1761922
  misc_feature: Encodes the peptide sequence at SEQ ID NO. 12288
cgccgcccccacccaaactctagcgccgccgccgctgcgatcccagcagccgccaccgcaaccatggctgccgtgctcacccgcccggccgcgggcaccgtccagtgcttcggccgcaagaagacggccgtggccgtggcctacaccaagcccgggcgcgggctgatcaaggtgaacggtgtccccatcgagctcatccgcccggagatcctccgcctcaaggccttcgagcccatcatgctcgccggccgctcccggttcaaggacatcgacatgaggatccgcgtccgcggcggagggaagacgtcgcagatctacgccatccgccaggccgtcgccaaggcgctcgtcgcctacttccagaagtacgtcgacgaggccgccaagaaggaggtcaaggacatcttcggccgctacgaccgcaccctcctcgtcgccgaccccaggcgctgcgagcccaagaagttcagtggtcgcggtgcccgcgccaggttccagaagtcttaccgttaagcagcgattgcttgacgcgtcacaatctgccatatcactctgggtgtgtgttcttggcttcgtgttcaatcaatggatcaacttatctggttctatatctagctgctgctttaccttcatgtctagacttttaagcctagtgttgaactttttttttgacattgtgatgtgaaatgtgagagatattcaagaagacaattcggtagtcgcttaagtattgttggttttgcttgttacctatgtccaggaattatgatatggtttccttttatctgtacctgtttcatgcttatgctt

SEQ ID NO: 12288 - protein, 149 aa, Panicum virgatum
  misc_feature: Ceres CLONE 1761922
  misc_feature (17)..(149): Pfam Name: Ribosomal_S9 Pfam Description: Ribosomal protein S9/S16
MAAVLTRPAAGTVQCFGRKKTAVAVAYTKPGRGLIKVNGVPIELIRPEILRLKAFEPIMLAGRSRFKDIDMRIRVRGGGKTSQIYAIRQAVAKALVAYFQKYVDEAAKKEVKDIFGRYDRTLLVADPRRCEPKKFSGRGARARFQKSYR

SEQ ID NO: 12289 - DNA, 703 bp, Panicum virgatum
  misc_feature: Ceres CLONE 1761949
  misc_feature: Encodes the peptide sequence at SEQ ID NO. 12290
agaccagtctgtaccaccgaaccggaggaggcaggaggccaggagctgccagccaaacagaaacaggattgcgagaagatgccgccgccgccgccggtcaatccgcagcggctgtcgccggcggagtcccgggagcggacgctgcacttcttccacggcctgggcgtagacgtgccgctcccggcctcggccgagcgcgccgacgcctacgccgcgctcgtccgcgtcatcgtctcctccgccaccgtctcctcgtcgcgcgtctcctgcaccctcaccatctcccccggcgtcgcgaaccagtacaacacgctccacggcggcgcggtggcggccgtggcggaggccgtcgggatggcgtgcgcgcgggccgcggcgggcgacaaggagatgttcctcggcgagctcagcacggcctacctcgccgccgcgcgagtcaactctgaagtagatgttgaagcgcagatactgaggaagggcaggtcggtcgtcgttaccactatcgagttcagactgaaggacaccaagaagctctgctacacatctcgggccaccttttacataatgcccgtggcaagcctatgaacaatcaagtttacatgtgcaaattgttgtatttacagtaccagtgttgtattttgtataattaaatcagagaacatatgcatgtcgtattaatgatgaaataaaaccatatcaatcc

SEQ ID NO: 12290 - protein, 168 aa, Panicum virgatum
  misc_feature: Ceres CLONE 1761949
  misc_feature (76)..(153): Pfam Name: 4HBT Pfam Description: Thioesterase superfamily
MPPPPPVNPQRLSPAESRERTLHFFHGLGVDVPLPASAERADAYAALVRVIVSSATVSSSRVSCTLTISPGVANQYNTLHGGAVAAVAEAVGMACARAAAGDKEMFLGELSTAYLAAARVNSEVDVEAQILRKGRSVVVTTIEFRLKDTKKLCYTSRATFYIMPVASL

SEQ ID NO: 12291 - DNA, 811 bp, Panicum virgatum
  misc_feature: Ceres CLONE 1761974
  misc_feature: Encodes the peptide sequence at SEQ ID NO. 12292
acctacggatatttcccagccatcctcctgccgcggttcgcgttgctgcgccgcgatccaggaagagaatcgaggaggagggcggaggagccatggcgagcgagcacgcggagccgaagcagaagcagagcctgatggacaaggccaaggagttcgtggcggacaagatcgcgcacatccccaagccggaggcgacgctcgacggcgtctccttcaagagcatgagccgcgagtgcatcaccctgcacagcaacgtcaacgtctccaacccctacgaccaccgcctccccatctgcgaggtcacctacaccctcaagtgcgccggcaaggttgtggcgtccggcaccgtgcccgaccccggctggatcgccgccagcgacaccaccaagctggagatccccgccaaggtgccctacgacttcctcatctcgctcatgaaggacgtgggcagggactgggacatcgactacgagctccaggtcgggctcaccgtcgacctccccatcatcggaaacttcaccatcccgctctccaccagcggcgagttcaagctcccaaccctcaaggacatgttctaataattcatcagattccgtggcgtcgaccatgtaccaccaatgtaactctgtcatctcatccccacggctgtatgaatcctagtgccgtcttgcaaataaaggcagatgctctgtttcagttctaccacatactgctacggcataccagtatcagctgcctgaacatctgtttctgaatgcatgcctaatggttgcaataaagagctagatgcctgaatttcaggtttcagcag

SEQ ID NO: 12292 - protein, 161 aa, Panicum virgatum
  misc_feature: Ceres CLONE 1761974
  misc_feature (12)..(161): Pfam Name: LEA_2 Pfam Description: Late embryogenesis abundant protein
MASEHAEPKQKQSLMDKAKEFVADKIAHIPKPEATLDGVSFKSMSRECITLHSNVNVSNPYDHRLPICEVTYTLKCAGKVVASGTVPDPGWIAASDTTKLEIPAKVPYDFLISLMKDVGRDWDIDYELQVGLTVDLPIIGNFTIPLSTSGEFKLPTLKDMF

SEQ ID NO: 12293 - DNA, 550 bp, Panicum virgatum
  misc_feature: Ceres CLONE 1762006
  misc_feature: Encodes the peptide sequence at SEQ ID NO. 12294
agttcaggcaacagagcagcagcacaggcgtcgccatggcctcccagctctccgccgccgcttccatgtccgccgccgtgccgcagttccacggcctccggggccggtccgtggcggcgctgccgccggtgagggccggcaggaagcgcgcgcagggcatgcggtgcgactacatcggctcggccaccaaccagatcatggtggtgtcgacgacgctgatgctggtggcggggcggttcgggctggcgccgtcggcgaaccggaaggcgacagcggggctgaagctcgaatcccgcgactccggcctgcagaccggcgaccccgccgggttcacgctcgccgacacgctggcctgcggcgccgtcggccacatcatcggcgtcggcatcgtgctcgggctcaagaacaccggcgcgctcgaccagatcatcggctaggtccagtgtctgcctttgccgctctcggcgccggcccggtgcccatgtaacctgcgtgtgtacatcgactccgcgctcatgcatctcgttccaatggacatagcttgtttgtt

SEQ ID NO: 12294 - protein, 133 aa, Panicum virgatum
  misc_feature: Ceres CLONE 1762006
  misc_feature (48)..(128): Pfam Name: PSI_PSAK Pfam Description: Photosystem I psaG / psaK
MASQLSAAASMSAAVPQFHGLRGRSVAALPPVRAGRKRAQGMRCDYIGSATNQIMVVSTTLMLVAGRFGLAPSANRKATAGLKLESRDSGLQTGDPAGFTLADTLACGAVGHIIGVGIVLGLKNTGALDQIIG

SEQ ID NO: 12295 - DNA, 882 bp, Panicum virgatum
  misc_feature: Ceres CLONE 1762009
  misc_feature: Encodes the peptide sequence at SEQ ID NO. 12296
atcgaacgccaaacccaccggccaccatcggagtcgcggaaggcaagagggagtcggtctccaacccccccgcgctgcacgcacgacgccgacgcgggatcaaggaagcaaggaaccagggcaagcgaccgccgccatggacatggcctccgcgtccgcgcccagcacctcctcccacaacatctccctggcgcaggccgtgctgacgctctccgtcaacgccgtcctcttcttcctcaccgccgtcatcaagtccgccgccgccaccaccacctcctcctcctcctcctccagccgccgcgacgctgcccccgctcccgcccctgccgccgcacccgcgtcgccggctccggctaagcccgccgtcgcagcggccgctggcgcgaacgacatggacgtggtgctcggggtgatgggcgccggcagcgccgccgcgtcggtggggttcgaggaggccgcggcgctgttcgacgaggaggaggcgaccgtggaggaggcccgcgccgcgttcgcggtcttcgaccgcgacggcgacgggttcatcgacgccgcggagctccggagcgtgctcgggtcgctcgggttcggcgccggcgccggcgccgtggagtgccagcgcatgatcgacgcgtacaacgaggacagggacggcaggatcgacttcggcgagttcgtcaagctcatggagacgagctcgtgagttaggaatagtatagccatttgttggaccgccgggccggatgagtccctctgtttcattccaagattctttgttcgttagttctttctatgctttttcttggccggaattgagccgaatgatgcatccagtacatgtgtatactcacaatctagatatgggcacatgattttctgaagatc

SEQ ID NO: 12296 - protein, 187 aa, Panicum virgatum
  misc_feature: Ceres CLONE 1762009
  misc_feature (120)..(148): Pfam Name: efhand Pfam Description: EF hand
  misc_feature (158)..(186): Pfam Name: efhand Pfam Description: EF hand
MDMASASAPSTSSHNISLAQAVLTLSVNAVLFFLTAVIKSAAATTTSSSSSSSRRDAAPAPAPAAAPASPAPAKPAVAAAAGANDMDVVLGVMGAGSAAASVGFEEAAALFDEEEATVEEARAAFAVFDRDGDGFIDAAELRSVLGSLGFGAGAGAVECQRMIDAYNEDRDGRIDFGEFVKLMETSS

SEQ ID NO: 12297 - DNA, 714 bp, Panicum virgatum
  misc_feature: Ceres CLONE 1762026
  misc_feature: Encodes the peptide sequence at SEQ ID NO. 12298
aacaaccagtccactcgctccgaggtgagtagtaggtaagcagcagctagtggtgcaggggagagcaaattaatcagcagctagtagctagcaatggcggctcatcagggaggaagaagaggcagcggtggtgtggtggtccttgcggcggcgcttgtcctctgcgtgctcctccacgaggcccaggtcgccgagtcggcggtgttcaccgtcggcgaccgcggcggctggagcttcaactccaacagctggaccaacggcaagcgcttcaaggccggcgacgtcctggtgttcaagtacgactcgtcggcgcacaacgtggcggcggtgagcgcggccgggtacaagggctgcagcgctccccggggcgccaagttctacagctccggcaacgaccgcgtcaccctcgcccgcggcaccaactacttcatctgcagcatccccggccactgccagtccggcatgaagatcgccgtcaacgccgcatgacgaccatgaccatgattctctttgagtgtgccttatgtgaatctgcttttgttattattaccacatatataggagtgctactgcatgcataaaaggttgttggttcagagtcgtgcttgatgatcgattattgtcagttgcagtggtgtgtgtggattgtgatcggtgcgagtttcatatcgatatatgaatgaataaacacatatatacatcatgattctgctt

SEQ ID NO: 12298 - protein, 131 aa, Panicum virgatum
  misc_feature: Ceres CLONE 1762026
  misc_feature (46)..(124): Pfam Name: Cu_bind_like Pfam Description: Plastocyanin-like domain
MAAHQGGRRGSGGVVVLAAALVLCVLLHEAQVAESAVFTVGDRGGWSFNSNSWTNGKRFKAGDVLVFKYDSSAHNVAAVSAAGYKGCSAPRGAKFYSSGNDRVTLARGTNYFICSIPGHCQSGMKIAVNAA

SEQ ID NO: 12299 - DNA, 809 bp, Panicum virgatum
  misc_feature: Ceres CLONE 1762027
  misc_feature: Encodes the peptide sequence at SEQ ID NO. 12300
atccgtctccgccagattccaacctcaaaccaaaaaatcccccaattccggcgtgcgagagcgcgaggaaggaggccaaggcggcggcgatgtcggggcgaggcaaggggggcaaggggctgggcaagggcggcgccaagcgccaccgcaaggtgctccgcgacaacatccagggcatcaccaagccggctatccggcggctggcccggaggggcggcgtgaagcgcatctcggggctcatctacgaggagacccgcggcgtgctcaagatcttcctcgagaacgtcatccgcgacgccgtcacctacaccgagcacgccaggcgcaagaccgtcaccgccatggacgtcgtctacgcgctcaagcgacaggggcgcaccctctacggcttcggcggctaggcggcgctggcgccggcgcgcctcctgcggggcgctgcgccctcgggcgtttcggggatgcagtgccgtctgtgattagggatgcttcgttgtttagttacttcgtcggcttgtgtcctggtgggtctggagctgatcttgctagcgatccctgttcgaattgttggtgacgaactgctattaatcttgtctgtctggagtgcctgtgcttctgttgtgattgttgtttcaagcggaatcttgttctgaatataagtgctagtagctacttattgtcgcaaaggttgtttcggtctaaccgtgctagtagctacttattgttctgaatcatgttttggttgcaagtgcaactggtaccattgtttaaaaatgggcatgcttcttgacaaacttttggctcaccgtacc

SEQ ID NO: 12300 - protein, 103 aa, Panicum virgatum; identical to SEQ ID NO: 12044
  misc_feature: Ceres CLONE 1762027
  misc_feature (25)..(94): Pfam Name: Histone Pfam Description: Core histone H2A/H2B/H3/H4

SEQ ID NO: 12301 - DNA, 804 bp, Panicum virgatum
  misc_feature: Ceres CLONE 1762031
  misc_feature: Encodes the peptide sequence at SEQ ID NO. 12302
acatccaataatcgatccaccactagcgatctcctgtagcaagaaagaagccatgtcgggtgtgtgggtgttcgaggacgggatcgttcggcgcgcggacagcgaccctccgagcggcgccggcgccggcgggtcgcggccgaacaaggtgctggtgcacgttcccagcggcgaggtggtgacctcctacgacgtgcttgagcggcggctccgcgagctcgggtgggagcgctacctctacgatccctgcctgctccagttccaccagcgctctaccgtgcacctcatcaccgttccccgcgactttgcccgcctcaagctcgtccacatgtacgacgtcgtcgtcaagacccgcaacgtcttcgaggtccgcgacgccgcgcccccagcctgaccgtcgcaggctcgcagagagcgccgccgctgccttcttcatcctcggcgactaaaccggccggcgctgcccggtttgattattgccgctgcccggtctgattgcggtcgagatcgagtgaagtagaagaatcatacgtgcgacgacatagcggcgcctgctcgcgaggcggctttgcatggactgctcctactacgttgtttggcgccaatatatatatatatatatatatatatatatatatatatatatatatatatatataagtttgccgctgtatgatttatttgtgattgagggagtgtttctttcaggaaagattgttgtacatgtgtatcgttcagggttatcgatatgatttgtatggtaatgtatggtttgtgaaataaagctgcttctttttcattttt

SEQ ID NO: 12302 - protein, 113 aa, Panicum virgatum
  misc_feature: Ceres CLONE 1762031
  misc_feature: Useful for making plants with modulated flowering time
MSGVWVFEDGIVRRADSDPPSGAGAGGSRPNKVLVHVPSGEVVTSYDVLERRLRELGWERYLYDPCLLQFHQRSTVHLITVPRDFARLKLVHMYDVVVKTRNVFEVRDAAPPA

SEQ ID NO: 12303 - DNA, 803 bp, Panicum virgatum
  misc_feature: Ceres CLONE 1762064
  misc_feature: Encodes the peptide sequence at SEQ ID NO. 12304
atccatcacaaccgacctccgatccacttctgctcaccagacactgctaagctagctagctgctttacacttcactcactagtcactagcagcttgatcattcgacgatcagtgagtgttatcatatatcagtcgtagctgcaatattatatatagaattttatatatggctcgcctctccgccgttgtcgccgtcgtcctggtggctgcgctggtggcggccgagaccgcttcggctgcggtgagctgcagccaggtgacgtcggccgtggcgccgtgcctggggtacgccatgggcagctcggcgtcgccctcgtcggcgtgctgcaacggggtgaggtcgctcaacagccgggcgtcgtcgacggcggacaggcaggcggcgtgcgcctgcctcaagaacatggcggggaggctgggtggcaacatgggcaacgccgccgccagcatcccaagcaagtgcggcgtcaacgtcggcgtgccaatcagcccaaacgtcgactgcgccaagattaactgataagatgctatggatggatgctcagctctttccttctctttgggtatgatgtcggccaacagagcagagagcagtcgtttaatttactacctcttccttttacatttgtacaacaccacgcaccacctgtgcacgtcgtcgtctatgtacaacaataatcctctctctgcttatgtgtttgctgggtctctgttttcatgtactactaccatgctgctgctgctactgcttgttataggcaggtcaggcagctctccgctcaatcaataaactttttttctgc

SEQ ID NO: 12304 - protein, 117 aa, Panicum virgatum
  misc_feature: Ceres CLONE 1762064
  misc_feature (28)..(113): Pfam Name: Tryp_alpha_amyl Pfam Description: Protease inhibitor/seed storage/LTP family
MARLSAVVAVVLVAALVAAETASAAVSCSQVTSAVAPCLGYAMGSSASPSSACCNGVRSLNSRASSTADRQAACACLKNMAGRLGGNMGNAAASIPSKCGVNVGVPISPNVDCAKIN

SEQ ID NO: 12305 - DNA, 1008 bp, Panicum virgatum
  misc_feature: Ceres CLONE 1762074
  misc_feature: Encodes the peptide sequence at SEQ ID NO. 12306
ctctcccttcctcccagccgcgcgaaaagacgagactaccccgctgcctcgaagtcagagggggactcgaggagagggggatagggtagcgcatcgtcgtcgctccggtcgtcggcgagccagcaggcagcgatggcggtggaggtagcggagctgtgggagacgctgaagcaggcgatcttcgcttacacggggctgtccccggcggccttcttcacggccgtggcggtggcggccgcgctgtaccacatcgtgtcggggctcttcgcgcccccgcccccgccgccgccgcgcccgcgggaggagcccgaggcggagccgctcccgccgcccgtgcagatgggggaggtctccgaggaggagctccgccagtacgacgggtccgaccccaagaaaccgctcctcatggccatcaagggccagatctacgacgtctcccagagcagaatgttctatggtcctggtggaccttatgctctattcgctggtaaagacgccagcagggctctagccaagatgtccttcgagccacaggacttaaccggcgacatctctggccttggtcccttcgagctggacgccctgcaggactgggaatacaagttcatgagcaagtacgtgaaagttggtaccgtcaagaagactgtccccgttgaagatggcaacaccgcaagcacagctgctcctgaaaccagtgagaccgcacccacggcaccagcaactgaagagaagccgagggagatagctgtggaggaagtgaaggagaaggaagctgctgctgctgaaggcgccaaggagagctagagtggctcagagctcctgcgtatgcggcaaataaatggacatggttccgttggtttcgtgtcagggcactgccatcctctcctatcagcgacatagcctgtgtaatttggatatgtaatctggaccagcgccatggccctactgggctttatattattatcagtcgtcattgttgatttggagtacaaaggcatccagttgtgc

SEQ ID NO: 12306 - protein, 223 aa, Panicum virgatum
  misc_feature: Ceres CLONE 1762074
  misc_feature (72)..(169): Pfam Name: Cyt-b5 Pfam Description: Cytochrome b5-like Heme/Steroid binding domain
  misc_feature: Useful for making plants with modulated nitrogen use efficiency
MAVEVAELWETLKQAIFAYTGLSPAAFFTAVAVAAALYHIVSGLFAPPPPPPPRPREEPEAEPLPPPVQMGEVSEEELRQYDGSDPKKPLLMAIKGQIYDVSQSRMFYGPGGPYALFAGKDASRALAKMSFEPQDLTGDISGLGPFELDALQDWEYKFMSKYVKVGTVKKTVPVEDGNTASTAAPETSETAPTAPATEEKPREIAVEEVKEKEAAAAEGAKES

SEQ ID NO: 12307 - DNA, 308 bp, Panicum virgatum
  misc_feature: Ceres CLONE 1762124
  misc_feature: Encodes the peptide sequence at SEQ ID NO. 12308
ggacaaacaaggcgcacaagaacggcatcaagaagcccaagcgccaccgccagacctccactaaggggatggaccccaagttcctgaggaacctgaggtacggggggaagaacaacaagaagagcggtgaggctgaagcggaggagtaagatggaagtttatgctcttacaaaagcaaagatgtgtttacccttcctagctccgttttacctttattttttggattttctttaaggatggagtttgaatggtgttatgtatgatgggtttttttttctcccgctgcttaagtgttactatgatattat

SEQ ID NO: 12308 - protein, 48 aa, Panicum virgatum
  misc_feature: Ceres CLONE 1762124
  misc_feature (1)..(30): Pfam Name: Ribosomal_L29e Pfam Description: Ribosomal L29e protein family
TNKAHKNGIKKPKRHRQTSTKGMDPKFLRNLRYGGKNNKKSGEAEAEE

SEQ ID NO: 12309 - DNA, 590 bp, Panicum virgatum
  misc_feature: Ceres CLONE 1762150
  misc_feature: Encodes the peptide sequence at SEQ ID NO. 12310
atccctcaccccacgccgcctacgccgttccccgaatcgcgtcgtgtccatcctcctgcgcgccatggccaccgcgtctctgtccgctttctcgtcgcctctgtccgtcggcgggctcaggaagccgctcggggccgcggcgtcgtcgttccatcccctgcagccgagggcgaggccggcggccaggatggccgtgcgggcggcggcggcgtccatgaaggagaaagcggcggccgggctgaccgcggcggcagtggcggcggcgctggtgctgcctgacgtcgcggaggccgcgcagtccgggctgacgccgtcgctcttttttttcctgctcagcatcgtgtccggcggggtcgtgctcgtggccatcgtcgtttttttcgtcgccgtctccaacttcgaccccgtcaagcgggcctgatggatggatcgttcgttcgttaggagctgaggcccgtttctcccctgtatcatgcatgtatcgagtggtaaatccttatgtgttcctattttctttggagaagagaatgttccaacatagtatttatcgtcatacagagtttgagttaaaccatcgttgcctttggttt

SEQ ID NO: 12310 - protein, 118 aa, Panicum virgatum
  misc_feature: Ceres CLONE 1762150
  misc_feature: Useful for making plants with modulated nitrogen use efficiency
MATASLSAFSSPLSVGGLRKPLGAAASSFHPLQPRARPAARMAVRAAAASMKEKAAAGLTAAAVAAALVLPDVAEAAQSGLTPSLFFFLLSIVSGGVVLVAIVVFFVAVSNFDPVKRA

SEQ ID NO: 12311 - DNA, 910 bp, Panicum virgatum
  misc_feature: Ceres CLONE 1762182
  misc_feature: Encodes the peptide sequence at SEQ ID NO. 12312
aaaaacgagggtttggccgccgcctcggccgcccactcctaccatttcgcccccgctccctctctcccagtctcctcgccgagagggtgacggaaagcgacgcggcgcgagcgcgagaagagggccaggggcaagggacgccctagtggacactccgcgccgccgccgcctcagggctcgagattgtgtcagctttcaagatgtcgatcagcacatttgctactccctgcgtgctgttgagcaatgttagaacacagagctcccagacagcggtgaagagcccttcatctctaaacttcttcagccaaggcatgaaggttccaagcctgaagacctccaaaaaactcgatgtctctgcgatggctgtgtacaaggtgaagctcgtcacaccagaaggggtagagcatgagtttgaggctccagatgacacctacatcctcgacgcagctgagaccgccggagtggagttgccatactcatgccgtgctggagcttgctccacctgtgctggcaaaattgaggctggcgaggtcgaccagtcagatgggtccttccttgatgacgggcagcaggctgagggctatgtgctgacatgcgtctcctaccccaagtctgactgtgtcatccacacccacaaggaaggtgacctgtactagggctttcagtccggcaagggaccaatgctatcgagtgtgttgtcaagcaaagctccatcctccttcaagttgtgtcaactctctggcatcaaacttggatggtggttgtcttgtttgttctgtttgtgcgagttcagggaatcactgaaatcagggttggcgcattaagattgggaacccgtgggaatactagctagcaataaaaactggtgcgatgccataatagtataaacttcatgtggttgcttttttgt

SEQ ID NO: 12312 - protein, 151 aa, Panicum virgatum
  misc_feature: Ceres CLONE 1762182
  misc_feature (62)..(138): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase
MSISTFATPCVLLSNVRTQSSQTAVKSPSSLNFFSQGMKVPSLKTSKKLDVSAMAVYKVKLVTPEGVEHEFEAPDDTYILDAAETAGVELPYSCRAGACSTCAGKIEAGEVDQSDGSFLDDGQQAEGYVLTCVSYPKSDCVIHTHKEGDLY

SEQ ID NO: 12313 - DNA, 684 bp, Panicum virgatum
  misc_feature: Ceres CLONE 1762191
  misc_feature: Encodes the peptide sequence at SEQ ID NO. 12314
tcttcgggcacgccttctatccttgcgccgccgccatctacgcccgagccgcttccccgtcagtctcttcgagcatcaaccatggccgagcagactgagaaggctttcctcaagcagcctaaggtgttcctctgcccgaagaaggccaacaaggggaacaagcctggcaagggcggcaacaggttctggaagaacattggccttggtttcaagactcccagagaagccattgaaggaacctacattgataagaaatgcccgttcaccggcactgtgtcaattagaggtcgcatcattgcgggaacatgccatagtgctaaaatgaacaggactatcattgttcgtaggaactaccttcacttcgtcaagaaataccagaggtatgagaagaggcactctaacatccctgcccacatttccccctgcttccgtgtgaaggaaggagaccacgtgatcattggccagtgcagaccactgtccaagaccgtgaggttcaatgtgctgaaggtgatccctgctgggtccaagagtggtgcagtaaagaaggcattcactgctgcctgagattctgaaaaccacagatcatcagattttgatgtcccattctgtattgctatttgatctgtactaggatttttgactgaaaatatcgtgacaaattaaagtcaaagagctgctggattc

SEQ ID NO: 12314 - protein, 160 aa, Panicum virgatum
  misc_feature: Ceres CLONE 1762191
  misc_feature (74)..(143): Pfam Name: Ribosomal_S17 Pfam Description: Ribosomal protein S17
MAEQTEKAFLKQPKVFLCPKKANKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 12315 - DNA, 549 bp, Panicum virgatum
  misc_feature: Ceres CLONE 1762224
  misc_feature: Encodes the peptide sequence at SEQ ID NO. 12316
aagtaccgcacgttcagttcagggaacagagcagcagcacaggcgtcgccatggcctcccagctctccgccgccgcgtccatgtccgccgccgtgccgcagttccacggcctccggggccggtccgtggcggcgctgccgccggcgagggccggcaggaagcgggcgcagggcatccggtgcgactacatcggctcggccaccaaccagatcatggtggtgtcgacgacgctgatgctggtggcggggcggttcgggctggcgccgtcggcgaaccggaaggcgacggcggggctgaagctcgagtcccgcgactccggcctgcagaccggcgaccccgccgggttcacgctcgccgacacgctggcctgcggcgccgtcggccacatcatcggcatcggcatcgtgctcgggctcaagaacaccggcgcgctcgaccaaatcatcggctaggtccagtgtctgcctttgccgctctcggcgccggcccggtgcccatgtaacctgcgtgtgtacatcgactctgcgctcatgcatctcgttccaacgg

SEQ ID NO: 12316 - protein, 133 aa, Panicum virgatum
  misc_feature: Ceres CLONE 1762224
  misc_feature (48)..(128): Pfam Name: PSI_PSAK Pfam Description: Photosystem I psaG / psaK
MASQLSAAASMSAAVPQFHGLRGRSVAALPPARAGRKRAQGIRCDYIGSATNQIMVVSTTLMLVAGRFGLAPSANRKATAGLKLESRDSGLQTGDPAGFTLADTLACGAVGHIIGIGIVLGLKNTGALDQIIG

SEQ ID NO: 12317 - DNA, 854 bp, Panicum virgatum
  misc_feature: Ceres CLONE 1762233
  misc_feature: Encodes the peptide sequence at SEQ ID NO. 12318
tctctctaaaccctacccgcgccgccgcctcgcatcgccagccgccgccgccgccgccgccgctgaggtcagaccgaccagcttcaaccatggcggacgtcgatgtcgagcccgaggtcgccgccggcgcgcccaagaagaggacgttccgcaagtacagctaccgcggcgtcgacctcgacgcgctgctcgacatgtccaccgacgacctcgtccagctcttccccgcgcgcgcgaggagaaggttccagaggggtctgaagaggaagcccatggcgctcatcaagaagctgcgcaaggcgaaaaaggatgctcctgccggcgagaagccagagccagtgaggacccatctccgcaacatgatcattgtccctgagatgattggaagcatcattggtgtctacaacggcaagacattcaaccaggttgagatcaagcctgagatgattggccactacctcgctgagttctccatctcctacaagccggtcaagcatggtaggcccggtatcggtgccactcactcctcacggttcattccgctgaaatgagttattagcccagttatcagcctccagaatccagcacggaaggcgcatggcatgtcttgtttccttccagttgtgctgcttgttttgaacaagttacataccaatggtgttttgctctgttccagctctagaatcctagctaagcactgcacgatgtatgctgttttgagttaatcttatctatactgcgatgtggttacttttaacggcattgtgatcgcttcgctgttcttgtgcgctgtatgctttgctgaaatttgaacaccgccatatccttggtatatttgcctgaccttactggtt

SEQ ID NO: 12318 - protein, 153 aa, Panicum virgatum
  misc_feature: Ceres CLONE 1762233
  misc_feature (55)..(136): Pfam Name: Ribosomal_S19 Pfam Description: Ribosomal protein S19
MADVDVEPEVAAGAPKKRTFRKYSYRGVDLDALLDMSTDDLVQLFPARARRRFQRGLKRKPMALIKKLRKAKKDAPAGEKPEPVRTHLRNMIIVPEMIGSIIGVYNGKTFNQVEIKPEMIGHYLAEFSISYKPVKHGRPGIGATHSSRFIPLK

SEQ ID NO: 12319 - DNA, 794 bp, Panicum virgatum
  misc_feature: Ceres CLONE 1762240
  misc_feature: Encodes the peptide sequence at SEQ ID NO. 12320
aatgtcctactgctccatgctgcgcaagctgcagctcttgatcttggccttgttgctaatcctgctgagagcatcaagtcagcgaagttcttgtacctgatgggagctgatgatataagtctagacaagcttccagaagatgcatttgttctttatcaggggcaccatggtgacaaggctgtctatagggccaatgttattttgccatcttcagcattcagtgagaaggaaggtacctacgagaacaccgaaggttgcacccagtggaccatcccagctgttcctacagttggtgatgctagggatgattagaagatcattcgtgctctttctgaggttgctggggttcaactgccttacgacagtctgtcagctgtgagggatcggatcagcacagttgcacctaatctcattcacgtagatgagaaagaaccatgcacaatttctcctgaggtgaagccgccagtaaagcaacaagtgagctcaaccccattcaaaaccgtcattgagaacttctatatgactgatgcaatcacacgagcttcaaagataatggcccaatgcagtgcgaccttattgaaaaagtgaggtctgtgtccttcaagccaatcatcggcgaagagcatcttagttcccttcttttttctttgctacgagtctcaccacctgtagcttgcttggttgggaggttggtgtataatttggactgcctctagattttcagagcagcaaaacttgataagtgcatttctgtgtcatgtatgagaagcagagcatactcaataagcttgtcc

SEQ ID NO: 12320 - protein, 103 aa, Panicum virgatum
  misc_feature: Ceres CLONE 1762240
  misc_feature: SWISSPROT Homolog: EC 1.6.99.5 NADH dehydrogenase (quinone)
NVLLLHAAQAAALDLGLVANPAESIKSAKFLYLMGADDISLDKLPEDAFVLYQGHHGDKAVYRANVILPSSAFSEKEGTYENTEGCTQWTIPAVPTVGDARDD

SEQ ID NO: 12321 - DNA, 653 bp, Panicum virgatum
  misc_feature: Ceres CLONE 1762252
  misc_feature: Encodes the peptide sequence at SEQ ID NO. 12322
atctctcttaccctctcatttctctactaatcatctctcttctcttgtctctggagcacgccgccgtgggcaaccggatgcagctgaggaaggggcgtagttcaggagagaggatttgaggagtgatgttggctgaggaggctgccgctgctgcgaccgaggttcccgagaccgaggtcgagtccgaggccccggccgccgccgaggaggcggaggccaagcccgccaaagccaagaaggcatccaaggagaagaaggagaagaagcccgccacggcgaggaagccggccgcccacccgccgtacgtcgagatgatctcggaggcaatcgcggcgctcaaggagaggaccgggtcgagctcggtggccatcggcaagtacgtggaggagaagcacggcaggaagctgccgcccaacttccgcaagttgctggccgggcagctcaagaagctcgaggccgcggggaagttggcccacgtgaagaactcgttcaagctggccgccgccagacgggagctgggcgtgggtgattttttctctttttttcttatttttcaaaaatagatatgcatgtcggattgtatggattggatctatcttgtaaataattttttggatgatttgtggaatctatgagtattttgtcgatcgatt

SEQ ID NO: 12322 - protein, 145 aa, Panicum virgatum
  misc_feature: Ceres CLONE 1762252
  misc_feature (56)..(126): Pfam Name: Linker_histone Pfam Description: linker histone H1 and H5 family
MLAEEAAAAATEVPETEVESEAPAAAEEAEAKPAKAKKASKEKKEKKPATARKPAAHPPYVEMISEAIAALKERTGSSSVAIGKYVEEKHGRKLPPNFRKLLAGQLKKLEAAGKLAHVKNSFKLAAARRELGVGDFFSFFLIFQK

SEQ ID NO: 12323 - DNA, 612 bp, Panicum virgatum
  misc_feature: Ceres CLONE 1762268
  misc_feature: Encodes the peptide sequence at SEQ ID NO. 12324
acacttcggcggcgtgcgcgaggcgatcggatcggagcacaccataacaccatcccgacgaggcgacgaggaggaaggccggccggcgacccgggggaagaaggatggggaagactccggtgcggatgaaggcggtggtgtacgcgctgtcgccgttccagcagaaggtgatgccggggctgtggaaggacatcaccaccaagatccaccacaaggtcaccgagaactggatctccgccacgctcctcctcggccccgtcgtcggcacctaccaatatgcgatgtggtacaaggagcaggagaagctatcccacagatactaaatgagaggtcgtccaagttgactgccacagcagctggatttttcatgatggattatatatccttcaaggatgattaacatttgttggatgaattttggttgtactccttttcaccttcccatgcagataaggcatctgtgccttgcaaacttgttgaggcttgctccatttggtggcatcttctgtcactgaagaagttgttaaataaatcaaattaactgcctgcttcgttttattttccctttttagcgattggtaactgcctcactgggtttatcagttggttcag

SEQ ID NO: 12324 - protein, 72 aa, Panicum virgatum
  misc_feature: Ceres CLONE 1762268
  misc_feature: Useful for making plants with modulated nitrogen use efficiency
MGKTPVRMKAVVYALSPFQQKVMPGLWKDITTKIHHKVTENWISATLLLGPVVGTYQYAMWYKEQEKLSHRY

SEQ ID NO: 12325 - DNA, 504 bp, Panicum virgatum
  misc_feature: Ceres CLONE 1762280
  misc_feature: Encodes the peptide sequence at SEQ ID NO. 12326
ttcatgcggtcgcactcaaatgcatcttccggcatgggagttgctcctaacatcagggagacattcgttgagcttcagatgaccaccgcattccgaggggttatcttcaaaattgaggaaaagcaaaagcaggtggttgtcgagaagactggcgctactactgaaagctatgatgactttttggcctccctcccagaaaatgactgctttttctctctgtatgattttgacttcgtcacgggggagaacgtgcagaattttttttttttcccccctgcctggtccccgtccacttcccgcaggggggggaagatgctgtactccacctccaaggaccgcatcaagcatgacctcgatgggttccactacgagatccaagcaactgacccgtcagaggtggacattgaagtcctcagggagcgggctcactgaagctggtttacctatgaggggacctgtggagggccttggaacttcagccagattcaaattctattattcaaa

SEQ ID NO: 12326 - protein, 143 aa, Panicum virgatum
  misc_feature: Ceres CLONE 1762280
  misc_feature (16)..(143): Pfam Name: Cofilin_ADF Pfam Description: Cofilin/tropomyosin-type actin-binding protein
  misc_feature: Useful for making plants with modulated time to senescence
FMRSHSNASSGMGVAPNIRETFVELQMTTAFRGVIFKIEEKQKQVVVEKTGATTESYDDFLASLPENDCFFSLYDFDFVTGENVQNFFFFPPAWSPSTSRRGGKMLYSTSKDRIKHDLDGFHYEIQATDPSEVDIEVLRERAH

SEQ ID NO: 12327 - DNA, 809 bp, Panicum virgatum
  misc_feature: Ceres CLONE 1762293
  misc_feature: Encodes the peptide sequence at SEQ ID NO. 12328
acacaaagccgccgccgccgacccaggccacccacctcccgcctagctcctctccgaccagagcacacgagccgcccgccgcgtgccaccccatggccaccgcctgccgcttcgccgcgccgctcggcctcgccgcgccgccccgcggccgcgcccccgccggcgtcgtcgtggccgtcgcccaatgcggttccaaggtctcgagaggcgtcgccgtcagggcgacgtccagcggcgagggcgcgacggaggacgtgccggagatcgtcaaggctgcccaggacgcgtgggacaaagttgaggacaagtacgccgtggccaccatcggcgtcgccgccatcgtcgcgctctggacagcggcaggagctctcaaggccatcgagaagcttcctctcctgcccggtgtccttgagattgttggaatcggctatactgggtggttcacataccgcaacctcgtcttccagccggacagggaagctcttatcagcaaggtcaagagcacttacaaggagatcaccgggagcagcagctgatcaagcatcatttactagatggatcgttctgtaatcagatgctagaattgcatctgcaagcactgagctgccatgcaagtgaaagtgctaacatttgagactggatcctgtaccgtttctagtcctctgactaagtcactaagtcagagagaaacctctgctgatgagctagtctttttgcttattttgtaatatttataacatatttccagttcctttgcagactactgcacattctgaagtctgaagcatttgtgtgggattaaagaggac

SEQ ID NO: 12328 - protein, 147 aa, Panicum virgatum
  misc_feature: Ceres CLONE 1762293
  misc_feature: SWISSPROT Homolog: EC 6.1.1.9 Valine--tRNA ligase
MATACRFAAPLGLAAPPRGRAPAGVVVAVAQCGSKVSRGVAVRATSSGEGATEDVPEIVKAAQDAWDKVEDKYAVATIGVAAIVALWTAAGALKAIEKLPLLPGVLEIVGIGYTGWFTYRNLVFQPDREALISKVKSTYKEITGSSS

SEQ ID NO: 12329 - DNA, 666 bp, Panicum virgatum
  misc_feature: Ceres CLONE 1762302
  misc_feature: Encodes the peptide sequence at SEQ ID NO. 12330
aactacccccatcaacttgttgagagagatggcgagcccgatggtggccacccgggtccagctccgcaccagcaccggtcgcctctgcttctcctcctcccccatcgcactacccatgcggctattcgcggcggtgagggcgtctgcggaagcaatggcgacggagaacctgggcctcagggtggagcgcaccccgcccgaatcccacctctccgagctcggcgtccgccagtgacccaggtgagggtgccagaacatgaagttcccgtggacctactccgtcaaagacacgtgctacctgctgcaggggaaggtgaaggtgtaccccgagggccacaggtacgacttcctggagatcgccgcgagggacctaatcgtcttccccgatgacatgaactgcacctgggacatctcccaggccgtctacaagcactacaacttcgagtaccctccgccgctgccgcccatgcctaactaccctgttatggcactgcagttcagtaatttggtgaccgcctattgggaatgtttgaactgctcctgcttttccattcctgcctgcctgtacacgttctgtgctctgaaccagtgatgctccactcaagtgttaatcatcatgatagagctctggattaacaaactacgatacttgtgtttcgtttagcc

SEQ ID NO: 12330 - protein, 111 aa, Panicum virgatum
  misc_feature: Ceres CLONE 1762302
  misc_feature (2)..(60): Pfam Name: Cupin_3 Pfam Description: Protein of unknown function (DUF861)
MKFPWTYSVKDTCYLLQGKVKVYPEGHRYDFLEIAARDLIVFPDDMNCTWDISQAVYKHYNFEYPPPLPPMPNYPVMALQFSNLVTAYWECLNCSCFSIPACLYTFCALNQ

SEQ ID NO: 12331 - DNA, 610 bp, Panicum virgatum
  misc_feature: Ceres CLONE 1762335
  misc_feature: Encodes the peptide sequence at SEQ ID NO. 12332
ccttcctccttccaaccccaactccaaaccaccggcctcccataactccaaccagcacttaaccaccctctcccactgccccccaagaacccaccggcggcaagagccagccacatggcgccgtcgccaccgccgccacggcgagccgcgctgctgctgctgcttctgctgtcgtctcttctgctgctctccgccgtcgcccacgcggcccgggagtcggcggcggcggcgaagtcgagaggccacgcggagctccgaagccagcacggcgaggtggacggcgaggaggcggcgggcttcacggcggcggacgacgacggcggcccgtgctgcggcggcggaggaggaggcgaagcagaggaggagtgcctggtgaggcggacgctggtggcgcacaccgactacatctacacccagggaagaggccacaactagctactccgagctctcgcagctgcctctgcagatcgagatatctcgatgcaaccttccattccatccagtgtcgatcctgttcatatgatccaatgggaaaaggctgtgttagtgaagatgatcagatgagttttgcgaggctctgttgttgtgcatgaatgtaaccttttctctg

SEQ ID NO: 12332 - protein, 106 aa, Panicum virgatum
  misc_feature: Ceres CLONE 1762335
  misc_feature (13)..(105): Pfam Name: PSK Pfam Description: Phytosulfokine precursor protein (PSK)
MAPSPPPPRRAALLLLLLLSSLLLLSAVAHAARESAAAAKSRGHAELRSQHGEVDGEEAAGFTAADDDGGPCCGGGGGGEAEEECLVRRTLVAHTDYIYTQGRGHN

SEQ ID NO: 12333 - DNA, 615 bp, Panicum virgatum
  misc_feature: Ceres CLONE 1762339
  misc_feature: Encodes the peptide sequence at SEQ ID NO. 12334
gatctctcccttcgtttgtgcgtgcgcaggtaaagggttgggactcatggcgccgacgcagcccaagtccggcctcttcgtgggcatcaacaagggccatgtcgtcaccaagcgcgagctgccgccgcgcccgtcccaccgcaaggggaaagcaacgaagcgggtgaccatggtcaggggcctgatcagggaggttgctgggtttgctccttatgagaagcgaatcactgagcttctgaaggttggcaaggacaagcgtgctctgaaggttgctaaaagaaagctcggaactcacaagagggcaaagaagaagagagaggagatggccaatgtcctcaggaagatgagatctgctggtacccacactgataagaagaaatagagcatctcaagtccgtgaagctgggggcaacattctcctgtgtcggttttccctacctgtagaacctaatagacttgtcaaagtacctgccagcaaaacatcgtgttgttagttatgtgttgaaccaccccatgagtttttgatccaactttgaatgcatctatggtttgtctatcctttgctgtggtttacaataccttatatcttgttcacttcggtgattttgggttacc

SEQ ID NO: 12334 - protein, 111 aa, Panicum virgatum
  misc_feature: Ceres CLONE 1762339
  misc_feature (5)..(103): Pfam Name: Ribosomal_L36e Pfam Description: Ribosomal protein L36e
MAPTQPKSGLFVGINKGHVVTKRELPPRPSHRKGKATKRVTMVRGLIREVAGFAPYEKRITELLKVGKDKRALKVAKRKLGTHKRAKKKREEMANVLRKMRSAGTHTDKKK

SEQ ID NO: 12335 - DNA, 716 bp, Panicum virgatum
  misc_feature: Ceres CLONE 1762361
  misc_feature: Encodes the peptide sequence at SEQ ID NO. 12336
ttccagcgccgcctccctccggcctcctgcgccgccgccactgccacctccgcagcccgcagccatggcagactcgaaggccgccgcggcggtgaccctccgcacgcgcaagttcatgaccaaccgcctcctctcccgcaagcagttcgtgctcgaggttatccaccccggccgcgccaacgtctccaaggcggagctcaaggagcggctggcgaaggtgtacgaggtcagggaccccaactgcatcttcgtcttcaagttccgcacccacttcggaggcggcaagtccaccggcttcggcctcatctacgacaacctcgaggccgccaagaagttcgagcccaagtaccgcctcatcaggaatggccttgcaaccaaggtagagaagtcacgcaagcagatgaaggaacggaagaacagggcaaagaagatccgtggtgtgaagaagacaaaggctggagatgccaagaagaagtaaggaaagagataattgccttgccatcttcatcttacctgcctccggcttgttgaggacggtgtcctttttggcaatgctgaatgtttaattagacctagaaaggattttgccagaattatgaatgttgaggctctcgtagtactttgtggtcagttttgaggaatattgtcagacactagcatatatacttgattgtcatggttcttctgctatcttcattttgatttgtttgttttgg

SEQ ID NO: 12336 - protein, 137 aa, Panicum virgatum
  misc_feature: Ceres CLONE 1762361
  misc_feature (28)..(111): Pfam Name: Ribosomal_S24e Pfam Description: Ribosomal protein S24e
MADSKAAAAVTLRTRKFMTNRLLSRKQFVLEVIHPGRANVSKAELKERLAKVYEVRDPNCIFVFKFRTHFGGGKSTGFGLIYDNLEAAKKFEPKYRLIRNGLATKVEKSRKQMKERKNRAKKIRGVKKTKAGDAKKK

SEQ ID NO: 12337 - DNA, 514 bp, Panicum virgatum
  misc_feature: Ceres CLONE 1762365
  misc_feature: Encodes the peptide sequence at SEQ ID NO. 12338
gagaggacatgcccagtctatcagagccaatgcattgtcaatgcatcgaaccactacagcggcccattccaggcgacgacgcacgttgttgttggcggcgcaggagccagcctctcggagttcaccacctcaaagatccaatggagccacttcaccgacttcgaccatgggttcgtcaagctcacggccttcaaccattcatccctgctgttcgagtacaagaagagccgcgacggcaacgtgtacgaccatttcacgatctcgcgggactaccgggacatcctcgcttgctctatcgacaactgcccccggactacactggcttcctgaagtcccagtagttttcagacagggaattcagttcatggggtctcttggaacaatttagtagttgtacatatataactttttttttcttaggagtgcaccaataaatgagcattttttttgtctatgttattttgttgtacctgaatacccagcgggaaataagtttggtatatacttgaggtgc

SEQ ID NO: 12338 - protein, 109 aa, Panicum virgatum
  misc_feature: Ceres CLONE 1762365
  misc_feature: SWISSPROT Homolog: EC 3.1.3.2 Acid phosphatase
ERTCPVYQSQCIVNASNHYSGPFQATTHVVVGGAGASLSEFTTSKIQWSHFTDFDHGFVKLTAFNHSSLLFEYKKSRDGNVYDHFTISRDYRDILACSIDNCPRTTLAS

SEQ ID NO: 12339 - DNA, 855 bp, Panicum virgatum
  misc_feature: Ceres CLONE 1762367
  misc_feature: Encodes the peptide sequence at SEQ ID NO. 12340
tgattcccccacacagcaccactgcaacacacacagcatttgcttaattagctaataagcacgaccctatcggtactaatggcggctttgatgatgaagaacaagaagcagatgccggcggtggtggcattggccgttgtggtggcggcggcggcgctggtggcgtcggcgtcggcggccatcacgtgcgggcaggtgggttcggcgctggcgccgtgcatcccgtacgcgacggggaaggcgaacgcgctgccgtcgtcgtgcttcggcggcgtgcgcagcctcaacagcgcggcgcgcacgagctcggaccggcaggcggcatgccggtgcctcaagagcctggccagcaccgtcaagtcggtgaacatgggcaccgtcgccaccatccccggcaagtgcggcgtctccgtgccattccccatcagcatgtccactgactgcaacaaggtcaactaataaattgtgcatcaatataataatcctaccatctgatgaggaagctcagctcgatccgctcagaagctagctgctagctagcgagctttcaggagaataaaataaagttgaggcatcatcagcagctaggggtggtaatgggccatggccctaatggcctcttcacagcccaataaagcccttaaaatttttagttcaaaaatacatatgtttagagcccggcccttttagggcccgatccttagattttctagttcaaaatgttgggccctttaccacccctatcagcagcacatcatctatatatattattgttgtactcgatctgtgtgtacgtgcgcgtacacatacatgcatgcttatacgatcgatgtatatatatgtgctgcttctctc

SEQ ID NO: 12340 - protein, 126 aa, Panicum virgatum
  misc_feature: Ceres CLONE 1762367
  misc_feature (37)..(122): Pfam Name: Tryp_alpha_amyl Pfam Description: Protease inhibitor/seed storage/LTP family
MAALMMKNKKQMPAVVALAVVVAAAALVASASAAITCGQVGSALAPCIPYATGKANALPSSCFGGVRSLNSAARTSSDRQAACRCLKSLASTVKSVNMGTVATIPGKCGVSVPFPISMSTDCNKVN

SEQ ID NO: 12341 - DNA, 830 bp, Panicum virgatum
  misc_feature: Ceres CLONE 1762372
  misc_feature: Encodes the peptide sequence at SEQ ID NO. 12342
agacagggaaggatcccagcaggctcccatcagagcagaggagataggtaaggagaagcagggtgagcgcagcggcgcagggaggcggagaggaggggccgacaatgcaggagcaggcggcgagctcgcggccgtccaggtccagcagcgagaggtcctccagctccgcgcaccacatcgacatggaggtcaaggaagggatggagagcgacgaggagataaggagagtgccggagctgggcctggagctccccggcggcgcttccacgtcggggagggaggccggagctggcgccggcggcccggagcgcgcccagtcgtccacggcgcaggccagctcgcgccgccgcgtgcgcagccccgccgacaaggagcacaagcgcctcaaaagattactgaggaaccgggtgtcagcccaacaggcaagagagaggaagaaggcttatctgactgacctagaggtgaaggtaaaggacctggagaagaataactcagagatggaagagaagctctccaccctccagaatgagaaccagatgctccgacagatactgaagaacaccactgtaagcagaagaggcccaggcagcactgctggtggagagggccaatagcacagaagatgaggacaaatagtgatgcttttatgccaaaaaaatatatatacttatgtggaatggatttggtcagggcgttttctggccgaagaagagaaccccaaaaaaaaacggggtgaagaaattgtgcagacggtcatataatatctcactgtattaccatccgtatccgatgtacagacggttcagtggaaaaaacttgaggaatgcttg

SEQ ID NO: 12342 - protein, 169 aa, Panicum virgatum
  misc_feature: Ceres CLONE 1762372
  misc_feature (88)..(151): Pfam Name: bZIP_1 Pfam Description: bZIP transcription factor
  misc_feature: The sequence is a functional homolog of SEQ ID NO 206 in the 10/225,066 US patent application
  misc_feature: The sequence is a functional homolog of SEQ ID NO 2356 in the 10/374,780 US patent application
  misc_feature: The sequence is a functional homolog of SEQ ID NO 827 in the 11/479,226 US patent application
  misc_feature: Useful for making plants with modulated light quality sensitivity
  misc_feature: Useful for making plants with altered alkaloid content
  misc_feature: Useful for making plants with altered terpenoid content
MQEQAASSRPSRSSSERSSSSAHHIDMEVKEGMESDEEIRRVPELGLELPGGASTSGREAGAGAGGPERAQSSTAQASSRRRVRSPADKEHKRLKRLLRNRVSAQQARERKKAYLTDLEVKVKDLEKNNSEMEEKLSTLQNENQMLRQILKNTTVSRRGPGSTAGGEGQ

SEQ ID NO: 12343 - DNA, 731 bp, Panicum virgatum
  misc_feature: Ceres CLONE 1762494
  misc_feature: Encodes the peptide sequence at SEQ ID NO. 12344
acaccatgctcccaatggccgtccacccagccaccacgccggccctcgccccgcgcgcccgcctcgccccgcccagaccttccacctccctggccgccgcctcgtcctccgccggctctcgcatcgtccgtttcgagaccaggaggccgccccctcgttcgctccgcagcgtctccgccgccgccgctgccgacgccgtcgaggcagaggaagaagaggtgcaactaggtggaggcggggatgcgttttacgaggaggagccagaggagtataaggtggcggtgcccgagagacaggacccgatgctggtactcaagttcatctggatggagaagaacattggcatagcacttgaccagctggttccaggctatggcagcattccgttaagcccgtactacttttggccacggaaagacgcgtgggaggagttaagagcaaagctggaggagaaagagtggatctcgcagaagcagatgatcatccttctcaaccaggccaccgacataatcaacctctggcagcagggcggcgggagcctgtcaacatgagtccctcactccctcccctccctgttcttccagccttgcaaacttgttttttattggtcttttgacacgccttgtctattgttaattaatgttgaagtcacacggtacatggccttttagatcggtttcggttcaatctgttctcagatatggttttgttcatggaaatgatcgtgtgat

SEQ ID NO: 12344 - protein, 181 aa, Panicum virgatum
  misc_feature: Ceres CLONE 1762494
  misc_feature (128)..(176): Pfam Name: PSRP-3_Ycf65 Pfam Description: Plastid and cyanobacterial ribosomal protein (PSRP-3 / Ycf65)
MLPMAVHPATTPALAPRARLAPPRPSTSLAAASSSAGSRIVRFETRRPPPRSLRSVSAAAAADAVEAEEEEVQLGGGGDAFYEEEPEEYKVAVPERQDPMLVLKFIWMEKNIGIALDQLVPGYGSIPLSPYYFWPRKDAWEELRAKLEEKEWISQKQMIILLNQATDIINLWQQGGGSLST

SEQ ID NO: 12345 - DNA, 589 bp, Panicum virgatum
  misc_feature: Ceres CLONE 1762504
  misc_feature: Encodes the peptide sequence at SEQ ID NO. 12346
atcgctcgcataggcaatctgctccctcttcctctcggctagccggcctcaattcgtggcgtagggcaaaggcggcggcgagcgagcgaggatgctggagagccgggcggtgatcggggacacggacatgctgcaggcgatgcagcaggaggcgctgcggctggccgggaaggcgctggactacttcgaggccgtcgactccaccgagatcgcccggttcatcaagaaggagtttgaccggtcgtacgggcccggttggcagtgcatcgtgggcaccgacttcgggtccttcgtgacgcaccactccggctgcttcatctactttggcatcggcaacctggccatcctgctgttcaacggcggcgacggcgcggctcctcacggtgccgccggtgagaaggcgcggctcacggcgcggtgaaggctgctgtcagaggcgtgagggaatgttatgatcacttattgtggacttgtggtgtcactcgaaggggatgatagtgtagtgatcaaacatactgttggagtaatgggcttgacccatttattctaaagcattaaaagaatttaaagcccactattaatgctaggc

SEQ ID NO: 12346 - protein, 109 aa, Panicum virgatum; identical to SEQ ID NO: 12224
  misc_feature: Ceres CLONE 1762504
  misc_feature (1)..(91): Pfam Name: Dynein_light Pfam Description: Dynein light chain type 1

SEQ ID NO: 12347 - DNA, 706 bp, Panicum virgatum
  misc_feature: Ceres CLONE 1762519
  misc_feature: Encodes the peptide sequence at SEQ ID NO. 12348
agataagcctttccagatcatactagggcacttggatcacacaagaaagttcaggtcggaagaagatgcaggccgccgccgctacagccgtcgggttctctgctgcggcgcccgtgaagggcaggccggcggcgaggagcacggtggttgctcgtgtcccagccacaaggaggagcgttcgcgccgccgtggctgccgccatcgtcgcggcggagcccgccgaggtcgactacagctcgagcttctccgtgttccccatggaggcctgcgagctgctcggcggcgacgcctgcagcgcgcagatgtacccggaggctaagctcgccggctcggcggaggcggccggcaggagggaggaggaggtggagagggactacctgtcctacaacgagccgaagacggtgttccccggcgaggcgtgcgacgacctcggcggcgagttctgcgaggcgccgtaccaggccggcgtgtccagggagctggcgcacgcctgatcgggtcgaagggtgatgggaagctagcagatgatgcttacgcggtagatggggagctagcgtacgcgcacgtacagaataacagcagccaagcaaggccaaggacttgtcacgtgtgtaaatgtgcatgtctctttggtcgtgtcagctgcctgtctgtagaaactaaagatgaaatatatggtactggtggtgatactttttacagcttc

SEQ ID NO: 12348 - protein, 142 aa, Panicum virgatum
  misc_feature: Ceres CLONE 1762519
  misc_feature (1)..(130): Pfam Name: Lir1 Pfam Description: Light regulated protein Lir1
MQAAAATAVGFSAAAPVKGRPAARSTVVARVPATRRSVRAAVAAAIVAAEPAEVDYSSSFSVFPMEACELLGGDACSAQMYPEAKLAGSAEAAGRREEEVERDYLSYNEPKTVFPGEACDDLGGEFCEAPYQAGVSRELAHA

SEQ ID NO: 12349 - DNA, 783 bp, Panicum virgatum
  misc_feature: Ceres CLONE 1762537
  misc_feature: Encodes the peptide sequence at SEQ ID NO. 12350
atcccaagcagcagctagcatcaatggccacctcctcctcctcctcgatgaccctcctgctgctggtcctgggcgcctccttggcagccagcgccagcgccgcgaccttcaccatcaccaacaactgcgggttcacggtgtggccggcggcgacgcccgtgggcgggggcacgcagctgaaccgaggcgggacgtggaccgtcaacgtgccggcgggcaccagctccggccgcgtgtgggcgcgcacgggctgctccttcaacggcaaccgcgggagctgccagacgggcgactgcggcggcgcgctcgcctgcacgctgtccggccagccgccgctgacgctggccgagttcaccatcggcggcagccaggacttctacgacatctcggtcatcgacggcttcaacgtcggcatggccttctcctgcagcaccggcgtcgggctggtgtgcagggactccggatgccctgacgcgtaccacaaccccaacgacgtcaagacccatgcctgtggcggcaacagcaactaccgggtcaccttctgcccgtgatcgatgagatgaggctgccgtaataatgtatcaagtgattatatatatttgcagcaggaagaataatgcggacgcatcgtgcacggtatactgattgtgagagtagctacacacgagtgtagataaaactcgtccatatatatgtagctggatctgtgtacgtatactctgtatacagtataccatatggtatacaatacaataagactatgttcttgtcatgttggaaagc

SEQ ID NO: 12350 - protein, 175 aa, Panicum virgatum
  misc_feature: Ceres CLONE 1762537
  misc_feature (33)..(175): Pfam Name: Thaumatin Pfam Description: Thaumatin family
MATSSSSSMTLLLLVLGASLAASASAATFTITNNCGFTVWPAATPVGGGTQLNRGGTWTVNVPAGTSSGRVWARTGCSFNGNRGSCQTGDCGGALACTLSGQPPLTLAEFTIGGSQDFYDISVIDGFNVGMAFSCSTGVGLVCRDSGCPDAYHNPNDVKTHACGGNSNYRVTFCP

SEQ ID NO: 12351 - DNA, 681 bp, Panicum virgatum
  misc_feature: Ceres CLONE 1762542
  misc_feature: Encodes the peptide sequence at SEQ ID NO. 12352
aaacaagctagagcacgtcttcgagacacaagacagagagagagagagaagagaagggacagaaattacattagccaggtagagagatcgagctagctgcggtacgttcagtctcgtggttaggttccatggagagagtcgcatcaagctgcaccggcctcctgtcgcaaaggagggggtactccgtggccgctggggtggtgaagggaaccgggcggatggtcgtggagaaggtggccaagcgcgtgatgggcaaggaggcgatgaacacggcggctgcggccgccccggcggagaaggcgccgtgggtgccggaccccgtcaccggctactacagcccggcgggcgccgccgccaaggaggcggacgcggtggacctgcgcgccaagctgcttccgcagagggtcgccaactgaccgagtgatcgatcagttcaaatgcatggcggcttagcttgctaagatctccatgcgctcgctgatggccgggcaacgagccagccaacgaggcctggagcaggagggtgctgttgcgtctttgatgaggcatgataaatatagtttggagactttggcgagtgctccaccgtatgagctatagtacaaaagaacgtacatttccgtgacgtcgacctaaattatctgttccggcaaagatgattataaatattggtgtgttcag

SEQ ID NO: 12352 - protein, 95 aa, Panicum virgatum
  misc_feature: Ceres CLONE 1762542
  misc_feature (1)..(90): Pfam Name: LEA_3 Pfam Description: Late embryogenesis abundant protein
  misc_feature: Useful for making plants with modulated nitrogen use efficiency
MERVASSCTGLLSQRRGYSVAAGVVKGTGRMVVEKVAKRVMGKEAMNTAAAAAPAEKAPWVPDPVTGYYSPAGAAAKEADAVDLRAKLLPQRVAN

SEQ ID NO: 12353 - DNA, 705 bp, Panicum virgatum
  misc_feature: Ceres CLONE 1762551
  misc_feature: Encodes the peptide sequence at SEQ ID NO. 12354
aatccaaaatccgcagaccacgaagcggcagcgagacaagccatggcgctgtccctctccctcgcgcgcgccgcgcccctcgccgtctccgcgggcgccggggccaggaggctccccgccgccagcctcgccttcccgcccaagtccttcttcggcgcgccgctggccgccgccgccgcctccgtcgcgtcgccgctcccgcgcaagccggccacctcctccacctcgctcgcggtcgtcgcggcggggaagaaggggtacaagatgaagacccacaaggcgtcggcgaaacggttccgggtgacggggaggggcaagatcgtgcggcggtgcgccgggaagcagcacctgctcggcaagaagaacaccaagcgcaagaagaggctttccaagatggtccaagtaaacaagagtgactatgacaatgtgacaggcgcactgccctacctcaaagtgaataggaaagcagactgagttcttcttggtcttcaaaagccattctgtttcattcaccaacctgtaattttgtgtatcttcagctgtatttcctttcgaatatggaggccgtaattcatttcaacaaagcataaacaactcttcttaccgccagagtgcactgctagctgtagttgtttttggttgcaaatttttgaaaagactggcacgtggcacttgagccatatcttagtaagctggtgtgtatct

SEQ ID NO: 12354 - protein, 143 aa, Panicum virgatum
  misc_feature: Ceres CLONE 1762551
  misc_feature (75)..(133): Pfam Name: Ribosomal_L35p Pfam Description: Ribosomal protein L35
MALSLSLARAAPLAVSAGAGARRLPAASLAFPPKSFFGAPLAAAAASVASPLPRKPATSSTSLAVVAAGKKGYKMKTHKASAKRFRVTGRGKIVRRCAGKQHLLGKKNTKRKKRLSKMVQVNKSDYDNVTGALPYLKVNRKAD

SEQ ID NO: 12355 - DNA, 579 bp, Panicum virgatum
  misc_feature: Ceres CLONE 1762564
  misc_feature: Encodes the peptide sequence at SEQ ID NO. 12356
ggcaagttagcgcctttcccctccactccacgcagcccgaagcgccacggcggctcggccatggcgtcccctccgctccggcgccccagtccgaccgcgccgcgcttctcaaggccttcgacgaggcccgcacgggcgtccgcggcctcgtcgagtccggcgtctcctccgtccccgcgatcttcgtgcacccggacccctacgccatgtgcttctcctgtccacgggtttaacaaatttgatcattgaatttcgtagtaatctttctgcatctaatttcttgttatgcttttttttgcttggtagtgtctgattatacatgcaagagttacaaacccgatgcgacaatgaattaacatgccagaatttctattgttttttcccgtctctctgggatgagagaggcctcaaatatggaccattgcccacattgatttcattggaaaaccccgcaaagcacatgaattgtactatgagtttttgaggaccttgtttggccgagaacttaccagcatgctgcaattgagcattttaggtaatcgaattatatggttgtttaaaagtagccacacaaattgg

SEQ ID NO: 12356 - protein, 76 aa, Panicum virgatum
  misc_feature: Ceres CLONE 1762564
  misc_feature: SWISSPROT Homolog: EC 1.14.11.20 Desacetoxyvindoline 4-hydroxylase
QVSAFPLHSTQPEAPRRLGHGVPSAPAPQSDRAALLKAFDEARTGVRGLVESGVSSVPAIFVHPDPYAMCFSCPRV

SEQ ID NO: 12357 - DNA, 584 bp, Panicum virgatum
  misc_feature: Ceres CLONE 1762588
  misc_feature: Encodes the peptide sequence at SEQ ID NO. 12358
acaacaaagcctcccaattatcctttcatcagatcatcttccttcttccaagatgtcttgcagctgcggatcaagctgcaactgcagctccaactgcaagtgcggcaagatgtaccctgaccttgaggagaagagcagcggcggcgctcaggccaccatcgtcctcggcgtggccccggagaagaaggccggccagttcgaggcggcggcagagtccggcgagaccgcccacgcctgcaagtgcggtaacagctgcagctgcgacccctgcaactgctgatttcgatggggatttttttaacacacctgcatgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtgtctgtatgtgttgatcattgcaaagaaaccatgcaggcatacatctttgcatgtgtctctgtaatgatcggtccagagtgatgaatatataaaactggtttgcttt

SEQ ID NO: 12358 - protein, 75 aa, Panicum virgatum
  misc_feature: Ceres CLONE 1762588
  misc_feature (1)..(75): Pfam Name: Metallothio_2 Pfam Description: Metallothionein
MSCSCGSSCNCSSNCKCGKMYPDLEEKSSGGAQATIVLGVAPEKKAGQFEAAAESGETAHACKCGNSCSCDPCNC

SEQ ID NO: 12359 - DNA, 768 bp, Panicum virgatum
  misc_feature: Ceres CLONE 1762610
  misc_feature: Encodes the peptide sequence at SEQ ID NO. 12360
acttttcgcctttccgcactcgtctttggtcgtcgccttcttcgagttcccccagcctccaaatccccgccgagaaggaagccaggagcagcaagtcgccgagaagaggagagatggcccgtacgaagcagaccgcccgcaagtccaccggagggaaggccccccgcaagcagctcgccaccaaggcggcgaggaagtcggcgccgacgaccggcggcgtgaagaagccccaccgctacaggcccgggaccgtggcgctccgcgagatccgcaagtaccagaagagcacggagctcctgatccgcaagctccccttccagcgcctggtccgcgagatcgcgcaggacttcaagacggacctccggttccagagccacgccgtgctggcgctccaagaggccgccgaggcctacctcgtcgggctcttcgaggacaccaacctctgcgccatccacgccaagcgcgtcaccatcatgcccaaggacatccagctcgcccgccgcatccgcggcgagcgcgcctaagccgccgccgtaccagtaggggagagggaggaggtcaaagatgaaatcggcttgttgatctgccccccgccgcgcgtagtggatcttgctagttgttgtcggtctcggtttggttagtgtaaaaacaggtttacaagtcttatttacggctccgctcctattttcgcttcgcttcgagatgaagccagcttgttaaagacttaattcgtgatgttactagcagtaaaaaaattacattgttctt

SEQ ID NO: 12360 - protein, 136 aa, Panicum virgatum; identical to SEQ ID NO: 9871
  misc_feature: Ceres CLONE 1762610
  misc_feature (58)..(132): Pfam Name: Histone Pfam Description: Core histone H2A/H2B/H3/H4

SEQ ID NO: 12361 - DNA, 559 bp, Panicum virgatum
  misc_feature: Ceres CLONE 1762612
  misc_feature: Encodes the peptide sequence at SEQ ID NO. 12362
aaggcacccacacacatctcggcggcgtgcgcgaggcgatcagattcagatcggagcacgccgtcccgacgaggtaggaggaaggccggccggcgacccgggggaaggaggatggggaaaactccggtgaggatgaaggcggtggtgtacgcgctgtcgccgttccagcagaaggtgatgccggggctgtggaaggacatcaccaccaagatccaccacaaggtcaccgaaaactggatctccgccacgctcctcctcggccccgtcgtcggcacctaccaatatgcgatgtggtacaaggagcaggagaagctatcccacagatactaaatgaaaggtcgtccaagttgactgccacagcagctggatttttcgtgatggattatatagcctccaaggatgattataatttgttggatgaattttggttgtactccttttcaccttcccatgcatatatggcgccttgcaaacttgtttgaggcttgctacatttggtggcatcttctgtcactgatgatgtctttgaataaatcaaattaactgtctgtttcttttg

SEQ ID NO: 12362 - protein, 72 aa, Panicum virgatum; identical to SEQ ID NO: 12324
  misc_feature: Ceres CLONE 1762612
  misc_feature: Useful for making plants with modulated nitrogen use efficiency

SEQ ID NO: 12363 - DNA, 841 bp, Panicum virgatum
  misc_feature: Ceres CLONE 1762638
  misc_feature: Encodes the peptide sequence at SEQ ID NO. 12364
accaaacaaccgcagcgagccaaaccaaaccgctcctcactctcccctagctccccagcagcagcagcagctcccaagcaagccaaggcggccatgagcgtggtgatcctggacggctcgacggtgcgcgccttcgtggcggacgaggcggcgttcgcgcgcagcgtggacgcgcgcttcgcggcgctggacgccaacggcgacggcgtgctgtcgcgcaccgagctccggcgcgcgctcgagtcgttccgcctcctcgacggcggcggcttcgggtccgccgcgccggcgccgctcccagccgaggtcgccgcgctctacgacgccgtcttcgagcagttcgacgccgaccacagcggcgccgtcgaccgcgccgagttccgcgacgagatgcgccgcatcatgctcgccgtcgccgaggggctcggctcgcagccgctccaggtcgccgtcgacgacgagggcggcagcttcctgctcgaggccgccgagcacgaggccgccgcgatcgccgccaaggtcgacgccgagcgcaaggcagaggccgacaccgccaataagtgacgcgtgccgcgtgggggcggtgccggtgccggtgggtgacccgtaaccttgtgctctgcgctgctcgctgtactgcttctagatgttggtgtgcttggacgtgtcagccgttgcgctgctacacttgtacgttaacagaaaaccggccggcggtggcgctcctcctgctgctgctgctggtgggaaatgagagttttattctactgtactttagtaacttgtgaacggaataaaacggcttccaagtctcggatgtaacttggcggcaactttgtcc

SEQ ID NO: 12364 - protein, 156 aa, Panicum virgatum
  misc_feature: Ceres CLONE 1762638
  misc_feature (24)..(52): Pfam Name: efhand Pfam Description: EF hand
  misc_feature (75)..(103): Pfam Name: efhand Pfam Description: EF hand
MSVVILDGSTVRAFVADEAAFARSVDARFAALDANGDGVLSRTELRRALESFRLLDGGGFGSAAPAPLPAEVAALYDAVFEQFDADHSGAVDRAEFRDEMRRIMLAVAEGLGSQPLQVAVDDEGGSFLLEAAEHEAAAIAAKVDAERKAEADTANK

SEQ ID NO: 12365 - DNA, 720 bp, Panicum virgatum
  misc_feature: Ceres CLONE 1762641
  misc_feature: Encodes the peptide sequence at SEQ ID NO. 12366
gtgccgccagcccgccgttaaccctcgctcctctcgcgcccccaactccccctctcccccttgcggcggcgcgtccagctccatctctcaaccatggcggactccaagaccagcacggcggtcaccctccgcacccgcaagttcatgaccaaccgcctcctctcccggaagcaattcgtgctcgaggtgatccaccccggccgggccaacgtctccaaggcggagctgaaggagaggctggccaaagtgtacgaggtgaaagaccccaacaccatcttcgtcttcaagttccgcacccacttcggaggaggcaagtccactggcttcggcctcatctacgacaacctcgaggccgccaagaagttcgagcccaagtaccgcctcatcaggaatggtcttgctactaaggttgagaagtcccgcaagcaaatgaaagagaggaagaacagggccaagaagattcggggtgtcaagaagaccaaggctggtgatgcgaagaagaagtaaacacttatttacatttgtattactgttctggactctggggggtctagttgcactgtcataattatggttgttaggttttgttctaccctaagcactgaaatgaagttttgttattcctggatgtgaacttggccagattggctatagcatgttatgagaaggctattaacttgcaagccaacctattatctcatgcagttgtgtgatttgccc

SEQ ID NO: 12366 - protein, 137 aa, Panicum virgatum
  misc_feature: Ceres CLONE 1762641
  misc_feature (28)..(111): Pfam Name: Ribosomal_S24e Pfam Description: Ribosomal protein S24e
MADSKTSTAVTLRTRKFMTNRLLSRKQFVLEVIHPGRANVSKAELKERLAKVYEVKDPNTIFVFKFRTHFGGGKSTGFGLIYDNLEAAKKFEPKYRLIRNGLATKVEKSRKQMKERKNRAKKIRGVKKTKAGDAKKK

SEQ ID NO: 12367 - DNA, 787 bp, Panicum virgatum
  misc_feature: Ceres CLONE 1762642
  misc_feature: Encodes the peptide sequence at SEQ ID NO. 12368
aacaaacccccagacccaaccccatctgctcctgctcctcacggccccgtcgatccatcggcgatgacgccaggaagctccgccgccggatcgggcgtcgtcgttcctcggaacttcagactgctagaagagcttgagcgtggggagaagggcattggagatggtacagtgagctatggcatggatgatgcagatgacatctacatgagatcgtggactggcactatcattggcccacataataccgtccatgagggtcgcatctaccagctgaagttgttctgtgacaaggactaccctgagaagtcaccatctgttagatttcattcaagaataaacatgacatgtgttaatcatgagactggagtggttgacccaaagaagttcagtgtactggctaactggcagcgggagtacacaatggagtacattctgacccagctcaagaaagagatggcctccccacataaccgcaaactagtgcagcctccagaaggaacattcttctgaaatagctatttgttgccccatttgcggatttaacagcagaatctcatggccatccatggtgactccaaaaacatcttcacttggtagctatgattgatttctagtatgtgtgcctactatctgttgaccgctgcgaagcgtacgagtgaactttccttaaaatctttctggtggttgctaaagaaatggaatgaaacggttgccagtttggctggtattaagaatgtgtaatctgagaaactgctgttgcttgttgcatatatgattgtttgtttgc

SEQ ID NO: 12368 - protein, 148 aa, Panicum virgatum
  misc_feature: Ceres CLONE 1762642
  misc_feature (19)..(140): Pfam Name: UQ_con Pfam Description: Ubiquitin-conjugating enzyme
  misc_feature: SWISSPROT Homolog: EC 6.3.2.19 Ubiquitin--protein ligase
MTPGSSAAGSGVVVPRNFRLLEELERGEKGIGDGTVSYGMDDADDIYMRSWTGTIIGPHNTVHEGRIYQLKLFCDKDYPEKSPSVRFHSRINMTCVNHETGVVDPKKFSVLANWQREYTMEYILTQLKKEMASPHNRKLVQPPEGTFF

SEQ ID NO: 12369 - DNA, 738 bp, Panicum virgatum
  misc_feature: Ceres CLONE 1762651
  misc_feature: Encodes the peptide sequence at SEQ ID NO. 12370
ctccgtccgctgctccttcacgttttctttttctcgcgtccggcggccggcaccggtggcggccagcccccccttctttccgatccgttttcatcaggcgcggcggcgtcggcgaatcaagggctgctacccacgtagtagtcgctgcctgcaacggaggagtcaggttccgttcttctcgcgaaggcctcgccattcttctcacctgcggactgcagcgatggcggcggctctccccgatccggtttggtcagcagatcgccgagtcaaggcagacggagcggcggcggctccctctccacatcgggatttcggctccctctgctgatttagataacttgcttcggatttcatttgttgatgaggactgtgagaagctccgatcaattgatttatcacctctttctgcttctggaaacgatgcctggagaatggctctttatactagagttctgtcagtcatttcaaatggcatcagtattggtgtcaagcacttgaagtttcttgccttttcctcaggccaactgcgagataactctgcatggatatttggttctcggacgggattcactgcaagtgacatcaggaagtcgatgggggactttcgcaacatcagaaatgtggcaaaccgctacaagctgatgtcttgtgtatatgacttgcagcttctatgtgctatcgtttcacttcaggagttatgctgcttatgaatgtttttaacgttgatgattctgtgcc

SEQ ID NO: 12370 - protein, 235 aa, Panicum virgatum
  misc_feature: Ceres CLONE 1762651
  misc_feature: SWISSPROT Homolog: EC 2.7.7.48 RNA-directed RNA polymerase
PSAAPSRFLFLASGGRHRWRPAPPSFRSVFIRRGGVGESRAATHVVVAACNGGVRFRSSREGLAILLTCGLQRWRRLSPIRFGQQIAESRQTERRRLPLHIGISAPSADLDNLLRISFVDEDCEKLRSIDLSPLSASGNDAWRMALYTRVLSVISNGISIGVKHLKFLAFSSGQLRDNSAWIFGSRTGFTASDIRKSMGDFRNIRNVANRYKLMSCVYDLQLLCAIVSLQELCCL

SEQ ID NO: 12371 - DNA, 768 bp, Panicum virgatum
  misc_feature: Ceres CLONE 1762656
  misc_feature: Encodes the peptide sequence at SEQ ID NO. 12372
aagcaggctccgacctccccggattcctccgaggcgcgggcggcggcggtcggcgacatggcggccgcggtgcccagccgtgtcgcgctctcggcggcgagccgcttccccaatcgccacgcggtggcaggggatagatcgtgcatttacaagggaagattccaaagtcttgcaatccctatggctctgtcagcagctgcaccaggcaaaggtggtgtgcttgatcggccggtagagaaaactactcctggtcgtcagtctgaatttgatgtgaagaaaaagcgcaagatgacgcccccataccgcgtcatcctgcacaacgacaactacaacaggcgcgagtacgtcgtccaggtcctgatgaaagtgatcccggggatgaccgtggacaacgcggtgaacatcatgcaggaggcgcacgtgaacgggctctcggtggtgatcgtctgctcccagtccgaggccgaggagcactgcacgtcgctcaggggcaacggcctgcggagctcgattgagcccgctagcggtggctgctgagaatgggtgctgatgttccgccgcgtatattttgtaaataccctgcgtcacaaagataagctgaaatgggttgcaggcagccgtcggtactgcgaagcggaatgccgcttgggtaggtgtaaatcatgtaagggtgccctgtagaagaacagacatagtggtttgggttatgattaatgaaacatttttgttacgctcttcctttgttactgggcagttgctgctactgct

SEQ ID NO: 12372 - protein, 159 aa, Panicum virgatum
  misc_feature: Ceres CLONE 1762656
  misc_feature (76)..(152): Pfam Name: ClpS Pfam Description: ATP-dependent Clp protease adaptor protein ClpS
MAAAVPSRVALSAASRFPNRHAVAGDRSCIYKGRFQSLAIPMALSAAAPGKGGVLDRPVEKTTPGRQSEFDVKKKRKMTPPYRVILHNDNYNRREYVVQVLMKVIPGMTVDNAVNIMQEAHVNGLSVVIVCSQSEAEEHCTSLRGNGLRSSIEPASGGC

SEQ ID NO: 12373 - DNA, 755 bp, Panicum virgatum
  misc_feature: Ceres CLONE 1762659
  misc_feature: Encodes the peptide sequence at SEQ ID NO. 12374
aaacacaacacggggccagcagacccgcgcatcagccagtagcaacacccgtttggccatttccaaggagtactttcttggcaagctgaccgatcgcgggagcaagtagcaactccaagcaaagaaaaatggcagcgagggcggcgccgttctggctcctggccgcggcgctggtcgcggcggcgtccgcgcagtcctccggctccggcggcggcggcgactgcacgtcggcgctggtgagcctgtccccgtgcatggactacatcagcggcaacggcacgtcggcgcccagcgcctcgtgctgctcgcagctcaaggccgtggtgcagtccaagccgcagtgcctctgcgccgcgatcggcggcgacgcctcctcctccctcggcggcgtcgagatcgaccggtcgcgcgcgctcggcctccccgccgcctgcaacgtccagaccccgcccgccagccggtgcaacgctgggtcgtcgggcggcgggtcgaaggcgacgccgtccctgccatctggcgccgcggcgctccgggggccggcgggtctcgtgctcggcctcgccgcggctgcggcgctctacgccgcgtctgctgcgtgatgcgcgaagcgtggcgattcaggacgcattgcgtcgtgtaaactttcgtttcagcagcattcggggaggaggattttgagtgttttgtgtgcctctatggattcgtgccattggttgttgattccgccattccggggtcataataaatttgctgat

SEQ ID NO: 12374 - protein, 156 aa, Panicum virgatum
  misc_feature: Ceres CLONE 1762659
  misc_feature (32)..(112): Pfam Name: Tryp_alpha_amyl Pfam Description: Protease inhibitor/seed storage/LTP family
MAARAAPFWLLAAALVAAASAQSSGSGGGGDCTSALVSLSPCMDYISGNGTSAPSASCCSQLKAVVQSKPQCLCAAIGGDASSSLGGVEIDRSRALGLPAACNVQTPPASRCNAGSSGGGSKATPSLPSGAAALRGPAGLVLGLAAAAALYAASAA

SEQ ID NO: 12375 - DNA, 727 bp, Panicum virgatum
  misc_feature: Ceres CLONE 1762669
  misc_feature: Encodes the peptide sequence at SEQ ID NO. 12376
ctagcgccggcgccgcagacactgccccttcgctcccttccctcccgccgccgcagccgtcgccgcaccgccgccggagccgagatggccccgaagaaggacaaggccccaccgccgtcctcgaagccggccaagtccggcggcggcaagcagaagaagaagaagtggagcaagggaaagcaaaaggagaaggtcaacaacgcggtgctcttcgaccaggccacctacgacaagctgctctcggaggtgcccaagtacaagcagatcaccccctccgtcctctccgagcgtctcaggatcaatggctccctggctcggagggccatcaaggacctgatggctcgtggcctcatccgaatggtctcagtgcactcaagccagcagatctacaccagggcaaccaacacctaaggattggggaagctgtaatgcctttgtttgccctctgtaggaggagctcctctgccttagaacagttgtcatctttgtcaagggtttgctaatgttatgttacctatgatgagtacctccatgtggctgaaacatttcagagattttgcgaattagttcagtactatggtttgcctattataagttgccttgcatcaatagctgtatgtttattcagtgttttgttactgttaatcccaaggctttcccattgtgagatctgagatgcctacacagcttgggaaatttgtgttgatatgcccttgatgcgtgggag

SEQ ID NO: 12376 - protein, 108 aa, Panicum virgatum
  misc_feature: Ceres CLONE 1762669
  misc_feature (1)..(106): Pfam Name: Ribosomal_S25 Pfam Description: S25 ribosomal protein
MAPKKDKAPPPSSKPAKSGGGKQKKKKWSKGKQKEKVNNAVLFDQATYDKLLSEVPKYKQITPSVLSERLRINGSLARRAIKDLMARGLIRMVSVHSSQQIYTRATNT

SEQ ID NO: 12377 - DNA, 741 bp, Panicum virgatum
  misc_feature: Ceres CLONE 1762673
  misc_feature: Encodes the peptide sequence at SEQ ID NO. 12378
acagccatcaaaattccccattcccaaatcgaccgagcgaatccctcccggcctctcgccgccgcgaacccaagcagccgcatcgatggcccccaaggcggagaagaagccggcggcgaagaagcccgcggaggaggagcccgcgacggagaaggcggagaaggccccggcggggaagaagcccaaggccgagaagcggctgcccgcgggcaagtccgccggcaaggagggcggcgagggcaagaaggggaggaagaaggggaagaagtcggtggagacctacaagatctacatcttcaaggtgctgaagcaggtgcaccccgacatcggcatctcctccaaggccatgtccatcatgaactccttcatcaacgacatcttcgagaagctcgctggcgaggccgccaagctggcgcgctacaacaagaagcccaccatcacctcccgcgagatccagacctcggtgcgcctcgtcctccccggcgagctcgcgaagcacgccgtctccgagggcaccaaggccgtcaccaagttcacctcatcttaggttggtggtaggagtaatcgagtggtgttggtagatgtggctcattttatcctgtagggctggtgcttgtagtttatgaaactagaaatggatggatgctgatctatatgtagttaatttcgtaatgaattattgtaatgcttttggaacacttgggagtgttcatggtgcttgctctacatgtgatttttgtc

SEQ ID NO: 12378 - protein, 153 aa, Panicum virgatum
  misc_feature: Ceres CLONE 1762673
  misc_feature (60)..(130): Pfam Name: Histone Pfam Description: Core histone H2A/H2B/H3/H4
  misc_feature: Useful for biocontainment applications
  misc_feature: Useful for making plants with modulated flowering time
MAPKAEKKPAAKKPAEEEPATEKAEKAPAGKKPKAEKRLPAGKSAGKEGGEGKKGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 12379 - DNA, 953 bp, Panicum virgatum
  misc_feature: Ceres CLONE 1762674
  misc_feature: Encodes the peptide sequence at SEQ ID NO. 12380
aaaaaagatcacaaactttaattgggccgtcacaagcaaacctcatctacaatttttgcaggaaggaagagctagctccttgtgtgtgtgtgtgtgtgtgtgacaggaagagggtcgagatggctacggcgtacgctcccatggcgagccaggtgatgaagagcggcatggtgcactcgaggccgaggggcctctctggcgctgcgctgacgaggcggccacgcttcaccgtgaaggccatccagcctgagaagccaacgtaccaggtggtgcagcccatcaacggcgaccccttcatcggcagcctggagacgcccgtcacctcgagcccgctcgtggcctggtacctctccaacctgccggcctaccgcaccgccgtgagcccgctactccgcggcatcgaggtcggcctcgcgcacggctacctcctcgtcgggcccttcgcgctcaccggcccgctccgcaacacgcccgtgcacggccaggccggcgccctgggcgccgccgggctcgtcaccatcctcagcgtctgcctcaccatgtacggcgtcgcctccttcaacgagggggacccgtccacggcgcccacgctcacgctcacggggcgcaagaaggaggccgacaagctgcagaccgccgacgggtgggccaagttcaccggaggcttcttcttcggcggcatctccggcgtgctctgggcatacttcctcctctacgtgctcgacctcccctactacttcaagtagacgtacgggctccatatgcaaatcccctcctctctacacatgtgggtaggtgatgtttgtgtggttcttgattgagcagtgatcgagcacgtgtataaattaatgtattactttctctggacatggatggatggggttgtaacttggaacggttaatttcttacttggatcacttgggaacaaaacatctgctggtgttgtattcgc

SEQ ID NO: 12380 - protein, 208 aa, Panicum virgatum
  misc_feature: Ceres CLONE 1762674
  misc_feature (48)..(206): Pfam Name: PsaL Pfam Description: Photosystem I reaction centre subunit XI
MATAYAPMASQVMKSGMVHSRPRGLSGAALTRRPRFTVKAIQPEKPTYQVVQPINGDPFIGSLETPVTSSPLVAWYLSNLPAYRTAVSPLLRGIEVGLAHGYLLVGPFALTGPLRNTPVHGQAGALGAAGLVTILSVCLTMYGVASFNEGDPSTAPTLTLTGRKKEADKLQTADGWAKFTGGFFFGGISGVLWAYFLLYVLDLPYYFK

SEQ ID NO: 12381 - DNA, 647 bp, Panicum virgatum
  misc_feature: Ceres CLONE 1762689
  misc_feature: Encodes the peptide sequence at SEQ ID NO. 12382
aagaagaagcgcctgcccagccggggtccgcgcgcgcggacgcggtcacgctccggccgttcgacctcgccgacgtcgacgccatgatggcgtgggcgtcggaccccgtggtcacggcgttcatgacgttggacgcctacacgtcccgggaagccctgctcgccttcatgcgcgacgccgtgctgccgcacccctggttccgcgccgtctgcctcggcggcggcgagcccgtgggcgcggtgtccatgacgccgacggacgaccggtgccgcgccgagctctgcgtcgtgctggcgcgcgcgcactgggggaagggtgtggccacggcggccctgaagcgcgcggtcgccacggtgttcggcgacctcgacggcgtggagcgcgtcgaggcgctcgtggacgccgacaacgcggcctcgcagcgggcgctcgagaaggccgggttccagcgggaggccgtgctgcggagttactgcgtggtcaagggaaggctcagggacatggtgatctacagcttcatctccactgaccctctcgtagactgatccagaaaaggttagctgctcatgtacctagagatttcacaacatggttggattggatgacccaaagtcttgcaaaagaaactatatggcattgcagcttgc

SEQ ID NO: 12382 - protein, 180 aa, Panicum virgatum
  misc_feature: Ceres CLONE 1762689
  misc_feature (68)..(149): Pfam Name: Acetyltransf_1 Pfam Description: Acetyltransferase (GNAT) family
  misc_feature: SWISSPROT Homolog: EC 2.3.1.128 Ribosomal-protein-alanine N-acetyltransferase
EEAPAQPGSARADAVTLRPFDLADVDAMMAWASDPVVTAFMTLDAYTSREALLAFMRDAVLPHPWFRAVCLGGGEPVGAVSMTPTDDRCRAELCVVLARAHWGKGVATAALKRAVATVFGDLDGVERVEALVDADNAASQRALEKAGFQREAVLRSYCVVKGRLRDMVIYSFISTDPLVD

SEQ ID NO: 12383 - DNA, 805 bp, Panicum virgatum
  misc_feature: Ceres CLONE 1762692
  misc_feature: Encodes the peptide sequence at SEQ ID NO. 12384
atcatcacctgcaacgagcaatcaatccccagatttttcacaggcggaaacacgcaaagccgtaactagcagctcatcgaccggctagcaatggcggcggcggcggcggagggggcagcgaagaagagcggcggcgagatgacggtggtgcgcgggctggacgtggcgcggtacatggggcggtggtacgagatcgcctcggtcccgtccttcttccagccccgggacggccggaacacgcgcgccacctacgcgctactggaggacggcgcgacggtgcacgtgctcaacgagacgtggagcaagggcaagcgcgactacatcgaggggacggcgtacaaggccgaccccggcagcgacgaggccaagctcaaggtcaagttctacctcccgccgttcctccccatcatccccgtcgtcggcgactactgggtgctctacgtcgacgccgactaccagtacgcgctcgtcggcgagccgcgccgcaagaacctctggatcttgtgcaggaagacgagcatcaacgaggaggtgtacagccagctgctggagcgggcgagggaggaaggctacgacgtgagcaagctgcacaggacgccgcaggacgacccgccgccggagagcgacgccgcgcccaccgacaccaagggggtctggtggttcaagtcgctcttcggcaaatgatcgtccatcgcgtgctgcgctttgctctgcttctcgcttgcttgctagctagctagtacactagtgtatctctctgctataatccgtgccgcgcgcggcgaataaaattggattgctgctg

SEQ ID NO: 12384 - protein, 197 aa, Panicum virgatum
  misc_feature: Ceres CLONE 1762692
  misc_feature (23)..(171): Pfam Name: Lipocalin_2 Pfam Description: Lipocalin-like domain
MAAAAAEGAAKKSGGEMTVVRGLDVARYMGRWYEIASVPSFFQPRDGRNTRATYALLEDGATVHVLNETWSKGKRDYIEGTAYKADPGSDEAKLKVKFYLPPFLPIIPVVGDYWVLYVDADYQYALVGEPRRKNLWILCRKTSINEEVYSQLLERAREEGYDVSKLHRTPQDDPPPESDAAPTDTKGVWWFKSLFGK

SEQ ID NO: 12385 - DNA, 846 bp, Panicum virgatum
  misc_feature: Ceres CLONE 1762739
  misc_feature: Encodes the peptide sequence at SEQ ID NO. 12386
attttgcacgaaactctaccggataggatttatccccctccctccgcgcgctctccgtcgtgtccgccatgaccgcggccgcagccgtcctgccggcctgcgccgccggtcccctctcccgagcacccgccccgctcccgcggcgcctcctctctatacagccctcccccgcgcgcagggacggctcccgcggctgcagcctcgccggcgccagcggcagccgcgcgccaaccgttcgacggaacgccgccgccgagacggtggttccatacgttccgggatccggcaagtacatcgcgccagactacctcgtgaagaaggtgtcggccaaggaggtggaggaactggtgaggggggagaggaacgtgccgctcatcgtcgacttctacgcgacatggtgcgggccctgcgttcagatggcgcaggacatcgagatgcttgcagtcgagtatgaggacaacgccctatttgtgaaggtggacaccgatgacgagtatgaatttgcaaaagacatgcaggtaagaggacttccaacactgtatttcttcagtccagaccaaagcaaagacgccatacgcacggaggggctaattccaatggatatgatcagaaacatcattgacaatgagctatgacagctgataggcaaatagacacgtaggcagtgttttttgtttgtagcggatgagattttgtctgagacttgagtgtttaggtactagtttgctgtgctgtattcggttcttgtattgcttcactgccagagtttctgcaggtgggaatgcaggtgtagcataggattggaacttgagactcacgactaagttactctgttgtttctccatt

SEQ ID NO: 12386 - protein, 188 aa, Panicum virgatum
  misc_feature: Ceres CLONE 1762739
  misc_feature (81)..(187): Pfam Name: Thioredoxin Pfam Description: Thioredoxin
  misc_feature: SWISSPROT Homolog: EC 1.8.1.8 Protein-disulfide reductase
MTAAAAVLPACAAGPLSRAPAPLPRRLLSIQPSPARRDGSRGCSLAGASGSRAPTVRRNAAAETVVPYVPGSGKYIAPDYLVKKVSAKEVEELVRGERNVPLIVDFYATWCGPCVQMAQDIEMLAVEYEDNALFVKVDTDDEYEFAKDMQVRGLPTLYFFSPDQSKDAIRTEGLIPMDMIRNIIDNEL

SEQ ID NO: 12387 - DNA, 678 bp, Panicum virgatum
  misc_feature: Ceres CLONE 1762756
  misc_feature: Encodes the peptide sequence at SEQ ID NO. 12388
acaagagcttctcagatcttgcagtccctgctcactcactcaaagtggtagtctctcccgttccatttccatccgtcatctatcctcttcgtcggcgagaaccaaggagacgccctccatggagctcttcgccgccgaggagaagccttgcaaccggctgttcaggaagcgggccggcggcaagggcgccatgggcgtgcgcggcgacggcggcagcggcaagggccggtccttctccgggcggtgcgcgcggctcgtcaaggagcagcgcgcgcggttctacatcatgcgccgctgcgtcgcgatgctggtgtgctggcgctttttctcctgaggcgagcagggcaaggaaccaaggacatgccgccgccgccgcggtgccgcaggagcagacgaacgaacaaggccgatcgatcgcctacgttaggaggaactgagagccatgtgtaaaaaggagagggttttttttctttctttttcagtctcctttcttctttgctttctgccctccggtttcttatcaagagctagtactagcagagctcagtactgcttggatccgatgatcaccgcaccgcgcattcagttgagtcgtcctcgatgagatgtgagcgtgtctaatacagaggaactgacttgtgaaattcctcatcaggagcttgttttttttttttttgg

SEQ ID NO: 12388 - protein, 71 aa, Panicum virgatum
  misc_feature: Ceres CLONE 1762756
  misc_feature (48)..(66): Pfam Name: DVL Pfam Description: DVL family
MELFAAEEKPCNRLFRKRAGGKGAMGVRGDGGSGKGRSFSGRCARLVKEQRARFYIMRRCVAMLVCWRFFS

SEQ ID NO: 12389 - DNA, 947 bp, Panicum virgatum
  misc_feature: Ceres CLONE 1762819
  misc_feature: Encodes the peptide sequence at SEQ ID NO. 12390
ctagccgcgccccttcttcgtttcctccccgcgccgccgcagccgccgcctctcgctaccgccgccgccatgggccgaagacctgcgaggtgctatcgccagatcaagaacaagccatatcccaagtcgaggtactgccgtggtgttcctgaccccaagatcaggatctatgatgttggaatgaagaagaagggagttgatgagttcccctactgtgtgcatctcgtctcttgggagaaggagaatgtctccagtgaggctcttgaggctgcccgtatcgcatgcaacaagtacatgaccaagtctgcagggaaggatgccttccacctcagggtccgggttcaccccttccatgtgctccgtatcaacaagatgctttcgtgcgctggggctgataggctccagactggtatgaggggtgccttcggcaagccccagggtacctgtgctagggtcgacattggccaggttctcctttctgtgcgctgcaaggacaacaatgctgcccatgccagcgaggctctgcgtcgcgccaagttcaagtttcctggtcgccaaaagatcattgagagcagaaagtggggcttcaccaagttcagccgtgctgattacctgaagtacaagagtgagggtagaattgtgcctgatggtgtaaacgcgaagttgctcggtaaccatggccggcttgagaagcgcactgctgggaaggctttccttgatgctgttgcttaagttgcccagacttctaccgcaggaatgcaattccagatgttttgcttagtctatcttattttgctttgtggaacttgaattaagtgtttgggatattacagtgccttatccgaacttacctatcttgttaaacatcgttatgcatggaattatctgttacttgcgtcatgggattacatctcacatcggcattatgtgattgggaatgtgtcgtt

SEQ ID NO: 12390 - protein, 220 aa, Panicum virgatum
  misc_feature: Ceres CLONE 1762819
  misc_feature (5)..(167): Pfam Name: Ribosomal_L16 Pfam Description: Ribosomal protein L16
MGRRPARCYRQIKNKPYPKSRYCRGVPDPKIRIYDVGMKKKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKFSRADYLKYKSEGRIVPDGVNAKLLGNHGRLEKRTAGKAFLDAVA

SEQ ID NO: 12391 - DNA, 487 bp, Panicum virgatum
  misc_feature: Ceres CLONE 1762843
  misc_feature: Encodes the peptide sequence at SEQ ID NO. 12392
ttgccatctctgcatccaacactggaggtgcttgggacaacgccaagaaatacattgaggctggtgcatctgagcatgcaagaaccctgggcccgaaaggctcagacccacacaaggctgccgttatcggtgacaccatcggtgatcccctcaaggacacctcaggcccctcactgaatatcctcatcaagctcatggccgtcgagtccttggtttttgcccccttcttcgccacccatggaggcatcctcttcaaatggctttagaggaagaatgatggatcggttactttaattttgccggggagagcactagatttatctctgccatagagaagtttcagtttacccatatagtgcctttcttcatttccgtctcgcctgtactgtattacgtcatgttgaaacctacaactctacaagccatggtgccatagagatttgcagtagccgagtcgagcaaatctctggccattctacaggttcag

SEQ ID NO: 12392 - protein, 87 aa, Panicum virgatum
  misc_feature: Ceres CLONE 1762843
  misc_feature: SWISSPROT Homolog: EC 3.6.1.1 Inorganic diphosphatase 220>
  misc_feature: Useful for making plants with modulated water use efficiency
AISASNTGGAWDNAKKYIEAGASEHARTLGPKGSDPHKAAVIGDTIGDPLKDTSGPSLNILIKLMAVESLVFAPFFATHGGILFKWL

SEQ ID NO: 12393 - DNA, 890 bp, Panicum virgatum
  misc_feature: Ceres CLONE 1762846
  misc_feature: Encodes the peptide sequence at SEQ ID NO. 12394
gtccattccgagctctcgctttgaaaccgaaccagctcccaccacccagctgccgtttctagagaatcccctgcgtttcgagatcccggtcgccacgatgcctgccctcgccaagcccgcctcgcgccccgccaagaccgtcgcggcgccgaagccgaagcccgccgccgccaagcccaaggtcgcggccggcgccgccgcctcccacccgccctacttcgagatgatcaaggaggcgatctcggcgctcaaggagaggaccggctcgagctcgcacgccatcgccaagtacatggaggacaagcacggcccgtcactgccggccaactacaagaagatgctctccatccagctccgcgggttcgccgccaagggcaagctcgtcaaggtcaaggcctcctacaagctctccgacgccgccaagaaggaggcccccaaggccaagcccgcagccgccaagaccgtcgcggccaagccggccaaggccgccgcgaagccgaagaagagcgccgccgccgcgaagccgaagaagaccgcggccgccgccgccgggaccaagcgcaaggcgccggagaaggtcgtggcgaagccgaagaagtcccctgcggcgaaggccaaggctaagcccaagactgtcaagtcccccgcctccaagaaggcccggaaggtcgccgcatgagatggttccataggtcgtagctcttattgtggtgtggttgtccctagggagttgtacaaatgaagtgtgttccctaagcgtctctgatccggtgttgtggtaggtcagttcaatgtatccaggtcggtgttagtgtaactgatggttaggtttcttgtgagggagatgtatctcgctctcttatatatgatatgaacctgcagtttgccag

SEQ ID NO: 12394 - protein, 193 aa, Panicum virgatum
  misc_feature: Ceres CLONE 1762846
  misc_feature (36)..(106): Pfam Name: Linker_histone Pfam Description: linker histone H1 and H5 family
MPALAKPASRPAKTVAAPKPKPAAAKPKVAAGAAASHPPYFEMIKEAISALKERTGSSSHAIAKYMEDKHGPSLPANYKKMLSIQLRGFAAKGKLVKVKASYKLSDAAKKEAPKAKPAAAKTVAAKPAKAAAKPKKSAAAAKPKKTAAAAAGTKRKAPEKVVAKPKKSPAAKAKAKPKTVKSPASKKARKVAA

SEQ ID NO: 12395 - DNA, 807 bp, Panicum virgatum
  misc_feature: Ceres CLONE 1762848
  misc_feature: Encodes the peptide sequence at SEQ ID NO. 12396
aatcacagccgcgccggccggccaccagcatctcgctcgtagccatgtcgagctccgccgccgccgccgcgaagaacccggccatggagcccgacacggacgcgccggcgggggagggcctggagctggcgcagttcgcggcggggtgcttctggagcgtggagctgacgtaccagcggctccccggtgtggcgcgcacggaggtgggctactctcagggccaccgcgacgcgcccacgtacgagctcgtgtgcgcccacggcacgggccacgccgaggtggtgcgcctgcactacgaccccgcggcgtgtccctacgccaagctcctcgacgcgttctgggccaagatcgaccccaccacgctcaacaggcagggcaaggacgtcgggacgcagtaccggacggggatctactactacacggcggagcaggagaggctggcgcgggagtcgctggcggagcagcgggggaagtgggagggcgagatcgtcaccgagatcctgccggcgaagcggttctaccccgccgaggagtaccaccagcgctacctcgagaagggcggccagtctgcggccaagggctgcaccgaccccatgcgctgctacggctgacgccgccgccggccatccgtctccgtccgacgaaacggaggctagcaaattgggcgaagccgattatctgccgtccgtgtatgcatgtcactatatatgtcagcgtaaaacaataagcaggaagataccgacaaccgtgccgtattagtatgtgctacgtcttacgtggaaataaacgccaagtgtttggaaggtc

SEQ ID NO: 12396 - protein, 188 aa, Panicum virgatum
  misc_feature: Ceres CLONE 1762848
  misc_feature (27)..(182): Pfam Name: PMSR Pfam Description: Peptide methionine sulfoxide reductase
  misc_feature: SWISSPROT Homolog: EC 1.8.4.11 Peptide-methionine-(S)-S-oxide reductase
  misc_feature: Useful for making plants with modulated flowering time
MSSSAAAAAKNPAMEPDTDAPAGEGLELAQFAAGCFWSVELTYQRLPGVARTEVGYSQGHRDAPTYELVCAHGTGHAEVVRLHYDPAACPYAKLLDAFWAKIDPTTLNRQGKDVGTQYRTGIYYYTAEQERLARESLAEQRGKWEGEIVTEILPAKRFYPAEEYHQRYLEKGGQSAAKGCTDPMRCYG

SEQ ID NO: 12397 - DNA, 1022 bp, Panicum virgatum
  misc_feature: Ceres CLONE 1762849
  misc_feature: Encodes the peptide sequence at SEQ ID NO. 12398
aatgtaaacgaaatatctccaaagcccccggtaatctcctcccgattaccgcgcgcccccctagttccctctccctctcgctctccccgcgccgccgccgccgcccagtcccacctctccgtgcccaggatgtggggaagcaccgacggcggcactccggaggtcaccctcgagacctccatgggcgccatcacagtcgagatgtactacaagcacgcgcccaagacctgccggaacttcgtcgagctcgcgcgccgcggctactacgacaacgtcatcttccaccgcatcatcaaggatttcattgtgcaaggtggggatcctacgggaaccggcagaggtggtgagtccatctacggagcaaagtttgaggatgagataaagtcagagttgaagcacactggggctggaattctgtccatggcgaacgctggtccaaatacaaatgggagccagttcttcataactctcgcgccttgtcaatcacttgatggaaagcatacaatattcgggagggtatgcagaggaatggaaattgttaagcgccttggaagtgtgcagactgacaaaaatgataggcccatccatgaagtgaaaatccttcgagccatcattaaagattgaatcatcacgtgcagttctagtttggcgaggcgaaatgtgtttgtgttagcttaggtttaatggtcctgcaagcggtgccactctggaaaagattgagaagctgcatggttcccggcttgtacgacggccaagtgacgaatctcatctgcctgacctgaaaagctaccttatcagtagatcagaccatttaagtaagataaggtgtatgctggtatttgaagcttgcgcatgtgtctgatgattatgctgcaggcacattgtattagcatggagttaaagcggcgacatacatggcttcctgatctctactatgccgtgttgtgttgtgttgtgttgtgtttgtctcacgaatatcaataatattgcctactagaatatgcggttttcttttttttttt

SEQ ID NO: 12398 - protein, 164 aa, Panicum virgatum
  misc_feature: Ceres CLONE 1762849
  misc_feature (11)..(163): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MWGSTDGGTPEVTLETSMGAITVEMYYKHAPKTCRNFVELARRGYYDNVIFHRIIKDFIVQGGDPTGTGRGGESIYGAKFEDEIKSELKHTGAGILSMANAGPNTNGSQFFITLAPCQSLDGKHTIFGRVCRGMEIVKRLGSVQTDKNDRPIHEVKILRAIIKD

SEQ ID NO: 12399 - DNA, 808 bp, Panicum virgatum
  misc_feature: Ceres CLONE 1762855
  misc_feature: Encodes the peptide sequence at SEQ ID NO. 12400
cactcctcaatgccccaggatcagccccctttgaagccgctgccagctcctccaagagctagcgaatcaagccgatcgatagccatggccacgcaagcctccgccgcgacgggccacctgctggcggcggcgtggtcgccggcggcgaaggcgcctctgccgtcgcagctcgaggtcccgccgccctcccgcgggccggccccgcgccgcgcggccgacgaggaggccgccgcggcgaccgaggaggagcccaaggggttcatgcccccccaactggacccgaacacgccgccctcgatcttcggcggagtcacaggcgggctgcttttttttttgcaggcggatgagttctacgtgatctcgtggacctcccccatggagcatgtgttcgagatgcccacgggcggcgccgccatcatgcacgaggggcccaacctccttaagctggctcgcactgagcagtgcctggcgctggtcaccagactgcgctccaattagaatatcaactaccacttctaccgcgtcttccccaacagcgaggtccagtacctgcaccccagggacggcgtctacccggacaaggtcgacgccggccgtgatggcgtcggttctaactaccgcaggatcggcaagaacttcagctccttcgaggtcaagttcgccggcgacaacaccttatacctctgatgtgttaattactgcgagctgttgggttcttggtttatggattctgaaggctcggtcgatctgtaattcaactatcaagcttttcttggcgattgtggagaggggatacatggaatccccc

SEQ ID NO: 12400 - protein, 137 aa, Panicum virgatum
  misc_feature: Ceres CLONE 1762855
  misc_feature (62)..(137): Pfam Name: PsaD Pfam Description: PsaD
MATQASAATGHLLAAAWSPAAKAPLPSQLEVPPPSRGPAPRRAADEEAAAATEEEPKGFMPPQLDPNTPPSIFGGVTGGLLFFLQADEFYVISWTSPMEHVFEMPTGGAAIMHEGPNLLKLARTEQCLALVTRLRSN

SEQ ID NO: 12401 - DNA, 673 bp, Panicum virgatum
  misc_feature: Ceres CLONE 1762856
  misc_feature: Encodes the peptide sequence at SEQ ID NO. 12402
attccgctttgagcttgcttgcagctccttttaccctcgtctcttggtggctacgccatggccaccgtagtcctgatgagctgcagcctccgcgcgccagcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgttttgcggggtcctactcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatatatatatatatatatatatatatatatatatatatatatacatatacacatgtatggctatagatatagctat

SEQ ID NO: 12402 - protein, 149 aa, Panicum virgatum
  misc_feature: Ceres CLONE 1762856
  misc_feature (58)..(133): Pfam Name: Fer2 Pfam Description: 2Fe-2S iron-sulfur cluster binding domain
  misc_feature: SWISSPROT Homolog: EC 1.14.13.7 Phenol 2-monooxygenase
MATVVLMSCSLRAPACSGLSGVRAAPAPAIVAMPAAKQQVVGRGARLRAQATYNVKLITPDGEVELQVPDDVYILDQAEEEGIDLPYSCFAGSYSSCAGKVVSGSVDQSDQSFLEDDQVAGGWVLTCAAYPTSDVVIETHKEEELTSSS

SEQ ID NO: 12403 - DNA, 776 bp, Panicum virgatum
  misc_feature: Ceres CLONE 1762868
  misc_feature: Encodes the peptide sequence at SEQ ID NO. 12404
aaaccctcgcgctttgcccccatctccgccccgccgctgcagcgctccgcctccctccccctcgcacccgcaggctagggttctcctctagaggcggcgccatgttggtctaccaggatctgctcaccggcgacgagctgctctcggactcgttcccgtacaaggagatcgagaacggcgtgctctgggaggtcgagggcaagtgggtcgtccaaggagcagtggaggtgaacattggtgccaacccgtctgctgagggtggcgaggatgagggcgtagacgatcaggctgtgaaggttgtggacattgtcgacaccttccgtctacaggaacaacctgccttcgataagaagcagtttgtcacatttattaagcgctacataaaaaacctcacttccaagctggagccggagaaggctgatgagttcaagaagggcattgagggtgccaccaagtaccttcttggcaagttgaaggacctacagttctttgttggcgagagcatgcatgacgatgggagtctcgtgttcgcgtactacaaggaaggagccaccgacccgaccttcctctactttgcgcatggcctgaaggagatcaagtgctaggtgcccctgaccatacgggtgttaccgtgttcttaatttgtctggttttgttcgtattgtgctgagaaacattgtgctgagaaacggttgtcggcttttaccgccaaaagatactcttactttctggatgtgatctgttactccgtgtttctgttactttctggatgttct

SEQ ID NO: 12404 - protein, 167 aa, Panicum virgatum
  misc_feature: Ceres CLONE 1762868
  misc_feature (1)..(164): Pfam Name: TCTP Pfam Description: Translationally controlled tumour protein
MLVYQDLLTGDELLSDSFPYKEIENGVLWEVEGKWVVQGAVEVNIGANPSAEGGEDEGVDDQAVKVVDIVDTFRLQEQPAFDKKQFVTFIKRYIKNLTSKLEPEKADEFKKGIEGATKYLLGKLKDLQFFVGESMHDDGSLVFAYYKEGATDPTFLYFAHGLKEIKC

SEQ ID NO: 12405 - DNA, 863 bp, Panicum virgatum
  misc_feature: Ceres CLONE 1762924
  misc_feature: Encodes the peptide sequence at SEQ ID NO. 12406
acgtagttttgcccgtcgacagggacattctcggtagtcgccccgttcgccgcagaacgcgacgagaggaatagggttgcggctccgccgccgcccgccggagcaggaagagaccactcgctccccatcgccgcgagcgggatgaagagcttcccggtggccggaggccgcagcgtctccctcgccctctactccgacatctccaacagccgggtgctgctcgacttgatgcagtcagggaagctggaaccggaggtcgcgttcctcaacgcatcactggtgccggatgtgttccctgttcttgcagcggcgcacaaggcgctgctgtcgaaggcgagggagtcactgaccacaaggactctgcactctgagctcgtctacaactactccgggtccaagcatattacggaatccctgaaacgatgcgggatctctgatgacacgacgtacatccttgcagctcgttttgatgcttcaaacgaggagatgaaagcagtggagaaactcatcagtggcaccgagatcgatttaggaaaactggaaagtagagcaaaccagccacatatcctaaagcattacaagattcctccccaagaactattgatatctacactgcccgacgcaattatatgcaggattgctgctcgagatgctctctgaggcctcaatgattattttgatgatcccagcaccgaagtttgagctcgatatctgcgccttggcattcataagctaatttagtttggagaaacgagaaggtgtcagctctcaatcacatgtatgactgcacagctaaaattggatatctgcaatgccattttatccacattcctgaaagcaacctgtaagcatgtcgttctgtt

SEQ ID NO: 12406 - protein, 172 aa, Panicum virgatum
  misc_feature: Ceres CLONE 1762924
  misc_feature (47)..(149): Pfam Name: CGI-121 Pfam Description: Kinase binding protein CGI-121
MKSFPVAGGRSVSLALYSDISNSRVLLDLMQSGKLEPEVAFLNASLVPDVFPVLAAAHKALLSKARESLTTRTLHSELVYNYSGSKHITESLKRCGISDDTTYILAARFDASNEEMKAVEKLISGTEIDLGKLESRANQPHILKHYKIPPQELLISTLPDAIICRIAARDAL

SEQ ID NO: 12407 - DNA, 884 bp, Panicum virgatum
  misc_feature: Ceres CLONE 1762930
  misc_feature: Encodes the peptide sequence at SEQ ID NO. 12408
aaaagcaaattgagaagaagcagcagcattagctgatcatcatcgatcgatcatatcatcaaatacaacaagaacaacaacaagtagcagcaaaaatataagggaatgtcgatcaagtactgcgaccagcacaaggactgcgagcgtcagcggctgtaccggcgcttctgcgcggggctcgccgccctcatcctgctggccctcctcatcgtgctcatcgtctggctgctgctccgccccagcaagccccgcttctacctcaacaacctcgacatcgtctgcatcaacgtctcctcctccgccgccctctccgtcaccatgcaggccacgctggcggcgcgcaaccccaacgcccgcgtcggcatcttctacgaccgcgccgacgtctacgccgagtaccggggcctccaggtcaccgtcgccaccgcgctgccgcccatgttccagggccgcggcgacgccaccgtctgggcgcccttcctctccggcgccggcgtcccgctgccgccctacctggccaccgcgctggcgcaggacgagacggcgcggtacctgctggtcaccgtgcgcgtggacgggtggatccggtggaaggccggggccttcatcaccagccactaccacctcagggtgcgctgcccggcgctgctcaccgtcaacgacggccaggggagctacggatccaacgccggaggaggggtcggatacttcaagttcaaccgcgccgcgccatgcatcgtcgaagtctagctacctatacctatatattattacctgcctgcctcactaattttcatcatctctctactgttattacttcaatatatatataattactgttatcatcgatcgatccttaattacttcaagtaagtaaaatatgc

SEQ ID NO: 12408 - protein, 214 aa, Panicum virgatum
  misc_feature: Ceres CLONE 1762930
  misc_feature (40)..(178): Pfam Name: Hin1 Pfam Description: Harpin-induced protein 1 (Hin1)
MSIKYCDQHKDCERQRLYRRFCAGLAALILLALLIVLIVWLLLRPSKPRFYLNNLDIVCINVSSSAALSVTMQATLAARNPNARVGIFYDRADVYAEYRGLQVTVATALPPMFQGRGDATVWAPFLSGAGVPLPPYLATALAQDETARYLLVTVRVDGWIRWKAGAFITSHYHLRVRCPALLTVNDGQGSYGSNAGGGVGYFKFNRAAPCIVEV

SEQ ID NO: 12409 - DNA, 613 bp, Panicum virgatum
  misc_feature: Ceres CLONE 1762944
  misc_feature: Encodes the peptide sequence at SEQ ID NO. 12410
aaagcaagcagccacttcacactagggcacttggatcacacaagaaagttcaggtcggaagaagatgcaggccgccgccgctacagccgtcgggttctctgctgcggcgcccgtgaagggcaggccggcggcgaggagcacggtggtcgctcgtgtcccagccacaaggaggagcgttcgcgccgccgtggctgccgccatcgtcgcggcggagcccgccgaggtcgactacaactcgagcttctccgtgttccccatggaggcctgcgagctgcacggcggcgacgcctgctttttttttatgtacccggaggctaagctcaccggctcggcggacgcggccggcaggagggacgaggaggtggagagggactacctgtcctacgacgagccgaaaacggtgtaccacggcgaggcgtgcgacgacctcagtggctagttctgcgaggcgccgtaccagatacggcgtgtccagggagatggcgcacgccggatcgggtcgaagggtgatgggaagctcgccgatggtgcttacgctgaagatggggagctagcgtacgcgcacgtacataataacaccagctaaacaagggcaaggacttgtcacgtgtgt

SEQ ID NO: 12410 - protein, 124 aa, Panicum virgatum
  misc_feature: Ceres CLONE 1762944
  misc_feature (1)..(124): Pfam Name: Lir1 Pfam Description: Light regulated protein Lir1
MQAAAATAVGFSAAAPVKGRPAARSTVVARVPATRRSVRAAVAAAIVAAEPAEVDYNSSFSVFPMEACELHGGDACFFFMYPEAKLTGSADAAGRRDEEVERDYLSYDEPKTVYHGEACDDLSG

SEQ ID NO: 12411 - DNA, 623 bp, Panicum virgatum
  misc_feature: Ceres CLONE 1762975
  misc_feature: Encodes the peptide sequence at SEQ ID NO. 12412
aagtaagcagttcagcaagattatagatacaaggcttgaaggccattactctaagcagggcgctagaaaagtcgccaagttggccaatagttgtcttgcaaagcacagaagggaccgtccaacaatgagagaagtggtcaagagcctgaagcaagcaatgcagcacaaggagttagatggcgatgcaggggcttcaggtgagacttcaccacctgatgaggtatcggggaaaccaacaacagaggatgttgccgtggcatcagcaaggcggcggatgcttcatctggctgccctaggtgagaatgcaaacagcattgcgaaggcgagattcatgctcatgagggccgccgctcctccaactactacataatcttcagttgtgatcttttcttttgactctgtactttcttatgtggttatgaagataggctcgttggtgacgttttccctttgtcagtgtacatctattagatgatcaaacattcttttttttttcttccgatcagtactttctataggttttctattgtaaagctttcttccccttagggattctctatgtttgactgcaactttttgttcctgtttctgttcatactcgacttcactttttgttcctgttc

SEQ ID NO: 12412 - protein, 122 aa, Panicum virgatum
  misc_feature: Ceres CLONE 1762975
  misc_feature: SWISSPROT Homolog: EC 2.7.11.1 Non-specific serine/threonine protein kinase
SKQFSKIIDTRLEGHYSKQGARKVAKLANSCLAKHRRDRPTMREVVKSLKQAMQHKELDGDAGASGETSPPDEVSGKPTTEDVAVASARRRMLHLAALGENANSIAKARFMLMRAAAPPTTT

SEQ ID NO: 12413 - DNA, 892 bp, Panicum virgatum
  misc_feature: Ceres CLONE 1763009
  misc_feature: Encodes the peptide sequence at SEQ ID NO. 12414
tcaggtggcggcgcgttcctttatcctcctgcttctcctacttcctgatctcgcctgttaatcgccactgacgctcgttccgcttgcttgctccaggtttcccctcgcagtcggccaggtcctcgcagcgcgggagatggcggatcaggagaccccggttgcagttgaggcaccgacccctgttcttggggagccgatggacttgatgactgctctgcagctcgtcatgaagaagtctggtgcccatgatggcctcgtaaagggtcttcgtgaggctgccaaggccattgagaagcatgctgctcagctctgtgtccttgctgatgactgtgaccagcctgattatgtcaagctggtgaaggctctctgtgctgagcacaatgttcacctggttactgtgcctagtgctaaaactcttggcgagtgggcagggctttgcaagattgactctgagggaaaggcaaggaaggttgtgggctgctcatgtgtggttgtcaaggactacggcgaagaatcagagggccttaacattgtgcaggagtacgtcaagtcgcactagatagtgtgtttccgaatctacattttaggcctgagtttgaaattgtccttggtttcccggcttactaggagattagaacaattttcaagtgcaagccaagattgatgtgaacgatctggatatcttaactcttgttttaagcgctgtgttatctgcttttaatacatgtatctccaagagctggtggtattcttgcttgtttcttattttttgtccttcctggttgatttgtgcctatgctcagtggggggcgcttttgatgttagggctttggttttgcttgcatattgttgccgtgtacctggattgctccctaataatatcacatttatc

SEQ ID NO: 12414 - protein, 140 aa, Panicum virgatum
  misc_feature: Ceres CLONE 1763009
  misc_feature (25)..(120): Pfam Name: Ribosomal_L7Ae Pfam Description: Ribosomal protein L7Ae/L30e/S12e/Gadd45 family
MADQETPVAVEAPTPVLGEPMDLMTALQLVMKKSGAHDGLVKGLREAAKAIEKHAAQLCVLADDCDQPDYVKLVKALCAEHNVHLVTVPSAKTLGEWAGLCKIDSEGKARKVVGCSCVVVKDYGEESEGLNIVQEYVKSH

SEQ ID NO: 12415 - DNA, 803 bp, Panicum virgatum
  misc_feature: Ceres CLONE 1763020
  misc_feature: Encodes the peptide sequence at SEQ ID NO. 12416
ccccaaccctagccgccgggccgccgccgcttcttctcctcctcgcttgaaggcaggagcttgtgaagggtccatcagactgacaagatggttcttaagactgaactttgccgttttagtggccagaagatatatccagggaagggtattaggttcattcgtgctgattcccaggttttcctttttgctaactcaaaatgcaagcgttacttccacaaccgcctgaagcctgcgaagcttacctggacagctatgtacaggaagcagcacaagaaggacattcatgctgaagctgtcaagaagaggcgtcgcaccaccaagaagccatactcacgctcaattgttggtgccactttggaagttattcaaaagaagagaagtgagaagcctgaagttcgcgatgctgctagggaggctgctctacgtgagatcaaggagcgcattaagaagaccaaggatgacaagaaggccaagaaagcagaggtggcgaaatctcagaagacacaaactaagggtgcagcaccaaagggtcctaaaggccccaagatcggtggtggcggtgggaagcgctgaatgcccattgcatcatagagatatagttctgtcaactagccttctctccaatcctatcttagaccttggtcaagttagtctgccgtcttgagtcttcacctatctgatgagattggtgtcctgaatgttttggattatttctggagttgatttacattggcacttatgtcaattattgttcagcaagttttgtcttcgattgccgacaagtgataaccaaatgattttgc

SEQ ID NO: 12416 - protein, 161 aa, Panicum virgatum
  misc_feature: Ceres CLONE 1763020
  misc_feature (3)..(73): Pfam Name: Ribosomal_L24e Pfam Description: Ribosomal protein L24e
MVLKTELCRFSGQKIYPGKGIRFIRADSQVFLFANSKCKRYFHNRLKPAKLTWTAMYRKQHKKDIHAEAVKKRRRTTKKPYSRSIVGATLEVIQKKRSEKPEVRDAAREAALREIKERIKKTKDDKKAKKAEVAKSQKTQTKGAAPKGPKGPKIGGGGGKR

SEQ ID NO: 12417 - DNA, 476 bp, Panicum virgatum
  misc_feature: Ceres CLONE 1763024
  misc_feature: Encodes the peptide sequence at SEQ ID NO. 12418
gccagctcaagctatccaccaccatagccgccccgtcacctacgtggagggcatgaacgcctacagcggcctcaaggggctcaacaaggtcaccatgctcgggctgcgcaagaccgccgactactccttcgccaagatcgtggcgtcgctcagccccgccggcaaggcgcggcgcggcagcgcgttcggggcgcagatgaacgccgccgcggagatcttcaggatcgccgccatcatgaacggcctcgtgctcgtcggcgtcgccgtcgggttcgtgctgctccgggtggaggccgccgtcgaggaggccgagtaggggtggatgcccgccccgccctgattgcagccactccggctgtcgcctcttgcctcatataagccgtgatatataaaacgtgacgtatgcttttggttgaatttacttcggtatgtatccatgacaattgatgaataccgtgcaaacatgtttctggtct

SEQ ID NO: 12418 - protein, 104 aa, Panicum virgatum
  misc_feature: Ceres CLONE 1763024
  misc_feature (66)..(102): Pfam Name: PetM Pfam Description: PetM family of cytochrome b6f complex subunit 7
PAQAIHHHSRPVTYVEGMNAYSGLKGLNKVTMLGLRKTADYSFAKIVASLSPAGKARRGSAFGAQMNAAAEIFRIAAIMNGLVLVGVAVGFVLLRVEAAVEEAE

SEQ ID NO: 12419 - DNA, 404 bp, Panicum virgatum
  misc_feature: Ceres CLONE 1763052
  misc_feature: Encodes the peptide sequence at SEQ ID NO. 12420
ctctcgtgtgtttcctctatccaaaatggcgacacaggcgaccggcctggccgtgggcctgaacaagggccatgtggtgaccaagagggagctgccgctggcgccctcgaggcgcattgggcgcctgggcaagcgcgtgaagttcgtgcgcgatgtcattcgcgaggtggctggccttgccccttatgagaagcgcattatggagcttctcaaggtcggcaaggacaagcgcgctcttaaggttgccaagaggaagctcggcacccacctgcgcggcaagcggaagcgtgaggagctgtctggcctgatgcgcaagatggccgccaagaagtaaatgggtcccacacgggacttctctctcgagcgcagttgatgtctggtttctgtaacaggcggactttcac

SEQ ID NO: 12420 - protein, 102 aa, Panicum virgatum
  misc_feature: Ceres CLONE 1763052
  misc_feature (3)..(101): Pfam Name: Ribosomal_L36e Pfam Description: Ribosomal protein L36e
MATQATGLAVGLNKGHVVTKRELPLAPSRRIGRLGKRVKFVRDVIREVAGLAPYEKRIMELLKVGKDKRALKVAKRKLGTHLRGKRKREELSGLMRKMAAKK

SEQ ID NO: 12421 - DNA, 714 bp, Panicum virgatum
  misc_feature: Ceres CLONE 1763059
  misc_feature: Encodes the peptide sequence at SEQ ID NO. 12422
gcagtcataacaaccactgatgatgctggcagtccattggccataagagatttcagtggcctagctgactccttgactacaaggagcagcaaatcagagagccttcgcagtctgcagtcctcgtacgagcaagaatacccaagtgtaagccgacggcgccgtgtgcgctttgaggttccagaggatgatgatatgggtcagcaagtgaaagatgagctcatggcacttgtggaagcgaaacatgctggggtggcatacatcatgggccattcttatatcaaagctaggaggagttcgagtttcctgaagaagtttgctattgatgttggctactctttcctccggaagaactgcagaggtccatcggtcacactgcacattccgcacattagcctgatagaagtgggcatgatatactatgtttagccgtatgcccattgccaagttcatgtggatacctggttgctatgaagcatgtgctacctgcagctttgttctggagttaaaaggctcgtggagaagagatgatgcatcctaaggtgcttctggtttcagcttgtagagatgactttccttgttaatattatttttagcctaaataaacaatcagaacggggcgagttacgctaagttttccgtttggtgtatttacatgcatgctctgtaatttttctgagagctatgtaatggaaatatgcattatcttgttcttac

SEQ ID NO: 12422 - protein, 141 aa, Panicum virgatum
  misc_feature: Ceres CLONE 1763059
  misc_feature: Useful for making plants with modulated biomass
AVITTTDDAGSPLAIRDFSGLADSLTTRSSKSESLRSLQSSYEQEYPSVSRRRRVRFEVPEDDDMGQQVKDELMALVEAKHAGVAYIMGHSYIKARRSSSFLKKFAIDVGYSFLRKNCRGPSVTLHIPHISLIEVGMIYYV

SEQ ID NO: 12423 - DNA, 898 bp, Panicum virgatum
  misc_feature: Ceres CLONE 1763061
  misc_feature: Encodes the peptide sequence at SEQ ID NO. 12424
gatcatcacaattattcatttctcgcatttgcagcccccacaaacccccgaaggaaggaagagaagagctcccgatggagaacgccgccgcgaagccgtcgctgtccaagaagccctcgccgtcgttccgcctccggaacggcagcctcaacgcgctgcggctgcgccgcgtgttcgacctcttcgaccgcaacggggacggcgagatcaccctcgacgagatggcctcggcgctcgacgcgctcggcctcggcgccgaccgctccggcctggaggccgccgtcggggggtacatcccggccggcgctgcggggctccgcttcgacgacttcgagtccctccaccgcgcgctcggggacgcgctgttcggccccatcccggaggcggtgcccgaggaggaggacgaggagggggacatgaaggaggcgttccgcgtgttcgacgaggacggcgacggctacatctcggccgccgagctccaggccgtgctcaagaagctcggcctgcccgaggcgcggaacctcgccacggtgcaggagatgatctgcaacgtcgacagcgaccgcgacggccgcgtcgacttcggcgagttcaagaacatgatgcaggggatcaccgtgtggggcgcctagctgcagcgtccctgcgttgccaaccttctacagcgtgttgacatgtatgtatgatgtatctactatgtaggcagcgccttttcttctacccggcgcttcttcttcttggtcgcgctgtggattcttcttgttcttggcttcgcgctgtttgggatcctagccttcagaaatttggggcaacagcgaaggcccacaggccacgggcattgtttcctgttcttatttatttaatagcattattacatgtaagaacgttgatcttgacc

SEQ ID NO: 12424 - protein, 185 aa, Panicum virgatum; identical to SEQ ID NO: 10425
  misc_feature: Ceres CLONE 1763061
  misc_feature (114)..(142): Pfam Name: efhand Pfam Description: EF hand
  misc_feature (29)..(57): Pfam Name: efhand Pfam Description: EF hand
  misc_feature (152)..(180): Pfam Name: efhand Pfam Description: EF hand
  misc_feature: SWISSPROT Homolog: EC 2.7.11.1 Non-specific serine/threonine protein kinase

SEQ ID NO: 12425 - DNA, 823 bp, Panicum virgatum
  misc_feature: Ceres CLONE 1763062
  misc_feature: Encodes the peptide sequence at SEQ ID NO. 12426
tggccgccatgagcggcggcggcgagtgcgggaacggcgacctgctcgggctgctgctggaggcgtggacgccgcagcggcgggcgggcgccgagacgctgacgacggacgaggtggtcgacgagtgcaagaccttcttcgccgcggggcaggagaccaccgccaccctcctcgtctgggccatgttcctgctcgccgcgcacccggagtggcaggacagggtccgggaggaggtcctccgggaattccccgacggcggcgccggcgaggcccccggcgccgacgtcctcggccagctgaagctgctgcacatggttctgctggaggagtcgcgcctctacccgccgttcgtctacatccagcggcgggccgccatggacgtcgtcctcggaggcatcaaggtgccgcgagggaccatggtgtcgatccccatcgccatgctgcaccgggacagggaggtctggggccccgacgccgacgagttcaaccccatgaggttcgagcacggcgccgccagggctgccaaggaccccaaggcgctgctgacattctccatgggcccgagggtgtgcacggggcagagcttcggcatcgtggaggcgcaggtcgccatggcgatgatcctcagcaagttctccttctccctctcacccaagtacgttcacaagccgaaatatctactgtccttgactcccaggagtgggatgcctctcatcgtgaagaatctagatgggtgacaaacgttgcaaaaacctcattgtaatgtgtgagaataaatgtacgaccaccggccggtgtgtgataaacggtgacgtttttgtcc

SEQ ID NO: 12426 - protein, 242 aa, Panicum virgatum
  misc_feature: Ceres CLONE 1763062
  misc_feature (1)..(236): Pfam Name: p450 Pfam Description: Cytochrome P450
  misc_feature: SWISSPROT Homolog: EC 1.3.3.9 Secologanin synthase
MSGGGECGNGDLLGLLLEAWTPQRRAGAETLTTDEVVDECKTFFAAGQETTATLLVWAMFLLAAHPEWQDRVREEVLREFPDGGAGEAPGADVLGQLKLLHMVLLEESRLYPPFVYIQRRAAMDVVLGGIKVPRGTMVSIPIAMLHRDREVWGPDADEFNPMRFEHGAARAAKDPKALLTFSMGPRVCTGQSFGIVEAQVAMAMILSKFSFSLSPKYVHKPKYLLSLTPRSGMPLIVKNLDG

SEQ ID NO: 12427 - DNA, 820 bp, Panicum virgatum
  misc_feature: Ceres CLONE 1763069
  misc_feature: Encodes the peptide sequence at SEQ ID NO. 12428
aaacggccaaacagccactcacactcctgccgctctgttataacgcacatcccgtctgcaccccgaggtcggcgaattgctctctcttcccgtcttctctcgcacaagtcatggcgaagccgcaggttcttctctgcctcctaatcgccgccgccgcgctgctactcgtcgccgcggccaagaaatccggcgacgtgactgagctccagatcggcgtcaagtacaagcctgaatcctgcagcattcaagctcacaaaggtgacagagttaaagttcactaccgtggaaaacttactgatggaacagtttttgattcaagctatgaaaggggtgaccctattgaatttgaattgggcactggccaagtgatcaaaggctgggatcagggtctcctgggaatgtgtgttagtgagaagcggaagctgaagattccatcaaaacttggctatggccctcaaggatcaccgcccactattccgggtggtgcaactctcatatttgacactgagcttgttgctgtcaatggggagccatccagcaaatctgatgaggacagtgagctttagatagcgggagggtagaatcggcttccagaatccagatcaaacaattatcagatcagatagatgaatgcagaaaccattttactcagaactcggcaaatgtaatgcacttagagaaatgagcattcgttccctgtgacttcgttttgctattccacaagaacaactagtctttctggagtaaactcctgatcttgtgacttcttttttggaatcgctagtcttgtggcttcatttggatgacaagattcatattg

SEQ ID NO: 12428 - protein, 151 aa, Panicum virgatum
  misc_feature: Ceres CLONE 1763069
  misc_feature (41)..(135): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MAKPQVLLCLLIAAAALLLVAAAKKSGDVTELQIGVKYKPESCSIQAHKGDRVKVHYRGKLTDGTVFDSSYERGDPIEFELGTGQVIKGWDQGLLGMCVSEKRKLKIPSKLGYGPQGSPPTIPGGATLIFDTELVAVNGEPSSKSDEDSEL

SEQ ID NO: 12429 - DNA, 631 bp, Panicum virgatum
  misc_feature: Ceres CLONE 1763072
  misc_feature: Encodes the peptide sequence at SEQ ID NO. 12430
gtttcttttcctcctcggcggcggcggctagcgaagaaggcgacggcgaaacgggcaagggtacggggtgcttcggcaagcgccggaacaagacgcacacgctgtgcgtgcgctgcggccgccgtagctttcacctgcagaagagcacctgctcctcatgtggctaccccgcggcccgcatccgcaagtataactggagcataaaggctattaggaggaagactactggcacagggaggatgaggtaccttcgccacctgccccggaggttcaagagcaacttcagagagggaactgaggccgtgtcaaggaagaagggagctgcttctggcgccaactaagtatgtgttctccacttctgctaggcaggaccgtgggtcaatgaatctagtgtttttgttgctttacttctatgttcctaaattgagaggcaaacgatgcttatctatgttatttcatatcctggatgttaacccttactgtttcgaatgtcgaatcatgccatgtgttgttagttgccaccctatttacagaattaactctacatctgcctgcgtgatgttgtgttatgtttactgctatgatttctgtgactccgatgatgaatggtggttcatgattctgttgttag

SEQ ID NO: 12430 - protein, 112 aa, Panicum virgatum
  misc_feature: Ceres CLONE 1763072
  misc_feature (18)..(71): Pfam Name: Ribosomal_L37e Pfam Description: Ribosomal protein L37e
FFSSSAAAASEEGDGETGKGTGCFGKRRNKTHTLCVRCGRRSFHLQKSTCSSCGYPAARIRKYNWSIKAIRRKTTGTGRMRYLRHLPRRFKSNFREGTEAVSRKKGAASGAN

SEQ ID NO: 12431 - DNA, 675 bp, Panicum virgatum
  misc_feature: Ceres CLONE 1763089
  misc_feature: Encodes the peptide sequence at SEQ ID NO. 12432
acaactcgcatctggagccatcggagttcatcagcactctctagtcacacagcacatcttcttctcctcctgctacagagctcaggcaaaagcttcgccgccacaacatcccaatggctcgcttcgccgtggtcgccgccatcgtcgccctcctcgccgtcaccgcggccgcgcaggccccggccgcgacgcccaccccggcgcccaggatggccccgctgccgcgctccccggccaccgccccggcaccggccgcgaagccgcccaccgcctcggcgccgtccccgctggcctctcccccggccccgcccgccgccgagggccccgccgcggccgcgccctccgcgctgacaccgaccagctccgtctccgcccccgccggcgcccccaccgccacgcccaccgggaacggcgccgcctcctccgccgtcagcttcgtcgccgtcgccgctgttgccgccgccgccgtcgtgttctagatgggggacgcgtgatgggatctcgagctgtttatactgccatattcttttttgccattcttttttattagataccgatgatgagagagcagagagagagaggacatttgagggggggattcaccgagtgctgtacacatcatgcatggttcatgatgatatgattattaatggaattctttcatttgttactact

SEQ ID NO: 12432 - protein, 121 aa, Panicum virgatum
  misc_feature: Ceres CLONE 1763089
  misc_feature: Useful for making plants with altered carbohydrate content
MARFAVVAAIVALLAVTAAAQAPAATPTPAPRMAPLPRSPATAPAPAAKPPTASAPSPLASPPAPPAAEGPAAAAPSALTPTSSVSAPAGAPTATPTGNGAASSAVSFVAVAAVAAAAVVF

SEQ ID NO: 12433 - DNA, 818 bp, Panicum virgatum
  misc_feature: Ceres CLONE 1763107
  misc_feature: Encodes the peptide sequence at SEQ ID NO. 12434
agcagcagctcgagcacacacgtagacttgaagctagagagtccacagctagcccctgctcgaggctgcgaggatgtcgctggtaaggctgctcgacacgctggccccgggctcgtggaggaaccccttcagcatcttcggcacggcggtggccgccgacacgtggctggcgagcgacacctcggcgttcgccaacacctacatcgagagccgggacacggcgggcgcgtacgtgttcagcgcggcgctgccgcccggcgtgaggaaggaggaggtgcgggtggaggtagacgagggcaacgtgctggtcatcaccagggagcggagcgtccgccgggaggagcgcggcgacaggtggcaccacatcgagcgcagctgcgccacgttcctcggcaggttccacctgcccggggacgccgccgtggacggcgtcagggccgccatggacgccggcgtgctcacggtcaccgtgcccaaggtcggggccatcgccgccgccgccgcctccgtcgagaagccggtcggggagccgacggtggccgtggaggccggcccctgctgatttgacgcgccggcgcgcgcgttccatcacgggcgaggcacgcccctgttggacgaacactaaggtctctcgtccgtaccgtctgaagcttcctcctcctctggtttggtattgcatactttcccgtgtgatggatctgcctgcacgcatgtaacaagaaaaaaaaaagaatccgttctgtgctcggtaaatgaatagcaacctaagcagctaagctggaatcctgtacatgtctctactaatttcttcgtctttt

SEQ ID NO: 12434 - protein, 162 aa, Panicum virgatum
  misc_feature: Ceres CLONE 1763107
  misc_feature (45)..(158): Pfam Name: HSP20 Pfam Description: Hsp20/alpha crystallin family
MSLVRLLDTLAPGSWRNPFSIFGTAVAADTWLASDTSAFANTYIESRDTAGAYVFSAALPPGVRKEEVRVEVDEGNVLVITRERSVRREERGDRWHHIERSCATFLGRFHLPGDAAVDGVRAAMDAGVLTVTVPKVGAIAAAAASVEKPVGEPTVAVEAGPC

SEQ ID NO: 12435 - DNA, 935 bp, Panicum virgatum
  misc_feature: Ceres CLONE 1763114
  misc_feature: Encodes the peptide sequence at SEQ ID NO. 12436
atcggtgatcgtcgtcccaccccaagcaagtgtccgagagcgagcttgcggcgtccgagtagagacgatggcgagcggcaggggcggcgcggcggcgagtgctctagtagggctggtggctttcttcgtgtgcctgctgtcctgcggcctcgcgcagggcggccgtgtggcgcggaaggacctcggccttgacctcggcggcggcggcgggggacagggcggcgcggggctgggcctcgggctgggccttgggctcagggtgggcaccgggggcgtgtccgcgtcggggtctgggtccgggtccggatccgtggccggggtggggtcgacgtccgggtcccggtccgggtcgatctccgttggcggggcgagctcgtcggcggggtcgagagccggatcgtccgctgggtcgagtgggtcgggggccgggtcctctgctgggtccggtggcgggcaagggtttgggctgggtggtgggagtgggtctggttccgggcacggtgagggcggcgggtctggcggtgggctcggcaatggggtcgtcggcgttgggtatagtgagggatacggtcatgggtcgcctggctcgggtgggaatccttgattgatcgtacgtgtttgaggtcatcgctttgtggttatgttggatattatgtgttttttttggaaaaagcttatcaaaaccatgtatgctatggttattacaatactagttttagtctggttattgataagttactgtagaatcgttgtcatttggcagcagctaagaaataattaagctatgccaaacatgactattgtgtgcgcgtgcgcgtgtgtcatggcaaaaagtgtattatttggtgatgaaaagttgtcttgaagagagaaatgtatttttctttttccgtttgtgatatatgcatccaataaaaaaacggtctgtgtttgtc

SEQ ID NO: 12436 - protein, 178 aa, Panicum virgatum
  misc_feature: Ceres CLONE 1763114
  misc_feature: Useful for making plants with altered alkaloid content
MASGRGGAAASALVGLVAFFVCLLSCGLAQGGRVARKDLGLDLGGGGGGQGGAGLGLGLGLGLRVGTGGVSASGSGSGSGSVAGVGSTSGSRSGSISVGGASSSAGSRAGSSAGSSGSGAGSSAGSGGGQGFGLGGGSGSGSGHGEGGGSGGGLGNGVVGVGYSEGYGHGSPGSGGNP

SEQ ID NO: 12437 - DNA, 936 bp, Panicum virgatum
  misc_feature: Ceres CLONE 1763122
  misc_feature: Encodes the peptide sequence at SEQ ID NO. 12438
gttattactgtcaatgtaagcagctgattcagtgaagaagctctttatttgttgctgctctgctatgcacgacaatgaatgataacaagtaacagggaaggtgtgaagtatgtgtatgtgtatgtgcagtgctgcaagcctgcaatgtactcataaaaaccataggttaccaaggacacttattttttatgaagagtaccaagggcacattttggtactaaaaaaaaggctccaagctagctagaaactcaaaatactaacaatggcctccctctcctctgccgccgtcaccgccccttccttcgccgcggctgcccggcccgcccccaggcgctctgctgctttcaccgtgcgcgcctcgctcggcaaggccgccggcaccgccgccgtggccatggccgccagcgccctgctcgcaggcggcgccgccatggcccaggaggtgctgctgggcgccaacggaggcgtcctcgtcttcgagcccagcgagttcaccgtcaaggccggcgaggccatcaccttcaagaacaacgccgggtacccccacaacgtggtcttcgacgaggacgaggtgcccagcggcgtcgacgctgccaagatctcgcaggaggagtacctcaacgcgcccggcgagacctactccgtcacgctcaccgtgccggggacctacggattctactgcgagccgcaccaaggagccggaatggtcggcaaggtcaccgtcaactgatgcatgctgcgatatatctatcatctgcgcatgcatctactgcgtgctatcaattacagtactacaagtattatgtattcaaacgtatgtacctaccaggaggctaggctagctagctagagagcttattagcttgccttcccctcaagagtcagtgaccatcttgtacctaccaagtggcctgaatgcatgcatgctattgcttc

SEQ ID NO: 12438 - protein, 111 aa, Panicum virgatum
  misc_feature: Ceres CLONE 1763122
  misc_feature (15)..(111): Pfam Name: Copper-bind Pfam Description: Copper binding proteins, plastocyanin/azurin family
  misc_feature: Useful for making plants with modulated nitrogen use efficiency
MAASALLAGGAAMAQEVLLGANGGVLVFEPSEFTVKAGEAITFKNNAGYPHNVVFDEDEVPSGVDAAKISQEEYLNAPGETYSVTLTVPGTYGFYCEPHQGAGMVGKVTVN

SEQ ID NO: 12439 - DNA, 858 bp, Panicum virgatum
  misc_feature: Ceres CLONE 1763133
  misc_feature: Encodes the peptide sequence at SEQ ID NO. 12440
ggacttcgggcagaacaaaattcctaattcctcctccacctagtcaccagagtctctccgcgcgccgcgtgagccgccaacgatggcccttggagtacgtcgcttcagagcgtagggcgctcgcacgccgcccccgccggcggcaaggacagagctcgccgtcggcagcagcttcgcgcagtccaagcgggccgccgccgcgccgctgtccgtcggccgcgtcgccacgcggcggccgcggcacgtctgccagtccaagaacgccgtcgacgaagtgctggtggcggacgagaagaactgggacgggatggtgatggcgtgcgagacgccggtgctggtggagttctgggcgccgtggtgcgggccgtgccggatgatcgcgccggtgatcgacgagctggccaaggactacgccggccagatcaagtgctgcaaggtgaacacggacgactgccccaacgtggcctccacctacggcatccgcagcatccccaccgtgctcatcttcaagggcggcgagaagaaggagagcgtcatcggcgccgtgcccaagaccacgctcaccaccatcgtcgacaagtacatcggcagctcgtgagccagacaactataaatacatacgtgtccgtgctcgcgcgtacacacaccatgtatgtgtatctcttgtttcgtagtaaggatgatgatgcgataactcaggcagccgtctgctcctgctccgttatactatgtccaatccaactccattaattagtttcgatcggtgcatgtttttcacagtgaatattataaatcaagtcaggcatggcatcatgtgtgtatattattattatttgttactgtattaccagcaccgct

SEQ ID NO: 12440 - protein, 96 aa, Panicum virgatum; identical to SEQ ID NO: 12010
  misc_feature: Ceres CLONE 1763133
  misc_feature (2)..(92): Pfam Name: Thioredoxin Pfam Description: Thioredoxin
  misc_feature: SWISSPROT Homolog: EC 1.8.1.8 Protein-disulfide reductase
  misc_feature: Useful for making plants with modulated heat sensitivity

SEQ ID NO: 12441 - DNA, 770 bp, Panicum virgatum
  misc_feature: Ceres CLONE 1763159
  misc_feature: Encodes the peptide sequence at SEQ ID NO. 12442
cgtcctattagagttgtaccatttcctgtccctgttcaaggtctcacatttgatgggcagccattctggaatggtacgccagtggcatccctgttctactcacagtccgctcctcccatttggaatagcaaaacatccatgtggcaagaatcaaccccacaagcaacctcagtgcagcagaagtcacaacagaatgagccaaatgaaatgggcccaaagccagttcaaaacgcagaggaacaatctcacataagtcatcctagttccaatgggaagcaactacgtgttgaaattcctaaagatgaggcacggcatgtttctcctatgactggtgaaagtggaactagcaccgtgcttgacagcgtcagaaatactctcagtgtcagcggctgtgacagcaattccaaccggatccctgcccctactgaatcgtccaacacatttaagggtgttcctgaaaccccaagtgctgaaggttcacgtcacctgagccagcgagaggctgcactgaacaaattccggctaaagaggaaggataggtgttttgagaagaaggtccggtaccagagcaggaaattactcgcagagcagcgcccacgggtcaagggccagtttgttcgtcaagatcatagcatccaaggaacttaggggtgccgccaccactggtgagtggtgatgtgagtggtgactaccgcactgcagatatcctgatcgtcagtgtcagattttgctgaagagttggaagcaatcacactgagtactgtttgcct

SEQ ID NO: 12442 - protein, 215 aa, Panicum virgatum
  misc_feature: Ceres CLONE 1763159
  misc_feature (166)..(210): Pfam Name: CCT Pfam Description: CCT motif
RPIRVVPFPVPVQGLTFDGQPFWNGTPVASLFYSQSAPPIWNSKTSMWQESTPQATSVQQKSQQNEPNEMGPKPVQNAEEQSHISHPSSNGKQLRVEIPKDEARHVSPMTGESGTSTVLDSVRNTLSVSGCDSNSNRIPAPTESSNTFKGVPETPSAEGSRHLSQREAALNKFRLKRKDRCFEKKVRYQSRKLLAEQRPRVKGQFVRQDHSIQGT

SEQ ID NO: 12443 - DNA, 825 bp, Panicum virgatum
  misc_feature: Ceres CLONE 1763171
  misc_feature: Encodes the peptide sequence at SEQ ID NO. 12444
cgcactccactctcacggtcggacctcgtcatccatgcctcccctccccgccgcggccatggccaccgcgacgctgccccttcgcctcctcccctccaagaccctgaccatctccgtcccctccgcgcgccgctccctctccgtcgcctctgtcccgcaccggcgctggcagctccgagccgccgccgaggaggcgcccgaggccgtggaggttgagttcgtggagcccgaggcggaggctgaggaggagagacccgcggtgccggagcccgtcgaggcgcagctcgctgcggcgggggccgggaaggatgccgacatcttcgctgttgtcatgattggttcaaggcaatacattgtgatgccaggccggtatatatacacacagagattgaaaggtgccaatgtcaatgatcagatcatattaaacaaggtgctactagtgtcaactagagacaaagcgtacattggaatgccagtggtgactaatgctgctgttcatgcagtggtcgaagaacagggacgggatgataaagttatagtcttcaagtacaagaagaagaagaagtaccagaggaaacttggtcacagacagccaaacacaaggttaagaatcacaggcataagcggatatgaagagtaccctgctgacccaatacttgaccctactacagcttaagctaaattgtaagttatgtagttacaaacggctggtagtacagtagcatgcaaatttttctttttctgcaaggaacatttttcagcaaaaatttactttgtttgcgtgttcaaattctgccagtcaaccagtggttccatcccctgttt

SEQ ID NO: 12444 - protein, 205 aa, Panicum virgatum
  misc_feature: Ceres CLONE 1763171
  misc_feature (87)..(183): Pfam Name: Ribosomal_L21p Pfam Description: Ribosomal prokaryotic L21 protein
MATATLPLRLLPSKTLTISVPSARRSLSVASVPHRRWQLRAAAEEAPEAVEVEFVEPEAEAEEERPAVPEPVEAQLAAAGAGKDADIFAVVMIGSRQYIVMPGRYIYTQRLKGANVNDQIILNKVLLVSTRDKAYIGMPVVTNAAVHAVVEEQGRDDKVIVFKYKKKKKYQRKLGHRQPNTRLRITGISGYEEYPADPILDPTTA

SEQ ID NO: 12445 - DNA, 602 bp, Panicum virgatum
  misc_feature: Ceres CLONE 1763182
  misc_feature: Encodes the peptide sequence at SEQ ID NO. 12446
ctcgcgccgccgaaacggaacacccccgagccgaatcgccgccccggagcagagcggaggagaggagaggagatggcggagaagaagggagcggcggcgaggaaggaggaggtggtcaccagggagtataccatcaaccttcacaagcgcctccacggctgcacattcaagaagaaggcacccaatgccatcaaggagatcaggaagtttgcacagaaggccacgggcaccaccgatgtccgggttgatgtgaagctgaacaagcacatctggagcagcgggatcagaagcgttccgcggagggtgcgtgtgagaatcgcccgcaggaggaacgatgaggaggatgccaaggaggaactctactccctcgtcaccgccgctgagattcctgctgagggtttgaaagggctgggaaccaaggtcatcgacgaagcggattaagctctcgcatcctttacatctttagaacaagtgtagcttgtattgtcaacagcaaaccttttgtggcccaacgaagttttgaactcttgtactgtgatgcgacatcacaaagttctctatttccttaaatcgaattcagtggtctatgtgttcagttcttt

SEQ ID NO: 12446 - protein, 122 aa, Panicum virgatum
  misc_feature: Ceres CLONE 1763182
  misc_feature (10)..(104): Pfam Name: Ribosomal_L31e Pfam Description: Ribosomal protein L31e
MAEKKGAAARKEEVVTREYTINLHKRLHGCTFKKKAPNAIKEIRKFAQKATGTTDVRVDVKLNKHIWSSGIRSVPRRVRVRIARRRNDEEDAKEELYSLVTAAEIPAEGLKGLGTKVIDEAD

SEQ ID NO: 12447 - DNA, 864 bp, Panicum virgatum
  misc_feature: Ceres CLONE 1763204
  misc_feature: Encodes the peptide sequence at SEQ ID NO. 12448
aaaaggtgaaaaaagcgacgcgtcggaggctcggagctcgctgccacaccaatcgcccctcctctcgctccctccctcttatctcctctcctcggctccgccagctccgcctcgtcattgccccgccgccgccttcctcgtccctggtacctgcgcgcgcggcagccggcagctagcagagatggccctgcagcaggctccggcgtcgtccctggcgcgcgcgccggcggcgccgccccggtcgtccttctcggcgccgtggccggcgctgcggcagccggcgccggcgcggcggcgggcggccgcgtccacggcctcgcggatcatcaccatgcgggtcgcgtccaagcaggcctacatctgccgcgactgcgggtacatctacaacgacaggaccccgtttgagaagctggccgacaactacttctgccccgtttgcggagctccaaagaggaggttcagaccttaccagccggcggtgtccaagaacgcgaactccaccgatgtccgcaaggcgaggaaggagcagctgaagaaggacgaagcaatcgggcaagccttgccgatcgccattgtcgccggaatcatcgctctggccggcctctacttctacctcaacaacgcctacaactagacgaacaaacacgcttcagagacgaccaatccatttggtgccggggacaggattcttcccattttgccctttgtttttgtggctgtacatgtgtgcgtcatgctacatgcatactactagggatccaattcaacctccaagacagttatacaacccgttgttgagcttgaaatgccatacgttactcaactgacagatgattatgattttgagtgctacacttaaattcg

SEQ ID NO: 12448 - protein, 150 aa, Panicum virgatum
  misc_feature: Ceres CLONE 1763204
  misc_feature (58)..(93): Pfam Name: Rubredoxin Pfam Description: Rubredoxin
MALQQAPASSLARAPAAPPRSSFSAPWPALRQPAPARRRAAASTASRIITMRVASKQAYICRDCGYIYNDRTPFEKLADNYFCPVCGAPKRRFRPYQPAVSKNANSTDVRKARKEQLKKDEAIGQALPIAIVAGIIALAGLYFYLNNAYN

SEQ ID NO: 12449 - DNA, 754 bp, Panicum virgatum
  misc_feature: Ceres CLONE 1763229
  misc_feature: Encodes the peptide sequence at SEQ ID NO. 12450
acactccgttaccaagccttcttcttctcctccccggacccggagccttctcctcactcctccgagctggctagcgacaagcgcgacgtcctcggcggcgatgccggcctgtgccttgataacggcgaggtggcggccatgagcagcaagacggtagtggaggagctgtaccgtgccctggagcgcggcgacgtggacgccgtgccccggctgctgaacccggacgtggactggtggttccacggcccgcgggcgcaccagcacctggtgctcatgcgcctgctcaccggcggcggcggcggcctcccgttcacgatccggtcccttgacgcgttcggggcgaccgtgctggccgagggaaccgacgcgacgggggcgctgtactgggtgcacgcgtggaccgtggggccaggtggccgcgtcaccgaggtgcgcgagtactgcaacaccacgctcgtcgtgacgaggctcggcggcggcggcggtgccggtgccggtgccggggccgacgtcaccgctgctgcggcggagaaggcgaaggcgccgtgctcgcagtcgcagtcggagcaggtgtggcagagccggctgcccgaccaggctcgtcggaacctccctggcctcgtgcttgccatctgatctcatcagatgcgaatcatccatcgtgccttgtggccatcagctctgcatgtttccaatgtggttacagggacataaacgaatcaaatgcctataaaaaagcaaaagaaatcatgcg

SEQ ID NO: 12450 - protein, 211 aa, Panicum virgatum
  misc_feature: Ceres CLONE 1763229
  misc_feature (92)..(211): Pfam Name: WI12 Pfam Description: Wound-induced protein WI12
TLRYQAFFFSSPDPEPSPHSSELASDKRDVLGGDAGLCLDNGEVAAMSSKTVVEELYRALERGDVDAVPRLLNPDVDWWFHGPRAHQHLVLMRLLTGGGGGLPFTIRSLDAFGATVLAEGTDATGALYWVHAWTVGPGGRVTEVREYCNTTLVVTRLGGGGGAGAGAGADVTAAAAEKAKAPCSQSQSEQVWQSRLPDQARRNLPGLVLAI

SEQ ID NO: 12451 - DNA, 277 bp, Panicum virgatum
  misc_feature: Ceres CLONE 1763233
  misc_feature: Encodes the peptide sequence at SEQ ID NO. 12452
accacacaaccaaccacactagcactgatcgagctagctagctaccagccaagatggcggccaaacgtctggcgcttgccatcctcgtcctccttagcgtaagcatggtggccactgctgctggagcccgcaagctgggctacggtcccggaggaggaggaggcggcggtagtggtggaggtggagggggtggctatgggggagcgggctgtgggggcgggtgggggtgcggtggggggggtgggggtggggctgctgttggtgggggcggtggtgg

SEQ ID NO: 12452 - protein, 74 aa, Panicum virgatum
  misc_feature: Ceres CLONE 1763233
  misc_feature: Useful for making plants with altered lignin content
  misc_feature: Useful for making plants with modulated nitrogen use efficiency
  misc_feature: Useful for making plants with altered alkaloid content
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with altered terpenoid content
  misc_feature: Useful for making plants with modulated flowering time
  misc_feature: Useful for making plants with modulated biomass
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 2 in US patent 7189892
  misc_feature: The sequence is a functional homolog of SEQ ID NO 644 in the 10/666,642 US patent application
  misc_feature: The sequence is a functional homolog of SEQ ID NO 1844 in the 10/374,780 US patent application
  misc_feature: The sequence is a functional homolog of SEQ ID NO 468 in the 11/479,226 US patent application
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
  misc_feature: Useful for making plants with modulated heat sensitivity
  misc_feature: The sequence is a functional homolog of SEQ ID NO 1226 in the 10/412,699 US patent application
  misc_feature: The sequence is a functional homolog of SEQ ID NO 923 in the 10/374,780 US patent application
MAAKRLALAILVLLSVSMVATAAGARKLGYGPGGGGGGGSGGGGGGGYGGAGCGGGWGCGGGGGGGAAVGGGGG

SEQ ID NO: 12453 - DNA, 812 bp, Panicum virgatum
  misc_feature: Ceres CLONE 1763245
  misc_feature: Encodes the peptide sequence at SEQ ID NO. 12454
gtagttcttgagagcttctgactggtgctggtgtgtgccttccaagtgtgagtgagtttttgcgagttgccatgggaggcaccttggagtacctgttgggactgctgggagggagtggaggacatggccacgagaagacgaagaagaggaagcagctgcagactgtggagctcaaggtcaggatggactgcgagggatgtgagctcaaggtcaagaacgccctctcctccatgaaaggtgtggagtcggtggaggtgaaccggaagcagcagaaggtgacggtggtcgggtacgtggaggccggcaaggtgctgaagaaggcgcagtcgacggggaagaagaccgagatctggccctacgtgccctacagcctggtgagccagccgtacgtcgccggcacctacgacaagcgcgccccgccgggctacgtccggagcgcggaccccggctacatgcccagcgtcgccgtccaccaccaccaccagcagcagctcggccggccgcacgaccacctcaccgacatgttcaacgacgagaacccaaactcctgctcggtcatgtgagggggccaagaggagaggttgacgatgatgctggagcttctcgagagagaaccggagatcgggtgaatgttcatggtttggtctgctcagtgttaaattaatcgtttgtaccgaggcgtgtagctggtagtactacgatgtagttttcttgtagctccctgctttatgatcctcctgccccgtcatcgttcgatgtgtattggcaggagaatttgtttgtttgccgttgaaaaactttcaaatcgtcgt

SEQ ID NO: 12454 - protein, 163 aa, Panicum virgatum
  misc_feature: Ceres CLONE 1763245
  misc_feature (33)..(93): Pfam Name: HMA Pfam Description: Heavy-metal-associated domain
  misc_feature: Useful for biocontainment applications
MGGTLEYLLGLLGGSGGHGHEKTKKRKQLQTVELKVRMDCEGCELKVKNALSSMKGVESVEVNRKQQKVTVVGYVEAGKVLKKAQSTGKKTEIWPYVPYSLVSQPYVAGTYDKRAPPGYVRSADPGYMPSVAVHHHHQQQLGRPHDHLTDMFNDENPNSCSVM

SEQ ID NO: 12455 - DNA, 782 bp, Panicum virgatum
  misc_feature: Ceres CLONE 1763249
  misc_feature: Encodes the peptide sequence at SEQ ID NO. 12456
ctctcccacttcctccattcgcgcttcgcctctctctctctgcccgtctccactccctccgttagatccctcgccccggctgccatggcggaccagctcaccgacgaccagatcgccgagttcaaggaggccttcagcctcttcgacaaggacggcgacggctgcatcaccaccaaggagcttggaactgtgatgcgctcattggggcagaaccctactgaggctgaactccaggacatgatcaatgaggttgatgcagatggtaacggaaccattgacttccctgagttcctcaacttgatggcacgcaagatgaaggacactgactctgaggaggagctcaaggaggccttccgtgtgtttgacaaggaccagaacggcttcatctccgcggctgagctccgccacgtcatgaccaaccttggcgagaagctgacagacgaggaggtggacgagatgatccgtgaagctgatgtggacggcgatggccagatcaactacgaggagttcgtgaaggtgatgatggccaagtgaagatgaccggtgaaactgatgtgcccttttgaagctagtttctctcctgatggtagtaactagtttagtgttgaagactgactgcatttagttatcccttattccgatccgtgcgccaatgaacagatctactgtttgttttcttccctgggattttactgtatcggtaatttatttcagattcgtttgcgattgtattacatttgtgttatctgggtaaaatgatcatgcctttcccttccaaattt

SEQ ID NO: 12456 - protein, 149 aa, Panicum virgatum
  misc_feature: Ceres CLONE 1763249
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 12457 - DNA, 784 bp, Panicum virgatum
  misc_feature: Ceres CLONE 1763250
  misc_feature: Encodes the peptide sequence at SEQ ID NO. 12458
tttacccatcggcactcggcagcgtcgtcttcctcgtccgctgcgacgccgacggcgaaggacgccgggcccgcgccacgcgcgatgtacgggcttccttcggccgcgcggcccccgctgccgtctcactccgcctgctcggcttcttcctccgttcctcgggcgagggcagcgtcggcgtactgcttcgccagtctgaagcaggcgcgccattccgccgtcgctgcagccatggcagagcgcgcggccgcgccacttttggctgcggcactcctccttgcagcatttgcccaaccagtttcagaaggcgcggcgttgttccggaaggcttgcatcggatgccacgacatggggggaaacatcctacagccaggagccactcttttcctgaaggatctcgagaggaatggagtcgccacagaggaggaactgtatagcatcacatactacgggaaggggaggatgccgggctttggagagaaatgcaccccaagaggacagtgcaccttcggcccccggctatctgaggatgacatcaagctcctagcttcgtttgtcaagtcgcaagccgaaaacgggtggccaaagatcgaaggtgatggagattgaatgattgatgtttgtattgatcagatgactagggtgacgggaagacagtgttgatttgtctaggacttctgaacttgtagcctttacttgtcagattctctgaacttccgaacctgtgaccttcaggctcctctgttttctgaaacttctgaaatctagctcgagcgttagaacc

SEQ ID NO: 12458 - protein, 174 aa, Panicum virgatum
  misc_feature: Ceres CLONE 1763250
  misc_feature (72)..(162): Pfam Name: Cytochrom_C Pfam Description: Cytochrome c
MYGLPSAARPPLPSHSACSASSSVPRARAASAYCFASLKQARHSAVAAAMAERAAAPLLAAALLLAAFAQPVSEGAALFRKACIGCHDMGGNILQPGATLFLKDLERNGVATEEELYSITYYGKGRMPGFGEKCTPRGQCTFGPRLSEDDIKLLASFVKSQAENGWPKIEGDGD

SEQ ID NO: 12459 - DNA, 575 bp, Panicum virgatum
  misc_feature: Ceres CLONE 1763264
  misc_feature: Encodes the peptide sequence at SEQ ID NO. 12460
atatcggtcctgaaactggatatcaatggtttagatcgtacccacaaggcctaaaggaccttcttatgatcataaagaacaaatatggaaacccacccatctacatcactgagaacgggaccgcggattttgatgatggccatctatccaagaaagaagagttggatgatggtttaaggctagattacctccagcgccacattgcagccgtcaaagagtcaatagactatggtgcggacgtgcgcgggcacttcacctggtctctgctagacaacttcgagtgggctaagggctacacctgtcgtttcggcatcgtctacgtcgatcgctacaacggcttcaagcggaccatgaagaagtcagccaagtggttttgtgactttaacaacactccaaggaaggtcatcaatgacaagcatcgtgacctcatcatccttaatcaagctttggtcagcagtaactgagatgcgtgcagcgtggttggcccacaacagtacgttgaactgagaataactttggtgtgggttttgaacctagaataaaacagaagaaaataatttggtgtcccctacttt

SEQ ID NO: 12460 - protein, 153 aa, Panicum virgatum
  misc_feature: Ceres CLONE 1763264
  misc_feature (2)..(133): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
IGPETGYQWFRSYPQGLKDLLMIIKNKYGNPPIYITENGTADFDDGHLSKKEELDDGLRLDYLQRHIAAVKESIDYGADVRGHFTWSLLDNFEWAKGYTCRFGIVYVDRYNGFKRTMKKSAKWFCDFNNTPRKVINDKHRDLIILNQALVSSN

SEQ ID NO: 12461 - DNA, 878 bp, Panicum virgatum
  misc_feature: Ceres CLONE 1763266
  misc_feature: Encodes the peptide sequence at SEQ ID NO. 12462
acccagcgacactcaacgaccatcacaattattcaatcctcgcatttgcagcgcccacaaacccgcgaagaaagaaaggaagagaagctgctcccgatggagaacgccgacgcccctcccgccgccgtgaagccgtcgctgtccaagaagccctcgccgtcgttccgcctccggaacggcagcctcaacgcgctgcggctgcgccgcgtgttcgacctcttcgaccgcaacggggacggcgagatcaccctcgacgagatggcctcggcgctcgacgcgctcggcctcggcgccgcggggctccgcttcggcgacttcgagtccctccaccgcgcgctcggggacgcgctgttcggccccatcccggaggcggtgcccgaggaggacgaggagggggacatgaaggaggcgttccgcgtgttcgacgaggacggcgacggctacatctcggccgccgagctccaggccgtgctcaagaagctcggcctgcccgaggcgcggaacctcgccacggtgcaggagatgatatgcaacgtcgacagcgaccgcgacggccgcgtcgacttcggcgagttcaagaacatgatgcaggggatcaccgtgtggggcgcctagctgcagcgcccctgcgttgccagccctctactgcgtgttgacatgtatgtatctagctaggcagcgccttttcttctacccagcgcttcttcttcttcttgatcgcgcagtggattcttcttgctcttggctttgctctggttgggatcgtagtcttcagaaatttggggcaacagcgaaggcccacaggccacgggcattgtttcctgttcttgatttatttactagcattattacatgtaagaagaacgttgaccttgacc

SEQ ID NO: 12462 - protein, 172 aa, Panicum virgatum
  misc_feature: Ceres CLONE 1763266
  misc_feature (101)..(129): Pfam Name: efhand Pfam Description: EF hand
  misc_feature (34)..(62): Pfam Name: efhand Pfam Description: EF hand
  misc_feature (139)..(167): Pfam Name: efhand Pfam Description: EF hand
  misc_feature: SWISSPROT Homolog: EC 2.7.11.1 Non-specific serine/threonine protein kinase
MENADAPPAAVKPSLSKKPSPSFRLRNGSLNALRLRRVFDLFDRNGDGEITLDEMASALDALGLGAAGLRFGDFESLHRALGDALFGPIPEAVPEEDEEGDMKEAFRVFDEDGDGYISAAELQAVLKKLGLPEARNLATVQEMICNVDSDRDGRVDFGEFKNMMQGITVWGA

SEQ ID NO: 12463 - DNA, 784 bp, Panicum virgatum
  misc_feature: Ceres CLONE 1763338
  misc_feature: Encodes the peptide sequence at SEQ ID NO. 12464
ctaggctttgcgctcgtcgacgtagccaagcttttcgagtccacgaggagaggcggcaggtcaagcgagcaagaagctttggatcggaggtcagcagcggggcgcatggccatggaggcccagggctccaggcggcaccaggacgccggcgtgaaggtcaagttcatcgagacgcagttcatcagctccgacgccgccagcttcaaggccgtcgtgcagcgcctcaccggcaagtcccccgccgactcgtcgaggccggcccaggcggtactggcgccgcagccgcagaggccgcgcccgtgccggccggccttcgctggcgcggggcagcaccatcaggccgccgggtggccggagcagcaccaagctggagcctacctggtcgcgccggcgccgaagcaggcgctgctcgcggcggcgccgagcctggaggagatgcaagagctctgcgacttcgccgatctgttctacaccaccagcggcgccacgggcgcgcggcgcgacattgccggcatcgccttcccttactgaatttgtttttccgagcaccaatgcttgtagtttgcctttgcaaattcgcagtgtgttgagcacattaatggtcgtcgaggagctagatgggacgagagatggtcatggtctgctgccacccgctgtcctgtcgagcttatagtcatgtagtagctccacacgcacagtactggaattgacgaggggcctgaaagtatagtgaaatgctgcagactagaatttgtaacgtgcaaacgacagatcatgttgcaat

SEQ ID NO: 12464 - protein, 141 aa, Panicum virgatum
  misc_feature: Ceres CLONE 1763338
  misc_feature (19)..(49): Pfam Name: VQ Pfam Description: VQ motif
MAMEAQGSRRHQDAGVKVKFIETQFISSDAASFKAVVQRLTGKSPADSSRPAQAVLAPQPQRPRPCRPAFAGAGQHHQAAGWPEQHQAGAYLVAPAPKQALLAAAPSLEEMQELCDFADLFYTTSGATGARRDIAGIAFPY

SEQ ID NO: 12465 - DNA, 778 bp, Panicum virgatum
  misc_feature: Ceres CLONE 1763339
  misc_feature: Encodes the peptide sequence at SEQ ID NO. 12466
tccgaatcggcatttctgcaggccaagaagcggaaggctcggccgccgcgggatgctgccgtggagccgctccggcggtctggccgtgtcgccaacctcccggagaagcccaagtaccgcgaggaggttctggatttcgggaggaaggtcagaagctcaaggacgttcagatcatggaggaaggacctggtggaccgggtgtatgcgaccgacgaggagcggagccacgccatcacgaaggctgaggagctggtcgacgagctgggctcccgcttccccatcttcctgaaacccatgacccagtcccatgtcacgggaggcttctggctgggcctcccaaccccgttctgccgaaagtacttgccaaaacgtgatgagacaatcacgctgaaggacgaggaggatgacgagttcgacacgctctacctcaataggaagatgggactgagtgctggatggagaggattcgccattgaccacaagctggtcgatggagattgcttggtcttccagttgatcgagcgcaccaagttcaaggtctacataaaacgagcaagttcctaccacgaagatgaggagtgatgaaactagtagcttctaatatggtgattggagcacagcgctggcgacggttgcacacttgcactccacaaaaccagtgtgagcaggatggaacaagctcgcatgtgtagagtgctgggcgtcttcaaccttttgactggcgaaaaaaactgcagttgctattttgtggggtttgggattacgacctgcacggttc

SEQ ID NO: 12466 - protein, 193 aa, Panicum virgatum
  misc_feature: Ceres CLONE 1763339
  misc_feature (94)..(188): Pfam Name: B3 Pfam Description: B3 DNA binding domain
  misc_feature: Useful for making plants with altered terpenoid content
SESAFLQAKKRKARPPRDAAVEPLRRSGRVANLPEKPKYREEVLDFGRKVRSSRTFRSWRKDLVDRVYATDEERSHAITKAEELVDELGSRFPIFLKPMTQSHVTGGFWLGLPTPFCRKYLPKRDETITLKDEEDDEFDTLYLNRKMGLSAGWRGFAIDHKLVDGDCLVFQLIERTKFKVYIKRASSYHEDEE

SEQ ID NO: 12467 - DNA, 818 bp, Panicum virgatum
  misc_feature: Ceres CLONE 1763342
  misc_feature: Encodes the peptide sequence at SEQ ID NO. 12468
ggaggagaggagatgaactgatcagccaccatgcatgcatgcatgctccgcaggtagccgtccggcacgcggagcccctgacggagccacaggcgatgggcgtgtgcggcgtgcagcagtgggcgagggacgcggaggcggcgctggaccacgagctgcaggcgatgcaccgctccgtctcggagaccgtctcctccgacgccgcggcgctgctctgcccctactccgacgtgcccggctacatggccaccatgtccctcgccatcggcaagctcgcctccctcgaagccttcgtcagacaagcggacgcgctgaggctgcaggcgctgcaccgactgccgcagatcctgacggcgcggcagtcggcgcggtgcttcctcgccatcgccgactactccaaccgcctccgcgcgctcagcgagctctggcacacccggccgcgccacgaaccgccggcaaacacaccgccggccgggtccagccacggacaactccaccaaagtagggatggtttggtatagatacagcctcacggacagtgatggaatagtttcagagatacacatacatatagaggtgatcaggaattcagatgacccatttctcgactatttgacatcagttctaggagtatttatatatttatttatagctgtgtatacacaaaggataaataggagctgattcagcagtatgaaatactaggaaggaataaccattgaaactgccagattgccatgcaagctaattcagccagtattgacatgtcagacactttgataaatggtgagaaaataagttattgcagaactaccgcc

SEQ ID NO: 12468 - protein, 172 aa, Panicum virgatum
  misc_feature: Ceres CLONE 1763342
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
RRGDELISHHACMHAPQVAVRHAEPLTEPQAMGVCGVQQWARDAEAALDHELQAMHRSVSETVSSDAAALLCPYSDVPGYMATMSLAIGKLASLEAFVRQADALRLQALHRLPQILTARQSARCFLAIADYSNRLRALSELWHTRPRHEPPANTPPAGSSHGQLHQSRDGLV

SEQ ID NO: 12469 - DNA, 855 bp, Panicum virgatum
  misc_feature: Ceres CLONE 1763366
  misc_feature: Encodes the peptide sequence at SEQ ID NO. 12470
gtctcgcacgcacaccacaagcgagggacccggggcggggcaggaggaaaaaacaagagagagaaggcgtctctctctctctctctctccctcctccctcgccgtccccagcctctcgtcttcgctgcctgcgaaaggagttcgtcatggcatcgaagcgtatcctgaaggagctgaaggacctgcagaaagatccccccacatcatgcagtgcaggccctgctggtgaggacatgtttcattggcaagcaacaattatgggaccgcctgacagtccctatgctggtggtgtgttcttagtgaacattcatttccctccagactaccccttcaaaccaccaaaggtgtctttcaagacaaaggtcttccatccaaatatcaacagcaatgggagtatatgccttgacattcttaaagagcagtggagccctgctttgacaatttctaaggtcttgctctccatctgctccctgctgactgaccccaacccggatgaccctcttgtccccgagattgcccacatgtacaagacggaccggtcgaagtatgagtcgacagcccgcagctggacacagaagtacgcaatgggctgacaaagcacctctgcagctcaatcggcgacggctctcgtgccgtctcaagaaattgtccgtgggccattatttccttcggtttgttgctggttgtgtgtatccccgatccatctaggatcgtattgtagtcgatgtccacctaccacccttgccatccatagtgagatggtcggacatgctttggctatgcacctatgcttgctgggaaaccttccttcgggtcggtgctattcggtaaatgttaatcgaagacatttatttc

SEQ ID NO: 12470 - protein, 148 aa, Panicum virgatum
  misc_feature: Ceres CLONE 1763366
  misc_feature (5)..(142): Pfam Name: UQ_con Pfam Description: Ubiquitin-conjugating enzyme
  misc_feature: SWISSPROT Homolog: EC 6.3.2.19 Ubiquitin--protein ligase
  misc_feature: Useful for biocontainment applications
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRSKYESTARSWTQKYAMG

SEQ ID NO: 12471 - DNA, 759 bp, Panicum virgatum
  misc_feature: Ceres CLONE 1763375
  misc_feature: Encodes the peptide sequence at SEQ ID NO. 12472
cagaggaagaccgagtgaaaaccgaagcggcggcagcagcaatggcggcctccatgatctcgtcgtcagctctggcggcaccggccaaggcccagggcctgccgtccctcggccgccgcgcgtcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggaaccactggacttctgatctgggccgtcaccctcgccgggctccttggcggcggcgccctccttgtttacaacaccagcgccctcgccagctaagaacactattcatgcatagtccatgcaagcgcttgtggttcatgtaagatcagctcgggtgtctgtcgtctgtaatctagcctgcagctttgatgcgcaatataatgcttggttcatgtaacaatgctactacggccctccatacttttgggacagttattatattaactaggtaggatggcgcgctatgcgcgcctgtagcaaaaggtttgatctaaaattataataaaaatatattattatgtgctatagttaaagcaatatcgtgttgatgtattttaacaatatgttgatgtattgaatgaagtctgaaagttaaagt

SEQ ID NO: 12472 - protein, 131 aa, Panicum virgatum
  misc_feature: Ceres CLONE 1763375
  misc_feature (35)..(131): Pfam Name: PsbR Pfam Description: Photosystem II 10 kDa polypeptide PsbR
MAASMISSSALAAPAKAQGLPSLGRRASSFAVVCGTGKKIKTDKPFGIGGGLTVDHDASGRKVKGKGVYQFVDKYGANVDGYSPIYKEEDWSPTGDVYVGGTTGLLIWAVTLAGLLGGGALLVYNTSALAS

SEQ ID NO: 12473 - DNA, 894 bp, Panicum virgatum
  misc_feature: Ceres CLONE 1763378
  misc_feature: Encodes the peptide sequence at SEQ ID NO. 12474
gagcgaacgcggagaaaagaaaaaggattcctccaatccggaaaccgggaaggagcagaagaatccggaggggagctccaggattgtgggcgatgctgcgcgcgggaggcaggcggctcctcgccccggggctccggcggctcggcttcggcgccgccggcgaggcgggcccggccgcggcggcggcggcgggggcgagggcgtaccacgagcgggtggtggaccactacaacaaccctaggaacgtgggatcgttcgacaaggatgatcccaacgtcggcaccgggctggtcggcgcgccggcctgcggcgacgtcatgaagatgcagatccgcgtcgacgaggactccggcaagatcgtcgacgcctgcttcaagacgttcggctgcggctccgccatagcgtcctcgtccgtggctactgaatgggtgaagggaaaaccaatggatgaagttttgactatcaagaacactgagattgcaaagcacttgtcgcttccaccagtaaagctacattgcagcatgcttgcggaggatgcgattaaagctgctgttaaagactacgaagccaagaaggcgaagatggggcaaaagggcgaagacagcccttcagagaaggctgctgaagcatgatcgtgaagtttctgccatgaaggttttccagtcatgcatctgcaaagataaatgcttctggccttaaggtgggggattgtgtgtaatgttcacaaactctggtactgcagcatgtatcataactcaaggatggagacgaacaatttcaaataaatctgctgccatcttagaaaagagtatgttcatgtacaagtgctgcgtctcgaagtgttgtttggctgtacgttacttatgtgcaattagtaagtttttttttgggtgc

SEQ ID NO: 12474 - protein, 179 aa, Panicum virgatum
  misc_feature: Ceres CLONE 1763378
  misc_feature (37)..(164): Pfam Name: NifU_N Pfam Description: NifU-like N terminal domain
MLRAGGRRLLAPGLRRLGFGAAGEAGPAAAAAAGARAYHERVVDHYNNPRNVGSFDKDDPNVGTGLVGAPACGDVMKMQIRVDEDSGKIVDACFKTFGCGSAIASSSVATEWVKGKPMDEVLTIKNTEIAKHLSLPPVKLHCSMLAEDAIKAAVKDYEAKKAKMGQKGEDSPSEKAAEA

SEQ ID NO: 12475 - DNA, 1025 bp, Panicum virgatum
  misc_feature: Ceres CLONE 1763402
  misc_feature: Encodes the peptide sequence at SEQ ID NO. 12476
tacagaaagtccacagagaccggccgggagcagcagcagcgagatggcggcggcggagtcctcgggcacggcgatagggtcctcgggaagatgggccctccacggcaagacggccctcgtcaccggcggcacgcgcggcatcgggcgtgcggtagtggaggagttggcggcgctgggggcggccgtgcacacgtgctcccggaaggaggaggagctcggcgagcgcatcaaggagtgggaggccaggggcttccgcgtcactggctccgtctgcgacctctccgcgcgtgaccagcgggagcgtctgctccgcgaggtcgccgatcgtttcggcggcaagctcgacatcctcgtaaacaatgtgggaacaaacataaggaaaccaactactgaattttctgcagaggaatactcctttttgatggctactaatcttgaatctgcataccacttgtgccaaattgcacatcctcttttgaaattatctgggtcaggcagcattatcttcatttcatctgtcgctggagtggtgggcatcttcagcggaactatatatgctatgactaaaggtgctattaatcagttaacgaagaacttagcatgtgagtaggcaaaggacaacataagagccaactctgttgccccctggtacattgcgacttcacttacggaaggacttttggcaaataagaattttgaggagcaagttgtgagtcgaactccgcttggacgtgtcggagaacctggggaaatatcagcactcgttgcttttctttgcatgccgggttccacttacattactggccagacgatctcagttgatggaggtatgactgtgaatgggttttatccaaccaaacccttctaggtgtaggttaccatggtggttttcttttaagttgaaacaaacctaataatatgtatgtattatgtaaaggtgatcatatcatgtatcgatccatgattattgttcaatgcataattatatcagaaccatgtgaaaaatgctgtgtcagatttgatcg

SEQ ID NO: 12476 - protein, 188 aa, Panicum virgatum
  misc_feature: Ceres CLONE 1763402
  misc_feature (22)..(188): Pfam Name: adh_short Pfam Description: short chain dehydrogenase
  misc_feature: SWISSPROT Homolog: EC 1.1.1.206 Tropine dehydrogenase
MAAAESSGTAIGSSGRWALHGKTALVTGGTRGIGRAVVEELAALGAAVHTCSRKEEELGERIKEWEARGFRVTGSVCDLSARDQRERLLREVADRFGGKLDILVNNVGTNIRKPTTEFSAEEYSFLMATNLESAYHLCQIAHPLLKLSGSGSIIFISSVAGVVGIFSGTIYAMTKGAINQLTKNLACE

SEQ ID NO: 12477 - DNA, 813 bp, Panicum virgatum
  misc_feature: Ceres CLONE 1763420
  misc_feature: Encodes the peptide sequence at SEQ ID NO. 12478
agaatctctagcaataatggccaccgccctcagcaacctccgcgcgccggccagcagcttctccggcgtccgcgctgccccggcacccgcggcgcccgccatcgtcgccatgcccgccgccaagcagcaggttgcccgcggcgccaggctgcgcgcccaggcgacctacaacgtgaagctcgtcacgcccgacggccaggtggagctgcaggtgcccgacgacgtgtacatcctggaccaggccgaggaggaggggatcgaccttccctcctcatgccgcgccgggtcctgctcctcctgcgccggcaaggacgtctccagctccgtcgaccagtccgaccagagcttcctcgacgacgaccaggtcgccagcggctgggtgctcacctgccacgcctaccccacctccgacgtagtcatcgagacccagaaggaggaggagctcaccgcttaatatacaattaattaagctcgctccatcgtgcgtcgatatatatcatcatcatctatagcaagtatatctcaatctgcctgccttgcaagagatgtagtaatcgatcgagttgacgaagccggccgccggagaaatttcttcctagctttaatttgtatcatccatcgtgcatgtcgatcaagcaagctaagcatcggcagcagggccatctgttaccgacgcagtacctgcatgcttggtctctgtatcattcaccatttttactgcatgcggatgcatcatctacttctcatcaaagttattaattaaaaatgtttttcctctttatgtttctactgtcatcaatacatatatattac

SEQ ID NO: 12478 - protein, 145 aa, Panicum virgatum
  misc_feature: Ceres CLONE 1763420
  misc_feature (56)..(131): Pfam Name: Fer2 Pfam Description: 2Fe-2S iron-sulfur cluster binding domain
MATALSNLRAPASSFSGVRAAPAPAAPAIVAMPAAKQQVARGARLRAQATYNVKLVTPDGQVELQVPDDVYILDQAEEEGIDLPSSCRAGSCSSCAGKDVSSSVDQSDQSFLDDDQVASGWVLTCHAYPTSDVVIETQKEEELTA

SEQ ID NO: 12479 - DNA, 841 bp, Panicum virgatum
  misc_feature: Ceres CLONE 1763422
  misc_feature: Encodes the peptide sequence at SEQ ID NO. 12480
cttgtgagatccatctaggtttcttgtgcctgctagctaccatggcggtagctcaccttcttctccaacactccgttgccaatgctgctaggaacagggtggttcctcctgccattctcctgattcttcagcttctttgcggagcgctgggcgctgacggcgcgacgtcgttccgcttcaccaacgcctgccataacccggtgtgggtgggcgcgctccacggcgcgagctcgccgccgctcgcgcgctccggcttctacctggcgccgtcggccacgtcccacctcgacgcgccgtcgtccgggagctggtcgggcacgttctgggcgcgcacgggctgcgccgtggactccgccacgggccgcttctcctgcgccacggcggactgcggcacgggcgacgttgcctgcgagggccgcgggccggcgccgcccgtctcgctcgtggaggtcaccctcgccgcgccgggcagcggcgggcaggacttctacgacgtgagcctcgtcgacgggttcaacgtgccggtgcgcgtggcgccctcaggcggcggcggggactgccggccggcggcgtgcgcaggggacgtgaacgccatgtgccccgcggacctccgcgtcgtggccgcgtccggcggtggcgtcgtagcgtgcaagagcgcctgcaacgcctacggcagcgcgcgctactgctgcacagggcagtacggcacgccggcggcgtgcgggcccaccagctactcgcaggtcttcaagagcgcctgcccggcggcgtacagctacgcctacgacgacgccagcagcaccttcacgtgctccggcgcctccagctatgacgtcacctt

SEQ ID NO: 12480 - protein, 266 aa, Panicum virgatum
  misc_feature: Ceres CLONE 1763422
  misc_feature (48)..(266): Pfam Name: Thaumatin Pfam Description: Thaumatin family
MAVAHLLLQHSVANAARNRVVPPAILLILQLLCGALGADGATSFRFTNACHNPVWVGALHGASSPPLARSGFYLAPSATSHLDAPSSGSWSGTFWARTGCAVDSATGRFSCATADCGTGDVACEGRGPAPPVSLVEVTLAAPGSGGQDFYDVSLVDGFNVPVRVAPSGGGGDCRPAACAGDVNAMCPADLRVVAASGGGVVACKSACNAYGSARYCCTGQYGTPAACGPTSYSQVFKSACPAAYSYAYDDASSTFTCSGASSYDVT

SEQ ID NO: 12481 - DNA, 832 bp, Panicum virgatum
  misc_feature: Ceres CLONE 1763430
  misc_feature: Encodes the peptide sequence at SEQ ID NO. 12482
acctccacacctcctccggcggcgtccagctcgacgaccaaccgcgcctccctgccgcggcactgcggcagccatggtgcacgtcagcttctaccgcaactatgggaagactttcaagaagccaaggcgtccttatgagaaggaacgtcttgatgctgagctgaagctggttggtgagtatggcctgaggtgcaagcgtgagctgtggcgtgtgcagtatgccctgagccgtatcagaaatgcagccagggagctgctcaccctgaatgagaagaaccctcgccgtatctttgagggtgaggcactcctccgccgcatgaaccgctatggtctccttggtgagggtcagaacaagctggattacgtgcttgccctcactgttgagaacttcctccagcgccgcctccagaccatcgtcttcaagaatggcatggccaagtccatccaccatgctcgcgtcctgatcaggcagcgccacatcagggtgggaaggcagcttgtcaacatcccgtcattcatggtcagggttgaatctgagaagcacatcgacttctccctcaccagccctctgggtggcggccctgctggaagagtgaagagaaagaaccagaagaaggcctcaggtggtcgtggcgatggggaggatgatgaagagtaagggcctgtaggattttgcaacagcaattggttgaaatgcgaaatgaaccttgttggaattaggtgttgttcctgagtttttgtggtaattgaattcagaatcgggggatggtagacaattttgtggtccactgacactcatgtttaatttaagccttggcatgtttcggacctc

SEQ ID NO: 12482 - protein, 194 aa, Panicum virgatum
  misc_feature: Ceres CLONE 1763430
  misc_feature (7)..(108): Pfam Name: Ribosomal_S4 Pfam Description: Ribosomal protein S4/S9 N-terminal domain
  misc_feature (109)..(156): Pfam Name: S4 Pfam Description: S4 domain
MVHVSFYRNYGKTFKKPRRPYEKERLDAELKLVGEYGLRCKRELWRVQYALSRIRNAARELLTLNEKNPRRIFEGEALLRRMNRYGLLGEGQNKLDYVLALTVENFLQRRLQTIVFKNGMAKSIHHARVLIRQRHIRVGRQLVNIPSFMVRVESEKHIDFSLTSPLGGGPAGRVKRKNQKKASGGRGDGEDDEE

SEQ ID NO: 12483 - DNA, 808 bp, Panicum virgatum
  misc_feature: Ceres CLONE 1763434
  misc_feature: Encodes the peptide sequence at SEQ ID NO. 12484
ataaccaaagacgccgttgtgcgggagacgaagagggaaagtgaagagcagcgtcggactagtgagccatgctcgcctcgccggcgctcgccggcgcgcactccttcgcggcgtccgtgtccggcagcctccgcgtccccctaccttccgtccccgcgccctcgcccacgccggcgcggcgcgcagcgctgtccgtcgtcgccaaggtcaaggtgcctacgccccaggacgaccgcatcgcccgccatgtccgcctccggaagaaggtgagtggcaccacggagagacccagactgagtgttttccgctcaaacaagcatttgtacgctcaagtcattgatgatacaaagcaatgcactttggcttcggcttcaaccatgcacaaatctctctccaaggaattggaatactccgctggaccaacaatcgaagtagcacaaaagattggtgaagtgattgccaagtcttgcctggagaaaggaattaccaaagttgtcttcgaccgaggtggtttcctctaccacggccgcataaaagctcttgctgatgctgctagagagcacgggcttgagttctgaatctttaccccgaatgtttgttcatatttcaatgatcacctgtaatcttttcttttcaccccctcgatgttgaacagagtttgtagtcacctgccttgttttgcagagtgcagattgggccaaactttgatggcatcagatttttgccccagtcttgcattcaaaagcttctcaacatgatattatgaatctcccaccattcatgctctctggtccacaccatattcatt

SEQ ID NO: 12484 - protein, 169 aa, Panicum virgatum
  misc_feature: Ceres CLONE 1763434
  misc_feature (51)..(169): Pfam Name: Ribosomal_L18p Pfam Description: Ribosomal L18p/L5e family
MLASPALAGAHSFAASVSGSLRVPLPSVPAPSPTPARRAALSVVAKVKVPTPQDDRIARHVRLRKKVSGTTERPRLSVFRSNKHLYAQVIDDTKQCTLASASTMHKSLSKELEYSAGPTIEVAQKIGEVIAKSCLEKGITKVVFDRGGFLYHGRIKALADAAREHGLEF

SEQ ID NO: 12485 - DNA, 658 bp, Panicum virgatum
  misc_feature: Ceres CLONE 1763464
  misc_feature: Encodes the peptide sequence at SEQ ID NO. 12486
tcactgccatggatggaaaggatctccatggaaggaacatacgggttaaccatgctactgagaggactgggggcttccggaccggtggcggcggtggttttggtggtgggggctatggcggtggcggcggcggttttggtggtgggggctatggcggcggtggcggcggttacggtggcagtggagggtacggtgggggcaactatggcaacaggggtggcggtggcggctatggtggtggtggagttgcaggtggagctgggggcaattttgctgctggaggcggcgacagctttggcaccaacttcggtggtgacagtgggtttgctgctggtggatttggcgctgccagtggcactggtggtgatgagttcactgctggtggcagcttcagcagcaacaagaatgacgaaatcatggaggatatgttcaaggatgacgagtcgcacaactacgccgacaaaagggcctagtttttgtcctccaagctaccctagcataccagtaaaaatgaggtgaatgatcatctggatgagattccaggacaatctgtagtgcctggtgtttttctgttagctttataggtctcttctgtctaaataatggaacgaggcactttgtgttgaacagaccatcgaagtgtgctttattttgactt

SEQ ID NO: 12486 - protein, 156 aa, Panicum virgatum
  misc_feature: Ceres CLONE 1763464
  misc_feature: Useful for making plants with altered alkaloid content
  misc_feature: Useful for making plants with modulated nitrogen use efficiency
  misc_feature: Useful for making plants with modulated flowering time
  misc_feature: Useful for making plants with altered lignin content
  misc_feature: Useful for making plants with altered terpenoid content
  misc_feature: Useful for making plants with modulated phosphate use efficiency
TAMDGKDLHGRNIRVNHATERTGGFRTGGGGGFGGGGYGGGGGGFGGGGYGGGGGGYGGSGGYGGGNYGNRGGGGGYGGGGVAGGAGGNFAAGGGDSFGTNFGGDSGFAAGGFGAASGTGGDEFTAGGSFSSNKNDEIMEDMFKDDESHNYADKRA

SEQ ID NO: 12487 - DNA, 1075 bp, Panicum virgatum
  misc_feature: Ceres CLONE 1763468
  misc_feature: Encodes the peptide sequence at SEQ ID NO. 12488
aacaaccctagcagcctcttcttcctccccctctccctcattgatcatcggttcaattgacaagatcgaagtcgcccaattgcctcttcgatccatacatgtcggagccaacatgcagcgtgtgtggcgcagccgcctgcggctcgaacctgttgcacgctagcgcagatgatagccggcgggcctccttctccatcttccccgtggttcatgatcatcatgagcccggggtacagcagccaccgtccgggagcctgcatgagttccagttctttggccaggacgaccacgaaagcgtcgcatggctcttcgacgacccaccgccttccatcagcgataaccagcccccagttgaggaccaacctcacaataagaggtcatccatgtttgacgacccgtttgggcagcagtaccaccccgggaacgggctaaccttcgaggtttcgcttggcctcggcggcggagctcgccacaaggagatagcggcaagcgccaccatcatgtcattctgtgggagcacatttacggacgctgcaagctcgaggctcaatgagccaatcctgatcgacggtcagctgcaaaggccaatagatccatcaatggagagggaggcaaagttgatgaggtacaaggagaagaagatgaggaggtgctatgagaagcaaatccgatatgcatccaggaaagcctacgcggagatgagaccccgcgtgaaaggccgatttgccaaggtacccgaagcttctgcaccatgataaccaacattggcaacgacctgttatatggttccagtcagcttgatctttgggcgctggttccattgatagatagccatattcagagtgctggatgatggagcagaccatctagtagctagtaactatcatgttgtcagctggattgccgatcgacgaccttattaacagcttttgtattatatatactggtttgtatattggtatttatatagtattagattgtgttcatcaaatttagtaactttttatctagtgatccggtggccagcatgcattgcaagcttaactgtactatatatgtggtgcaagccagtttg

SEQ ID NO: 12488 - protein, 218 aa, Panicum virgatum
  misc_feature: Ceres CLONE 1763468
  misc_feature (170)..(214): Pfam Name: CCT Pfam Description: CCT motif
MSEPTCSVCGAAACGSNLLHASADDSRRASFSIFPVVHDHHEPGVQQPPSGSLHEFQFFGQDDHESVAWLFDDPPPSISDNQPPVEDQPHNKRSSMFDDPFGQQYHPGNGLTFEVSLGLGGGARHKEIAASATIMSFCGSTFTDAASSRLNEPILIDGQLQRPIDPSMEREAKLMRYKEKKMRRCYEKQIRYASRKAYAEMRPRVKGRFAKVPEASAP

SEQ ID NO: 12489 - DNA, 818 bp, Panicum virgatum
  misc_feature: Ceres CLONE 1763480
  misc_feature: Encodes the peptide sequence at SEQ ID NO. 12490
atcctccacttcacacctgctcgctatcacacagccaattgctctcgacaccaaccacttcttcttcttcaccatgtcgaacggcaccgagaagcaagcccaggcggctgcggcggcccagcagcagcagcagcagcagaggcccccggcggtgtccgcggagatgcagaaggtgttctcccgcttcgacgcggacggcgacggccggatttccccctcggagctggccgcggtctcgcgcgccatctccccgccgccgagctcctcgcacggcggccgcgaggtggccgccatgatggacgagctcgacgccgaccgcgacggctacgtggacctcggcgagttcgcggcgttccacgcgcgcgccgccggccgcggggacggcgagctcgaggccgagctccgcgccgccttcgacgtctacgacgtcgacggcgacggccgcatcacggccgccgagctcggcaaggtgctcgcgcagatcggggagggctgcagcgccgaggagtgcgagcggatgatcgccagcgtcgacggcgacggcgacgggtgcgtcgggttcgaggagttcaagaagatgatggcgccccaaccccaaggcagcgccgccgacgccgccgcgcccggcggcagcctccctgacaaggccaagaaggagtgagcagttacatatgtagccaggggaaagtgctggagtgcctctagaattattttcacctagagtaaacgctcccccgtaatgttattaggaataaaaatcctccatgatttatatgtgttataactcccattatatattgtggtgtacatttatctgc

SEQ ID NO: 12490 - protein, 195 aa, Panicum virgatum
  misc_feature: Ceres CLONE 1763480
  misc_feature (109)..(137): Pfam Name: efhand Pfam Description: EF hand
  misc_feature (30)..(58): Pfam Name: efhand Pfam Description: EF hand
  misc_feature (145)..(173): Pfam Name: efhand Pfam Description: EF hand
  misc_feature: SWISSPROT Homolog: EC 2.7.11.1 Non-specific serine/threonine protein kinase
MSNGTEKQAQAAAAAQQQQQQQRPPAVSAEMQKVFSRFDADGDGRISPSELAAVSRAISPPPSSSHGGREVAAMMDELDADRDGYVDLGEFAAFHARAAGRGDGELEAELRAAFDVYDVDGDGRITAAELGKVLAQIGEGCSAEECERMIASVDGDGDGCVGFEEFKKMMAPQPQGSAADAAAPGGSLPDKAKKE

SEQ ID NO: 12491 - DNA, 663 bp, Panicum virgatum
  misc_feature: Ceres CLONE 1763484
  misc_feature: Encodes the peptide sequence at SEQ ID NO. 12492
attgcatcgcatctcctctcgctctctgttgtgtgactgattgccaagaaagctctctgcttgcttgtgttccagcctctgaatctcgtgaggatgtcgtgctgcggaggcaactgcgggtgcggctccgactgcaagtgcggctccggctgcggagggtgcaagatgtacccggacatgactgagcagggcaccaccaccaccagccagactgtcatcatgggcgttgcaccaaccaacaaggggcacgccgagggcggatttgaggccggcgccggagccgagaacggctgcaagtgaggagctcatggccatggccggaccggaggagatctgaagctagtatagcggcgttgtgtgtgcgtcgttcgtttgtctgaaagtgtgtgtggcatgcttaataacggtgttgcgcgtgctgctagtagatggtactgatggggaacaataataatgatggtgctgagatgtcgtcggcgtcgccgccgccgtcgtgtccttcctccccggccggtcgggcacctgtggcggtgctctagcagtgtgttgtgtgtgcagcagaccatgctctgatctttgtggtgtatgtgtgtggcctgctgcttggtgtccctagtgtcatgtgtaaccatccatctatatctatctacatccatcttgtgt

SEQ ID NO: 12492 - protein, 68 aa, Panicum virgatum
  misc_feature: Ceres CLONE 1763484
  misc_feature (1)..(68): Pfam Name: Metallothio_2 Pfam Description: Metallothionein
MSCCGGNCGCGSDCKCGSGCGGCKMYPDMTEQGTTTTSQTVIMGVAPTNKGHAEGGFEAGAGAENGCK

SEQ ID NO: 12493 - DNA, 590 bp, Panicum virgatum
  misc_feature: Ceres CLONE 1763495
  misc_feature: Encodes the peptide sequence at SEQ ID NO. 12494
attccccttccccacccggccactccccccttctgcaagcaaaagcagagctagggttttaggaggcagagaggggcgctatggataaccccgagatgcagcgattcctccagcaagagcagcagaaggcgctgatgggtgagatggttggcaagctgacaagcgtgtgctgggacaaatgcatcaccggcaccccaggaagcaagttcagctccggggaatcaacctgcttaatcaactgtgcccagaggtttctcgacatgagcgcgctgattgccaaacggtttgagatgcagtgaggtgtaggcgcccaaacaccatttcttagtcagatgccttgagcttcttctctgagcttcgtacaaaccccttttgaacgatgctggttttttttaattgttagtaacagagaaagtctgatgtgcttccaatatctgttgcctcgatgggaaatgtactagtgtgatttttccgtttgatactgaacactccctgccctgagtttaactcaacattgtgctcctgcgtccctagttctgagcgactgtttatatgcttacatataaatccactcttcttgctgtagcgtc

SEQ ID NO: 12494 - protein, 72 aa, Panicum virgatum
  misc_feature: Ceres CLONE 1763495
  misc_feature (7)..(72): Pfam Name: zf-Tim10_DDP Pfam Description: Tim10/DDP family zinc finger
MDNPEMQRFLQQEQQKALMGEMVGKLTSVCWDKCITGTPGSKFSSGESTCLINCAQRFLDMSALIAKRFEMQ

SEQ ID NO: 12495 - DNA, 755 bp, Panicum virgatum
  misc_feature: Ceres CLONE 1763523
  misc_feature: Encodes the peptide sequence at SEQ ID NO. 12496
aagcgagtgagcaatggcaaccatcagcgccgccgcatccgccgccctcttccccggcgccggcgtcgccaggccgtctcagggtcacggggtgcctcagctgagagcaagggccggcaagatgcggtgcggcgcctgctccaagcagcaggacggcaacggcaaggcgccggcggcggctccggccggcgcgtccctgctggcctcggcgagcgcgatgactgcgtcgcccgcgctggcgctggtggacgagcggatgtcgacggagggcaccgggctcagcctggggctgagcaacaacctgctggggtggatcctgctgggcgtcttcggcctcatctggtccctctacaccgtctacacctccacgctcgacgaggacgaggactccggcggcctctccctgtgaaatccttttgatttccagcagtttacttcagccctgacctgtgcaagttcgacgctctgtgggtgcaactggaagtctgcaactgaagacatatggttgtatgcgactgtgattgggttgttgcatcggagatggtaatgacgagtacttagtagttggctttatggtggtttgagattgcacctatgaggctctgatgcatgaaagatgctgggcacacactgtactgtatgaaatttgatagcagtccgatttgattgctgagtgtcatagtgtggcatgagaaaagaaatattctagagtcgtgttgcaactaaactcagtttcatgcgactatgtgagtgtc

SEQ ID NO: 12496 - protein, 131 aa, Panicum virgatum
  misc_feature: Ceres CLONE 1763523
  misc_feature (1)..(131): Pfam Name: PsbW Pfam Description: Photosystem II reaction centre W protein, PsbW
MATISAAASAALFPGAGVARPSQGHGVPQLRARAGKMRCGACSKQQDGNGKAPAAAPAGASLLASASAMTASPALALVDERMSTEGTGLSLGLSNNLLGWILLGVFGLIWSLYTVYTSTLDEDEDSGGLSL

SEQ ID NO: 12497 - DNA, 750 bp, Panicum virgatum
  misc_feature: Ceres CLONE 1763529
  misc_feature: Encodes the peptide sequence at SEQ ID NO. 12498
acccacatctccaccgcgcgccatggccggcggcaccagcaagctcctcttcgtgtgcgccggcgccgtcgccctgctggcggcgctggccccgccgcccgcctccgcggcggacgacggcgggttcacgacgttcaaggtctacttccacgacatcgtgggcgggacgagcccgacggcgatccgcatcgcgcaggcggcgtcgtccaactcctcctccaccttcttcggcgcggtggtggccatcgacgacccgctgaccacggggccgacccgcgccgcggggacggaggtcgggcgcgcccagggcacgtacacgttcgcggaccagagcacggtcgggctcctgatggtgatgaacttcgtgttcaccgccggcgagcacaagggcagcggcctgtcgatcctgggccggaacgaggtgctgtcggacgtccgcgagatgagcatcgtcggcggcagcggcaagttccggatggcgcgcgggttcgtgcaggcgcacaccatcgactccggcgccacctccggcgagaccgtcgtggagtacaccgtcaacgtcaaggcgtagccgccgtccgtcgtcgtcgtctttgtaccttcttgttcttcagtgttgctgtaccgtgagcgtgagagagttcattcagttcagatggattcttgccagagcagtagttagttgaacagggattcgagtttggagagagatgtgtacgaagttgttggggaatttgcagagtcgatcgggtc

SEQ ID NO: 12498 - protein, 181 aa, Panicum virgatum
  misc_feature: Ceres CLONE 1763529
  misc_feature (8)..(181): Pfam Name: Dirigent Pfam Description: Dirigent-like protein
MAGGTSKLLFVCAGAVALLAALAPPPASAADDGGFTTFKVYFHDIVGGTSPTAIRIAQAASSNSSSTFFGAVVAIDDPLTTGPTRAAGTEVGRAQGTYTFADQSTVGLLMVMNFVFTAGEHKGSGLSILGRNEVLSDVREMSIVGGSGKFRMARGFVQAHTIDSGATSGETVVEYTVNVKA

SEQ ID NO: 12499 - DNA, 696 bp, Panicum virgatum
  misc_feature: Ceres CLONE 1763561
  misc_feature: Encodes the peptide sequence at SEQ ID NO. 12500
aacaagatagataagccttttgcagatcatactgaaccaagcagccacttcacactagagcacggtggtcgctcgtgtcccggccacaaggaggagcgtccgcgccgccgtggccgccgccatcgtcgcggcggagcctgccgaggtcgactacagctcgagcttctcggtgttccccatggaggcctgcgagctgctcggcggcgacgcctgcagcgcgcagatgtacccggaggctaagctcgccggcgcggcggaggcggccgcgggcaggagggaggaggaggtggagagggactacctgtcctacgacgagccgaagacggtgttccccggcgaggcgtgcgacaacctcggcggcgagttctgcgaggcgccgtaccaggccggcgtgtccagggagctggcgcacgcctgatccatcgtccatctatccgcaacatgaattgatctcgccgtcgagtcgatgggtgatgggtccatatgctgctatgcacgtacgtgttgcagatgatactcgagtggtggaggggaatctagcctacgtgtgctagaataacagcagccaagcaaggccaaggacgatgtcacgtgtgtaattgtgcatgacttgggtcgtgccagctgtgcctgtctgtagaaactaaagatgaaatactacgatccgtatcgctttacagtgtgatacgattaccg

SEQ ID NO: 12500 - protein, 79 aa, Panicum virgatum
  misc_feature: Ceres CLONE 1763561
  misc_feature (1)..(67): Pfam Name: Lir1 Pfam Description: Light regulated protein Lir1
MEACELLGGDACSAQMYPEAKLAGAAEAAAGRREEEVERDYLSYDEPKTVFPGEACDNLGGEFCEAPYQAGVSRELAHA

SEQ ID NO: 12501 - DNA, 436 bp, Panicum virgatum
  misc_feature: Ceres CLONE 1763600
  misc_feature: Encodes the peptide sequence at SEQ ID NO. 12502
ctagtccaacaaacattaatacagtgtcgtccgaaactgctgcttgatgtggtggttctaccgcaaggggccctcgggcttctccagcgcctccacggccgaggaggtcaccgccggcgtcgacggccgcggcctggtcgccgtcatcacaggtgcgtcgagtggaatcgggctggagacggcgcgcgtcctggcgctgcgaggtgtgcacgtcgtcatgcccgtcggcaatgtcgccgccgggctcgcagtcaaggagtccatcgtggccaagatccccgtcgcaagaattgatgtgctggagctggacctcagctccatggcatcggtaaggagattcgcctccgagttcgaatctctgaacctgcccctgaacattctcatgtaagaacgaacaaatccttctacttcatgctagtactttaccaggtaccgc

SEQ ID NO: 12502 - protein, 113 aa, Panicum virgatum
  misc_feature: Ceres CLONE 1763600
  misc_feature: SWISSPROT Homolog: EC 1.3.1.33 Protochlorophyllide reductase
MWWFYRKGPSGFSSASTAEEVTAGVDGRGLVAVITGASSGIGLETARVLALRGVHVVMPVGNVAAGLAVKESIVAKIPVARIDVLELDLSSMASVRRFASEFESLNLPLNILM

SEQ ID NO: 12503 - DNA, 668 bp, Panicum virgatum
  misc_feature: Ceres CLONE 1763603
  misc_feature: Encodes the peptide sequence at SEQ ID NO. 12504
ctgaagtaccgcacgttcagttcagggaacagagcagcagcacaggcgtcgccatggcctcccagctctccgccgccgcgtccatgtccgccgccgtgccgcagttccacggcctccggggccggtccgtggcggcgctgccgccggcgagagccggcaggaagcgggcgcagggcatccggtgcgactacatcggctcggccaccaaccaggtaccaacgaccaatcaatcctgagctagccttcgcttttaatccgccggtgcgcagcaatacgttattaagtttggttggcaatggtggtggcagatcatggtggtgtcgacgacgctgatgctggtggcggggcggttcgggctggcgccgtcggcgaaccggaaggcgacggcggggctgaagctcgagtcccgcgactccggcctgcagaccggcgaccccgccgggttcacgctcgccgacacgctggcctgcggcgccgtcggccacatcatcggcgtcggcatcgtgctcgggctcaagaacaccggcgcgctcgaccagatcatcggctaggtccagtgtctgcctttgccgctctcggcgccggcccggtgcccatgtaacctgcgtgtgtacatcgactctgcgctcatgcatctcgttccaatggacatagcttgtttgttgctc

SEQ ID NO: 12504 - protein, 79 aa, Panicum virgatum
  misc_feature: Ceres CLONE 1763603
  misc_feature (1)..(74): Pfam Name: PSI_PSAK Pfam Description: Photosystem I psaG / psaK
MVVSTTLMLVAGRFGLAPSANRKATAGLKLESRDSGLQTGDPAGFTLADTLACGAVGHIIGVGIVLGLKNTGALDQIIG

SEQ ID NO: 12505 - DNA, 633 bp, Panicum virgatum
  misc_feature: Ceres CLONE 1763618
  misc_feature: Encodes the peptide sequence at SEQ ID NO. 12506
gtcttccctgtccgcgctgcgctaccgccgtttacccccgaccaccgtcccctccgccccccaccccggcgccccgcagctagctcgtcagcctctcgccatggagacctgcccgtcggtgaagaacatccttttgctggactccgagggaaagcgcgtcgccgtgaagtactacagcgatgactggcccacgctctccgcgaagctggcattcgagaagtcggtcttcgcgaaaacccagaaggcgaatgctggaacggaagctgagattgtaatgtttgacggtcaaattgtggtatataagttcatccaagacctgcacttttttgttactggaggagaagaggagaatgagcttattttagcatcagttcttcagggtttctctgatgctgttgaccgacttctcaaaaacatggtcgacaaaagaacagcacttgagaatttggacctgatcctattatgtcttgatgaaattgttgatggagggattgttcttgaaacagaagggaggttgtatatgtgtgcctgtaccgatgctaaaactagtttactcttggttcgctaaggattagttttttctgtatttgttgccatgtctctataaaagatccatcgttccgatgacttgtt

SEQ ID NO: 12506 - protein, 155 aa, Panicum virgatum
  misc_feature: Ceres CLONE 1763618
  misc_feature (6)..(147): Pfam Name: Clat_adaptor_s Pfam Description: Clathrin adaptor complex small chain
METCPSVKNILLLDSEGKRVAVKYYSDDWPTLSAKLAFEKSVFAKTQKANAGTEAEIVMFDGQIVVYKFIQDLHFFVTGGEEENELILASVLQGFSDAVDRLLKNMVDKRTALENLDLILLCLDEIVDGGIVLETEGRLYMCACTDAKTSLLLVR

SEQ ID NO: 12507 - DNA, 826 bp, Panicum virgatum
  misc_feature: Ceres CLONE 1763622
  misc_feature: Encodes the peptide sequence at SEQ ID NO. 12508
cctctgctagctctctcacgcacaagcacacacgcacctgcaggctgcagcttcaggtcgatcgacgcgcgccgacctatcgtgtcagcagcgagccatcatggccttggcacgcggcggcagggggttgccatcccgggcggcggcggcggcggcggcggtgctggtggtggcggcgctggcgggcgtggcgagcggggacttcgcggcggacagggcggagtgcgcgaaccagttgatgggcctggcgacgtgcctgacgttcgtgcaggagaaggcgacggcgcgggcgccgacgcccgactgctgcgcggggctcaagcaggtggtggccgccagcaagaagtgcatgtgcgtgctggtcaaggaccgcgacgagccggcgctgggcttcaagatcaacgtcacccgcgccatggacctgccccccctctgcaactaccccgcgaccttctccgactgccccaagattctggggatgtcgccggacgcccccgaggcggagatcttcaaggagtacgcgaggaagcacgagtcccacaacggcaccgccaccaaacccgccgctgcaaccggtgccgcgggcgggaagagcgccacgagctcgtcgccggcgggaggggccggcgccgggagcaagccgggcgcggtcgtcgtctacctcgcgtcggcgctggtcgcactcgtctccgtcgtcgtcctcgcgtgatgggcgccgggcgcgacgcgttcgatcggcgttcatagcaggcaggggagatacactattatactagggaagaatgatcggagtagaaggaagccggagagggataaagcgacgagc

SEQ ID NO: 12508 - protein, 202 aa, Panicum virgatum
  misc_feature: Ceres CLONE 1763622
  misc_feature (42)..(121): Pfam Name: Tryp_alpha_amyl Pfam Description: Protease inhibitor/seed storage/LTP family
  misc_feature: Useful for making plants with altered carbohydrate content
MALARGGRGLPSRAAAAAAAVLVVAALAGVASGDFAADRAECANQLMGLATCLTFVQEKATARAPTPDCCAGLKQVVAASKKCMCVLVKDRDEPALGFKINVTRAMDLPPLCNYPATFSDCPKILGMSPDAPEAEIFKEYARKHESHNGTATKPAAATGAAGGKSATSSSPAGGAGAGSKPGAVVVYLASALVALVSVVVLA

SEQ ID NO: 12509 - DNA, 622 bp, Panicum virgatum
  misc_feature: Ceres CLONE 1763630
  misc_feature: Encodes the peptide sequence at SEQ ID NO. 12510
atccctaagcaccaccgcaaccctagacgacgtctcagcttcccagcctcccgccgccgccgcttttcttctccgaagaccctcccctccagagaccaacgagcgcagagacgccggagcgaaccctcgcctgccaccatggtgctccagaatgacatcgacctgctgaacccgccggcggagctggagaagctcaagcacaagaagaagcgcctcgtccagtcccccaactccttcttcatggatgtcaagtgccagggctgcttcagcatcactactgtgttcagccactcccagacggtggtggtctgcccgggctgccagacggtgctctgccagccgacaggcgggaaagctaggctaaccgaggggtgctccttccgccgcaagggcgactaaatcttcaagacgcaaaaggctcatggagctgctagtttcttggatgtagtctgaaagttttgccaatggctgccatgtgaaaccatgctctatgaatcttttgttagataagttgcatcgcaacactggtaaccttatattctacaactgggtaaggcaggtcagactagctgtctgtcctggtgatatttggcgtcgatgaatccttcgttatttctggtgc

SEQ ID NO: 12510 - protein, 86 aa, Panicum virgatum; identical to SEQ ID NO: 9875
  misc_feature: Ceres CLONE 1763630
  misc_feature (30)..(84): Pfam Name: Ribosomal_S27e Pfam Description: Ribosomal protein S27

SEQ ID NO: 12511 - DNA, 664 bp, Panicum virgatum
  misc_feature: Ceres CLONE 1763631
  misc_feature: Encodes the peptide sequence at SEQ ID NO. 12512
accccgtctcgccctcgcccaaatccccaccccaaagtcccaaaccgaaccagcgaaagctcccctgcctgagcctgcctgctccgccctccgatcgcagggaggaagaggagggagatgagctactacggccagcagccccccgtcggcgtcccgccgcagcaaggctacccggggaaggacggctacccgccgccggggtacccgccggccggctaccccccgccggcgcagggctacccgccgcaggggtacccgcagcagggctacccgccgccgtacgcgcagccgccgccccagcagcagcagagcagcgggccttccttcatggagggatgcttggctgctctctgctgctgctgcctcctggacgcctgcttctgagacgaccctcgccgacggattcgaggtgactgcaagtgaaatgaaactgcctcaaggaagaaacggcttgaaatgctagtgtcctagactatagctttcttgtcctgcattatcgtctatttttttttttcattctcttttatgaaacccagcaatgagacttctagtactagtactctgtcggtgttgattggatgatggctggtgtgtattctgtggattgccgagtttctggtggaattcaacttgggattatggagtgcgcaacttggtttgttct

SEQ ID NO: 12512 - protein, 88 aa, Panicum virgatum
  misc_feature: Ceres CLONE 1763631
  misc_feature: Useful for making plants with altered cell wall content and/or composition
MSYYGQQPPVGVPPQQGYPGKDGYPPPGYPPAGYPPPAQGYPPQGYPQQGYPPPYAQPPPQQQQSSGPSFMEGCLAALCCCCLLDACF

SEQ ID NO: 12513 - DNA, 634 bp, Panicum virgatum
  misc_feature: Ceres CLONE 1763644
  misc_feature: Encodes the peptide sequence at SEQ ID NO. 12514
tcttggtcggtggaggaggaaaagaaaaaaaaaaggaaagaggaaggaatcgctccggcgaccggcggcgattgggacgggatggacggagccaagacgccgccgccggcgggtgggaagcgggagctggaagtggcgctgcttcacatcatacaacaccaccaccaccaatccctccgccaacgccaacaaactgagagagccaagaaggatgccttgagaagcgcgctgcgggtgtccgatctcctcgtcgacacggtcgacggcggcgtgcaggagctcttcgtcaacgagaagcgcatcgagcatgaggcccgcgcgctgctcaccactatcgcgcgctacaggaagcagactgaccagtggctggctgccaccaacgaaatcaactcagtcttgaaggaaattggagatttcgagaactggatgaagatcatggactttgactgtaaaagtatcaatgcagcgatacgcaatattcatcagtcatgactctacctgcagtcacaacttcagcaagtattcgtgtcattagatgtgctaattatgcgagttggaaaccctcttggatagaactgcttcctgtttttctgtacaaaactgtaaaatgaatccttgccaagtatctctgctg

SEQ ID NO: 12514 - protein, 136 aa, Panicum virgatum
  misc_feature: Ceres CLONE 1763644
  misc_feature (25)..(136): Pfam Name: GCN5L1 Pfam Description: GCN5-like protein 1 (GCN5L1)
MDGAKTPPPAGGKRELEVALLHIIQHHHHQSLRQRQQTERAKKDALRSALRVSDLLVDTVDGGVQELFVNEKRIEHEARALLTTIARYRKQTDQWLAATNEINSVLKEIGDFENWMKIMDFDCKSINAAIRNIHQS

SEQ ID NO: 12515 - DNA, 753 bp, Panicum virgatum
  misc_feature: Ceres CLONE 1763649
  misc_feature: Encodes the peptide sequence at SEQ ID NO. 12516
ctagctttgcctctcctctcccgcgccgccgcctcctctttcgcccacctcgcggtccagccgtccgtcgaggttgagcaacctgaaactacaatggcgcctaaagctcccccgaaaaaggctgatagcaaggctcaagccttgaaggttgccaaggctgttaagtctggatccaccaagaggaagaccaagaagatccgcacatctgtgacatttcacaggccgaagaccctcaagaagccaagggaccccaagtacccaagagtcagtgcacctgggaggaacaagcttgatcagtaccaaatcctcaaatacccacttacgaccgagtctgcaatgaagaagattgaagacaacaacacccttgtcttcatcgtcgacctcaaggcggacaagaagaagatcaaggcagctgttaagaagatgtatgacatccaggcgaagaaggtcaacactctgatcaggcctgatggcaagaagaaggcttacgtgaagcttacaccagactatgatgcccttgatgtggccaacaagatcggcatcatctaaattttgtagttctgtgtgccagtgtgttgcagtttcagagttctgtgggggtagggtcttatctgtagctaagcctgagtaccctttttctgcttgtgaactggtaccaatgatggaaatttgcaatgttcaagttctgcatttgaatttttctgttggatgttagcacttattgcgatatgaggctacatcatgttgcaggtt

SEQ ID NO: 12516 - protein, 151 aa, Panicum virgatum
  misc_feature: Ceres CLONE 1763649
  misc_feature (69)..(148): Pfam Name: Ribosomal_L23 Pfam Description: Ribosomal protein L23
  misc_feature (10)..(63): Pfam Name: Ribosomal_L23eN Pfam Description: Ribosomal protein L23, N-terminal domain
  misc_feature: Useful for making plants with modulated nitrogen use efficiency
MAPKAPPKKADSKAQALKVAKAVKSGSTKRKTKKIRTSVTFHRPKTLKKPRDPKYPRVSAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 12517 - DNA, 812 bp, Panicum virgatum
  misc_feature: Ceres CLONE 1763658
  misc_feature: Encodes the peptide sequence at SEQ ID NO. 12518
aatgtacacgaaatatctccaagccgccctcctcgcacgggcctcctcgcttcccccttctcgcacgggcctcctcgcttctcccttccctctccccgcgccgccgcccgccgccgcagcctcccacctcgccgtgcccaggatgtggggcagcaccgacggcggcacgccggaggtcaccctcgagacctccatgggcgccataacagtcgagatgtactataagcacgcacccaagacctgccggaacttcgtcgagctagcgcggcgaggctactacgacaacgtcatcttccaccgcatcatcaaggatttcattgtgcaaggtggggatcctacgggaaccggcagaggtggtgagtccatctacggagcaaagtttgaggatgagataaagtcagagttgaagcacactggagctggaattctgtccatggcaaatgctggtccaaatacaaatggaagccagttcttcataactctcgcaccttgtcagtctcttgatggaaagcatacaatttttgggagggtatgcagaggaatggaaatcgttaagcgccttggaagtgtgcagaccgacaagaatgacaggcccatccatgaagtaaaaatccttcgagccatcgtcaaagattgagttgaagcatcacgtgccgagtttggctctttgaactatgtttgtgttggtttaggtttaatgttcctaggagtggtgccatgcgaaaaaagattgcgaaatggcacggtcctggcttgaacgactgttatagtcgaaaattcagctattgatgaatctcatctctcgatctgtc

SEQ ID NO: 12518 - protein, 164 aa, Panicum virgatum
  misc_feature: Ceres CLONE 1763658
  misc_feature (11)..(163): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MWGSTDGGTPEVTLETSMGAITVEMYYKHAPKTCRNFVELARRGYYDNVIFHRIIKDFIVQGGDPTGTGRGGESIYGAKFEDEIKSELKHTGAGILSMANAGPNTNGSQFFITLAPCQSLDGKHTIFGRVCRGMEIVKRLGSVQTDKNDRPIHEVKILRAIVKD

SEQ ID NO: 12519 - DNA, 975 bp, Panicum virgatum
  misc_feature: Ceres CLONE 1763686
  misc_feature: Encodes the peptide sequence at SEQ ID NO. 12520
accaaacaggcggggttgagcaacctcccggatctccagccagcctcctccgcgtcgccgccgccgccgcctagcgccgcaacgatggccaccccggacctgctcttcaacctgcggaacctcttctacctgggcgcctaccaggcggccatcaacaacagcgacgtcccgggcctcgacgccgacgccgccgccgagcgcgacgccatcgtcttccgctcctacatcgccctcggctcctaccagctggtgatcagcgagatcgactcctccgccgcgacgtcgctgcaggccgtgaagctgctcgcgctgtacctcaccggggacaaggaaggtgcaatctccagtctcaaggaatggttgagcgattcagcaattgggagcaatcctgttcttcgattgattgctggaattatatttatgcatgagcaggactataatgaggccctcaagcacacacactctggaggaactctggatttgcatgcattgaatgtgcagatcttcattaagatgcatcgttcagactatgctgagaagcaattgaagaccatgcaacaaattgatgaagaccatacactgacacaacttgcaagcgcatggttggacattgctgttggtggctctaagatccgtgaagcttacctcatattccaagactttgctgaaaagtacccaatgacaggaatggttctgaatgggaaagcagtttgctgtatgcacatgggaagctttgaggaggctgaaactctattgcttgaagcattaaacaaggatgcaaaagatccagaaactcttgccaatctcattgtatgtagtctccaccttggcaaaccatcatcacggttcctcagccagctgaagctatcgcatcctgatcatgtgctagtgaagaactcagcatcgtcggaagcaaacttcgagagggccctccaagccgttgcttgagcacgacaaactgcatccagattacag

SEQ ID NO: 12520 - protein, 287 aa, Panicum virgatum
  misc_feature: Ceres CLONE 1763686
  misc_feature (3)..(287): Pfam Name: Coatomer_E Pfam Description: Coatomer epsilon subunit
MATPDLLFNLRNLFYLGAYQAAINNSDVPGLDADAAAERDAIVFRSYIALGSYQLVISEIDSSAATSLQAVKLLALYLTGDKEGAISSLKEWLSDSAIGSNPVLRLIAGIIFMHEQDYNEALKHTHSGGTLDLHALNVQIFIKMHRSDYAEKQLKTMQQIDEDHTLTQLASAWLDIAVGGSKIREAYLIFQDFAEKYPMTGMVLNGKAVCCMHMGSFEEAETLLLEALNKDAKDPETLANLIVCSLHLGKPSSRFLSQLKLSHPDHVLVKNSASSEANFERALQAVA

SEQ ID NO: 12521 - DNA, 851 bp, Panicum virgatum
  misc_feature: Ceres CLONE 1763692
  misc_feature: Encodes the peptide sequence at SEQ ID NO. 12522
aaagcgctgagccgctcgcccccatcagcgcacgcccaagcatggcgctctccgtctcctccctcgccgccgccctctcccatctctccctcccctccacctccaagcctcatcaggcttccctcctccgcctccacccctccacctcccgccgcgccgtcagcctcgcgctccgcgcctccgcggccgaggccgccgagccggccgagccgggcctgcccgcgaaggaggtggtggccgtcgaggcggaggcggaggaggatgcggtgtcgggcgtcgcgctgcggaagtacgtcaagcagcggctgccgggcggcttcgcggcgcagcggatcaccgccacgggccgccgcaagacggccatcgcccgcgtcgtgctccaggagggcaccggcaaggtcttcatcaacttccgcgacgccaaggagtatctgcagggaaacccaatgtggatggagtactgcaaggtccccttggtgactctcggatttgagaacaactacgacgtcttcgtcaaagttcatgggggcggtttgtcaggccaggcccaggcaatttgccttggtgtcgcccgtgcgctagtgaagatcagcactgccaacaaggttcctcttagatcagaaggtttgctgacgagagacacccgtattgttgaaaggaagaaggctggtctcaagaaggcacgcaagcgcccacagttctcaaagcgttgagggtgctcggttgttcttacagttttctcatttccatctcttcaccactcagaaagcccttctgtatcatttgctgtgcaaattctgtaatggacgccgcgtatctgtaatagttgattcttgaaagcaattttcctg

SEQ ID NO: 12522 - protein, 223 aa, Panicum virgatum
  misc_feature: Ceres CLONE 1763692
  misc_feature (102)..(223): Pfam Name: Ribosomal_S9 Pfam Description: Ribosomal protein S9/S16
MALSVSSLAAALSHLSLPSTSKPHQASLLRLHPSTSRRAVSLALRASAAEAAEPAEPGLPAKEVVAVEAEAEEDAVSGVALRKYVKQRLPGGFAAQRITATGRRKTAIARVVLQEGTGKVFINFRDAKEYLQGNPMWMEYCKVPLVTLGFENNYDVFVKVHGGGLSGQAQAICLGVARALVKISTANKVPLRSEGLLTRDTRIVERKKAGLKKARKRPQFSKR

SEQ ID NO: 12523 - DNA, 774 bp, Panicum virgatum
  misc_feature: Ceres CLONE 1763700
  misc_feature: Encodes the peptide sequence at SEQ ID NO. 12524
accaaccatcgacgagacgacgacgtcgccggcgagagagaaggggagacagttgacagatggaggcggcggcggcagcggccggcgtgcagctcggctcctccaagccccagatcgccacgcaggcggagatggcggaggcccgggtgccgctcccctaccgcgaccagtgcgcgcacctcctcatcccgctcaacaagtgccgcgtcgccgagttctacctcccatggaagtgcgagcccgagcgccacgcctacgagaagtgccagtacgagctcgtcatggagcggatgctccagatgcagaagatccgcgaggcgcaggaggccaaggtcaagggcggcgcctccattggcctcatcccggccaccgccaagctcgcctgatccttccccggtccgatccggttgatttaggtctgctggttatcacagcgtgcagaggcattgtgcaagaatcctgaatgtttgttgtatgaacagacatctgttgaatttggcataaagttaactgttatcttctcctcatcccccttttctccttgatgggcatcttcaagtttcaatttgatggaataacgaaacctactgtcttacgcttgatgactgaatgacgccttgaagttttgaatgcaattcgtggacccttcatatgtagacagacctactttgtgctgtaggttatgtaatgacatagccgctttacctgggctgtggctgtgcagcaattttgtgttacgcgtgtcatcaactcatcatcatgtcatgttgcatc

SEQ ID NO: 12524 - protein, 108 aa, Panicum virgatum
  misc_feature: Ceres CLONE 1763700
  misc_feature (1)..(89): Pfam Name: NDUF_B7 Pfam Description: NADH-ubiquinone oxidoreductase B18 subunit (NDUFB7)
MEAAAAAAGVQLGSSKPQIATQAEMAEARVPLPYRDQCAHLLIPLNKCRVAEFYLPWKCEPERHAYEKCQYELVMERMLQMQKIREAQEAKVKGGASIGLIPATAKLA

SEQ ID NO: 12525 - DNA, 729 bp, Panicum virgatum
  misc_feature: Ceres CLONE 1763709
  misc_feature: Encodes the peptide sequence at SEQ ID NO. 12526
aatcgaggaagacagagtgctactgattcgagaagcttctacgtacggccacaagccagcaacccgccgaggcatctctgcaagcgaagcaggtccgatcgagagcatgctggttgtcgcgtcgccgtcggcgtcgggcgagctcggctcgctgttcgcggcgttcgacaaggacgccgacggcaggatctccgcggcggagctgcggctctgcatgcgggcggcgctgggcgaggacgtggcgcccgaggacgccgaggcgctggtggcctcggcggacgcggacggcgacgggctgctggacgagggcgagttcgcgcggctggtgcgcgcggaggctaaccgttggagcaatggctacaagacttggtgacctatatatacatctcactccggccatttgaagattactggagttgctggatatcccacacacacctaagaacatctccaagccatacaaaagcatcaagatcatatccttagcccttagcacactttgagagtgttgtgtaaaagattagctcttagtgagtgagtttgcaaggcttagagcctttgtgttgtggttcattagcgaaccaaaacaagagcttggtgcgtcggcaccttggagcgtgaagctcaccggcaacgtcatcgaccctccgatttggtgtggagcggcgacgacatctttgtgcgggggatgtgaagatccccatcctttgtggagaagctctttagtgg

SEQ ID NO: 12526 - protein, 88 aa, Panicum virgatum
  misc_feature: Ceres CLONE 1763709
  misc_feature (12)..(40): Pfam Name: efhand Pfam Description: EF hand
MLVVASPSASGELGSLFAAFDKDADGRISAAELRLCMRAALGEDVAPEDAEALVASADADGDGLLDEGEFARLVRAEANRWSNGYKTW

SEQ ID NO: 12527 - DNA, 994 bp, Panicum virgatum
  misc_feature: Ceres CLONE 1763713
  misc_feature: Encodes the peptide sequence at SEQ ID NO. 12528
agggggtctagagcgagcaagactgcgagatctttcgacttttccagagcgagcagagggagccggggagggggcaccggcgatgtcgacgacgaccgaggcggcgaagagcgccgccgccgctcccgtgcggtgccagcggatcggctgcgaagccatgttcaccgacgacaacaaccccgaaggctcctgccagtaccacccctcccctttatttcatgatggcatgaaagagtggagctgctgcaagcaacgaagccatgattttagcttatttttggcgataccaggatgcacaacagggaagcacacgactgaaaaaccagtcacaaaagctgtttctgcaaactgtccaaaggcaacaccagtccagtcttctaagcagactgtaggagccgatgcctgcgcaaggtgccgtcagggttttttttgttctgaccatggatcacagccaaaggtacaaaaaccagctgctaacgatgatacaagcaaggaacctgttgaaaaatcctcggttccacctcccaagaaaaggatcgatatgaatgaaccgcgaacatgtaaaaataaaggatgcggtaaatcctacaaggagaaggataaccatgattctgcgtgtgattaccatccaggtccagcagttttccatgacaggatgagagggtggaaatgttgcaatgttcatgtcaaggagtttgatgagtttatggagatacctccatgcaccaagggctggcataacgcagatgctgtgtgaattcacaccatgcctattgctgctatcgtgtcatatctcctagcatgtaagaggcaatcttgcttctcagcttctgttacttgggagttttacttggaagtgtgacaagaactttgaggacgggctgcatattagcttcgagtgattgtcccgaagttttacatgatgctccttgtactctggacctgaacttgaaaccatatttcttcgctacttgatttgaattgaaattgtatc

SEQ ID NO: 12528 - protein, 224 aa, Panicum virgatum
  misc_feature: Ceres CLONE 1763713
  misc_feature (14)..(77): Pfam Name: CHORD Pfam Description: CHORD
  misc_feature (156)..(220): Pfam Name: CHORD Pfam Description: CHORD
  misc_feature: Useful for making plants with modulated biotic stress sensitivity
MSTTTEAAKSAAAAPVRCQRIGCEAMFTDDNNPEGSCQYHPSPLFHDGMKEWSCCKQRSHDFSLFLAIPGCTTGKHTTEKPVTKAVSANCPKATPVQSSKQTVGADACARCRQGFFCSDHGSQPKVQKPAANDDTSKEPVEKSSVPPPKKRIDMNEPRTCKNKGCGKSYKEKDNHDSACDYHPGPAVFHDRMRGWKCCNVHVKEFDEFMEIPPCTKGWHNADAV

SEQ ID NO: 12529 - DNA, 809 bp, Panicum virgatum
  misc_feature: Ceres CLONE 1763735
  misc_feature: Encodes the peptide sequence at SEQ ID NO. 12530
acgaaacaaagctaagcgtttggtattacagccagcaccagcagcttagctcagctcagctccccgttcgacaccaccatggcctccgtctcgcgcctcctcgccgtggcgctcgtcgtcatggccgccgcgctcctcggcggcggcggcggcacgtgccacgccgcccgcctcctcgccgccctgccggtgcccgaggtgcctggcgtgccgttgccgacgttgcccgaggtgccgggcatcccgacgctgccggtgcctgaagtgccgatgccggaagtgccgaagctgccggtgcctgaagtgcccaagctgccggtgcccgaagtgcccaagctgccggtgcccgaagtgccgggcgtgcccgtgcctgaggtgcccggcgtgcccgccgtgccttaggtgccgcgcgctcgtccgcggatgctgccggctcccggcgtggacgaaagcctctcccgcgccgcgctgcgtgcccatcggcctcgacgacgtcggtccgtgcgcaagtgccggcgcgggagtgtggtggtggtactcttctgtgtttatatgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtacgcgagactacgtacgcgtcgcgtgtctctcgtttcgtcgtgatgtctgctacgtcgttgtagggtatggacgtgcacgcgatacggtgcgcgtgtaacaccacatatatactgctctatcgatgaatgttacc

SEQ ID NO: 12530 - protein, 107 aa, Panicum virgatum; identical to SEQ ID NO: 10029
  misc_feature: Ceres CLONE 1763735
  misc_feature: Useful for making plants with modulated heat sensitivity

SEQ ID NO: 12531 - DNA, 460 bp, Panicum virgatum
  misc_feature: Ceres CLONE 1763744
  misc_feature: Encodes the peptide sequence at SEQ ID NO. 12532
cgtgagctcccttgcaaccaccattttcactgcagctgcatagataagtggcttcacataaaagcgacgtgcccgctgtgcaagttcaacattgtcaagagcaaccttgacagggaagaggtctaggtatcacaagacaaaaatcttgccaaagcttttcgacatctctcagctgtcgtgctctccattgctacttcatttgcaaacagagttgtgattatcggtcatgtagtttcaagttataggtgatgcacagatggttgccatgttggttgtcgtgaatatattttagcagtttgttgcagctattgtacatcctctttctgctcgatctatttgcattgcagatttatatgtcggtggccgcgccatcagtcatttgtaaaatgattcatgaattggaggttagtatacagttacttggtgtaaatgcatcgacgaaagtttggtgtttgggcac

SEQ ID NO: 12532 - protein, 41 aa, Panicum virgatum
  misc_feature: Ceres CLONE 1763744
  misc_feature: SWISSPROT Homolog: EC 6.3.2.19 Ubiquitin--protein ligase
  misc_feature: The sequence is a functional homolog of SEQ ID NO 178 in the 10/666,642 US patent application
  misc_feature: The sequence is a functional homolog of SEQ ID NO 404 in the 10/666,642 US patent application
  misc_feature: The sequence is a functional homolog of SEQ ID NO 2 in US patent 7053203
  misc_feature: Useful for making plants with modulated biomass
  misc_feature: Useful for making plants with altered alkaloid content
  misc_feature: Useful for making plants with altered lignin content
  misc_feature: Useful for making plants with altered lutein content
  misc_feature: Useful for making plants with modulated nitrogen use efficiency
  misc_feature: The sequence is a functional homolog of SEQ ID NO 984 in the 11/479,226 US patent application
  misc_feature: The sequence is a functional homolog of SEQ ID NO 1133 in the 10/666,642 US patent application
  misc_feature: The sequence is a functional homolog of SEQ ID NO 1285 in the 11/479,226 US patent application
  misc_feature: The sequence is a functional homolog of SEQ ID NO 1935 in the 11/479,226 US patent application
  misc_feature: The sequence is a functional homolog of SEQ ID NO 152 in the 10/666,642 US patent application
  misc_feature: The sequence is a functional homolog of SEQ ID NO 606 in the 10/412,699 US patent application
  misc_feature: The sequence is a functional homolog of SEQ ID NO 1131 in the 10/666,642 US patent application
  misc_feature: The sequence is a functional homolog of SEQ ID NO 1541 in the 11/479,226 US patent application
  misc_feature: Useful for making plants with altered terpenoid content
  misc_feature: The sequence is a functional homolog of SEQ ID NO 216 in the 10/225,068 US patent application
  misc_feature: The sequence is a functional homolog of SEQ ID NO 2322 in the 10/374,780 US patent application
  misc_feature: The sequence is a functional homolog of SEQ ID NO 242 in the 10/412,699 US patent application
  misc_feature: The sequence is a functional homolog of SEQ ID NO 515 in the 11/479,226 US patent application 220>
  misc_feature: Useful for making plants with modulated flowering time
  misc_feature: The sequence is a functional homolog of SEQ ID NO 406 in the 10/666,642 US patent application
  misc_feature: The sequence is a functional homolog of SEQ ID NO 670 in the 10/666,642 US patent application
  misc_feature: The sequence is a functional homolog of SEQ ID NO 1145 in the 11/479,226 US patent application
  misc_feature: The sequence is a functional homolog of SEQ ID NO 140 in the 10/666,642 US patent application
  misc_feature: The sequence is a functional homolog of SEQ ID NO 504 in the 10/412,699 US patent application
  misc_feature: The sequence is a functional homolog of SEQ ID NO 268 in the 10/666,642 US patent application
  misc_feature: The sequence is a functional homolog of SEQ ID NO 954 in the 10/412,699 US patent application
  misc_feature: The sequence is a functional homolog of SEQ ID NO 1134 in the 10/666,642 US patent application
  misc_feature: The sequence is a functional homolog of SEQ ID NO 150 in the 10/225,068 US patent application
  misc_feature: The sequence is a functional homolog of SEQ ID NO 1537 in the 11/479,226 US patent application
  misc_feature: The sequence is a functional homolog of SEQ ID NO 2534 in the 10/374,780 US patent application
  misc_feature: The sequence is a functional homolog of SEQ ID NO 1850 in the 11/479,226 US patent application
  misc_feature: The sequence is a functional homolog of SEQ ID NO 90 in the 10/666,642 US patent application
RELPCNHHFHCSCIDKWLHIKATCPLCKFNIVKSNLDREEV

SEQ ID NO: 12533 - DNA, 737 bp, Panicum virgatum
  misc_feature: Ceres CLONE 1763754
  misc_feature: Encodes the peptide sequence at SEQ ID NO. 12534
aaaaatccgaagccacacagcgagaggaaatggcggcggcggcgctccgtccggcgatcctccgccgcatccgcctctccccctccccggcgctccccctcgccgccgcggcgtcccacccgcacgccctggcgcggtggctcgcgcggcccatgtcctcccacgacgcgcacctcacccgcgaggaggtcgtcgaccgcgtcctcgacgtcctcaagagccaccccaaggtggatccctccaaggtgactcccgaggcgcacttcgagaaggatctggggctggacagcctggacaccgtcgaggtggtgatggccatcgaggaggagttcaagctcgagatcccggacaaggaggccgacaagatcgactcgctcccgctcgccatcgagtacgtcgccaaccaccccatggccggctgagcctcagctcgccggaggtgaggtctcttggttttttttttcccgagggcaaataattggccggagcggctgaggaaagcgcgtccctggcgctccgcattgcttcgcgggcggacgatgatgtcgaaatggaacattaacattttgtttctcagacgatgcaatgttagattgctgttttcggtgtgtgttatatctaaacggtgttgttgacaaactagtttggtcggttacgagcctgcctattgttccactatctgattgttcaaattgggttcataatagtttattacgcttatgtaccagttttcttcc

SEQ ID NO: 12534 - protein, 130 aa, Panicum virgatum
  misc_feature: Ceres CLONE 1763754
  misc_feature (56)..(123): Pfam Name: PP-binding Pfam Description: Phosphopantetheine attachment site
  misc_feature: SWISSPROT Homolog: EC 6.1.1.13 D-alanine--poly(phosphoribitol) ligase
MAAAALRPAILRRIRLSPSPALPLAAAASHPHALARWLARPMSSHDAHLTREEVVDRVLDVLKSHPKVDPSKVTPEAHFEKDLGLDSLDTVEVVMAIEEEFKLEIPDKEADKIDSLPLAIEYVANHPMAG

SEQ ID NO: 12535 - DNA, 595 bp, Panicum virgatum
  misc_feature: Ceres CLONE 1763760
  misc_feature: Encodes the peptide sequence at SEQ ID NO. 12536
cagttctccgcggttctattcgcatcggcagcgtcttctacccgagccgccaccatgccgaagcagatccacgagatcaaggacttcctgctgacggcgcggcggaaggaagcgtggtcagtgcggatcaagcgggccaagggcgccgtcaagatcaaggttcgctgctccaggtacctctacaccctatgcgtccacgacgcggacaaggccaacaagctcaagcagtcgctcccgccaggtctgagcgttcaggagatttaagtagcaagccaaactacgccttgtggtgtcagagatgtttgccctccagtatttctttagtaggtgggttaagccatgattgaatgaattgaagtttgagtttaaaaagtgtaatgttggaagtgatgtattggacctatgatcctttagtgtaatggtactcccttgcggagaagataatcggctatcaatagttgagtctgaattttgtgaaatgtattctgctttcttcagattcctgctctgttcaaaatgctgagtttacgctgtgcagccatttgaaaatcttaaattcatgtattttttccgtaatatcttggcagttcgagac

SEQ ID NO: 12536 - protein, 69 aa, Panicum virgatum
  misc_feature: Ceres CLONE 1763760
  misc_feature (2)..(69): Pfam Name: Ribosomal_L38e Pfam Description: Ribosomal L38e protein family
MPKQIHEIKDFLLTARRKEAWSVRIKRAKGAVKIKVRCSRYLYTLCVHDADKANKLKQSLPPGLSVQEI

SEQ ID NO: 12537 - DNA, 799 bp, Panicum virgatum
  misc_feature: Ceres CLONE 1763771
  misc_feature: Encodes the peptide sequence at SEQ ID NO. 12538
cttagcccccgccgccgccgccagttctcgccctctcccaaaccctacccgccgccgccgccatgccgccgaagctcgacccgtcgcaggtggtggaggtgttcgtccgcgtgacgggcggcgaggtcggcgcggcgtcgtcgctggcgcccaagatcggcccgctggggctctccccgaagaagatcggggaggacatcgccaaggagacggccaaggactggaagggcctccgcgtcaccgtcaagctcacggtgcagaaccgccaggccaaggtctcggtcgtgccctccgccgccgcgctcgtcatcaaggcgctcaaggagcccgagagggaccggaagaaggtcaagaacatcaagcacagcggcaacatcggcctcgacgacgtcgtcgagatcgccaggaccatgaggcccaggtccatggccaaggagatggccgggaccgtcaaggagatcctcggcacctgcgtcagcgtcgggtgcaccgtcgacggcaaggaccccaaggacctgcagcaggagatcgatgacggcgacgtcgagatcccctcagcttaaaaggctaaggagactgtaattgatgctgctgaagtggtgttttgttctgcatgctgttgtacctccaaacaatgtgattccacctttttcgtctagctctattagtgttattctgtgagagaactcaatggtattaccacatccttttccattgggagtccggaatggagagtttcaaacgcatctgcagcttgtgcctcatgtttcggtgtttgtttcatgatcctttttgtcct

SEQ ID NO: 12538 - protein, 166 aa, Panicum virgatum
  misc_feature: Ceres CLONE 1763771
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNIGLDDVVEIARTMRPRSMAKEMAGTVKEILGTCVSVGCTVDGKDPKDLQQEIDDGDVEIPSA

SEQ ID NO: 12539 - DNA, 536 bp, Panicum virgatum
  misc_feature: Ceres CLONE 1763772
  misc_feature: Encodes the peptide sequence at SEQ ID NO. 12540
tgagattctctctttggctggctcatatcttctgtcagaaagtggtgggatgagcagtcgaactggtggacttagtgtctcactttctggtcctgatgggcgtgttttaggtagtgccgtagcaggacctctaactgcagcttcgccagttcaggtggtcattgggagctttctagctgattggaaatcggagcttgatcctggatcagcacctgacagaactgttttcggtgggtttcctactgccagcagtccatcgtcaaggggcactgaatcctctggtgggcatggaagcccgccgaatcctgctgcctcgttcaatacgagcagccaaccaagctttcctaactaccctacatggaaatgagcttacctgaatcctactgtccgcctgccccagctgtggggactagacttaaattgctgttttaggtactcctgaaggaacttggtggttttcaggctgaaatgtagattgttgtcttgtaatgtgccgtttggtttggtaggtttatgcttatcgatccttatttggt

SEQ ID NO: 12540 - protein, 121 aa, Panicum virgatum
  misc_feature: Ceres CLONE 1763772
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
  misc_feature: The sequence is a functional homolog of SEQ ID NO 1446 in the 10/666,642 US patent application
  misc_feature: The sequence is a functional homolog of SEQ ID NO 2606 in the 10/374,780 US patent application
  misc_feature: The sequence is a functional homolog of SEQ ID NO 296 in the 10/225,066 US patent application
  misc_feature: The sequence is a functional homolog of SEQ ID NO 74 in the 11/375,241 US patent application
  misc_feature: The sequence is a functional homolog of SEQ ID NO 878 in the 10/412,699 US patent application
EILSLAGSYLLSESGGMSSRTGGLSVSLSGPDGRVLGSAVAGPLTAASPVQVVIGSFLADWKSELDPGSAPDRTVFGGFPTASSPSSRGTESSGGHGSPPNPAASFNTSSQPSFPNYPTWK

SEQ ID NO: 12541 - DNA, 837 bp, Panicum virgatum
  misc_feature: Ceres CLONE 1763778
  misc_feature: Encodes the peptide sequence at SEQ ID NO. 12542
ccaccagcgtagtagcaaagctagcccacttttccttgacttgacccgcgcgcgcggcgtcagctcccgcctctccgccgagaagccggacggagctctttttttaaaggcagcaagcccaaccaaacccttctccttcgagaggtcgccgaggagaggggagccatgctggaccatctcgtcgggctggtgagggtgcgcgtgctcaggggggtgaacctcgccatccgcgacctccgatctagcgacccctacgtcgtcgtccgcatcggcaagcagaggctgaggacgaaggtggtcaagaagaacaccaacccggaatggaacgaggaactcaccctctcgattgaagaccctgcacatcctgtcagactggaagtgtttgacaaggacacattcgtcgatgattcgatgggtaccgcagagctggacatccgcccgttggttgaggtcgtgaagatgaagctccaggatgttgccgatggaactgtggtaaagaaactggtgcccaacagacagaactgcctggccgaggagagctccatttacatctccgagaggaaggtgaagcaggacctggttatcaggctgaagaacgtggagtgcggggagatagagctccagcttcagtgggtcgacctccctggttccaagggtgtatgagctccgctctgccctgctgttctcaggggttctcgagtgaaagtaaagttcatgtgacgaatgtaaatgtaatctaaggatggttatggtacagcaagtgctgaactgctgattaggattttttatgttcttttatgattgtatataaggggttgtttggatctgtgttttgtg

SEQ ID NO: 12542 - protein, 165 aa, Panicum virgatum
  misc_feature: Ceres CLONE 1763778
  misc_feature (9)..(87): Pfam Name: C2 Pfam Description: C2 domain
  misc_feature: SWISSPROT Homolog: EC 2.7.11.13 Protein kinase C
MLDHLVGLVRVRVLRGVNLAIRDLRSSDPYVVVRIGKQRLRTKVVKKNTNPEWNEELTLSIEDPAHPVRLEVFDKDTFVDDSMGTAELDIRPLVEVVKMKLQDVADGTVVKKLVPNRQNCLAEESSIYISERKVKQDLVIRLKNVECGEIELQLQWVDLPGSKGV

SEQ ID NO: 12543 - DNA, 748 bp, Panicum virgatum
  misc_feature: Ceres CLONE 1763792
  misc_feature: Encodes the peptide sequence at SEQ ID NO. 12544
gtgagtggaccaccccaccttcgctccgcagccgcagcacccacctcctcctctcgccgccgccaccgcaagtacagcgcagccgcgccgcctccgatccccttccgaggctaaagcaccagcgcatcccccccccccccccaccgaatggcggcggcgaggagtctgattctgaggcacctccgcttggcggcggccccgtcgtcagcggcggccctcaggccggcggccgcgctgcaggaggctctatgggggcggcgatggatgtcttcagaagaggcgaaggggtcgttcctggacaaaagcgaagtcacggaccgcatcatcaaggtcgtcaggaacttccagaagattgacgacccctccaaggtgacaccagatgcccatttcaagaatgatcttggcctagatagcttggatacagtggaggttgtcatggccctagaagaggaatttggattcgagatacctgacaacgaagctgacaaaatcgactccgtcaaagttgcagttgagttcattgcctcacaccctcaagcaaaatgatcaggcaaattgccttctgtagtctttaaggtttttatgaagaagagtttggcttaatgatgagcactgttgtgaccgtttcaccattgtactgtttgacacgatcctttctggaacgttttctgttactgtgggttattctgcactaaataatgatatttagtcctgagaaggaacttggatggcgctttcgcctctcacc

SEQ ID NO: 12544 - protein, 132 aa, Panicum virgatum
  misc_feature: Ceres CLONE 1763792
  misc_feature (57)..(125): Pfam Name: PP-binding Pfam Description: Phosphopantetheine attachment site
  misc_feature: SWISSPROT Homolog: EC 6.1.1.13 D-alanine--poly(phosphoribitol) ligase
MAAARSLILRHLRLAAAPSSAAALRPAAALQEALWGRRWMSSEEAKGSFLDKSEVTDRIIKVVRNFQKIDDPSKVTPDAHFKNDLGLDSLDTVEVVMALEEEFGFEIPDNEADKIDSVKVAVEFIASHPQAK

SEQ ID NO: 12545 - DNA, 809 bp, Panicum virgatum
  misc_feature: Ceres CLONE 1763814
  misc_feature: Encodes the peptide sequence at SEQ ID NO. 12546
ctagtcagccggatcgctgcgtcgctccgcctcggccttccgccctcgcgcggcgccttcctcggttcgtcggtccagcttgggagatgtcagactctgaggagcaccatttcgagtcgaaggccgacgccggagcctccaagacttacccgcagcaggccggcaccatccgcaagaacggatacatcgtcatcaagggccgcccgtgcaaggttgttgaggtctccacttcaaagacagggaagcacggtcatgcgaaatgccacttcgtggccattgacattttcaatggaaagaagcttgaggatattgtgccatcttcccataactgtgatgtgccccatgtcaaccgtactgactatcagctgattgacatatctgaagatggatttgtaagccttctgactgaaaatggaggcaccaaggatgatctgaggctccctactgatgaaactctgctttcccagattaaagctggattcgatgatgggaaggacctgattgttagtgtgatgtctgccatgggtgaggagcagatctgcggtctgaaggatatcggcaagaactagagctgcattgccactgttggttgtttgtccggtcgctatctgggaggtggtgtgttgatgatataagcgtgtttggttacgagtaacatgcttgtggactgccgttgtcttgtcgtttatgcagagtgatttggatgtacctttgctatctgtaatgttcttttgaacctagtagcttggctacacctcaatcgaaatcatatgcatcagatgagaagtgggctttcagaagtttgtatt

SEQ ID NO: 12546 - protein, 160 aa, Panicum virgatum; identical to SEQ ID NO: 10137
  misc_feature: Ceres CLONE 1763814
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif

SEQ ID NO: 12547 - DNA, 768 bp, Panicum virgatum
  misc_feature: Ceres CLONE 1763829
  misc_feature: Encodes the peptide sequence at SEQ ID NO. 12548
aaatcgatcggagcacaacagaagccacacgctcccaagtcccaacacacaagcaagcaagcaatctgaggagaagccggccgccgatttccccagcccgtgcattgttcccgatggcgaccatggtgatggcctccgccgcgagctccctcgccttcgccgccaccgtcgcgagcgccggccgcttccccgcccggcttccggcggcggcggggctcgcgccgcgccggcgcgcaccgctcgtcagggcgcaggctaataagggtcctgagaagccggcagcgagcccggggctctgggacgcgctggcgttcagtggccccgcgccggagcggatcaacgggcgcctcgccatggtgggcttcgtgtccgcgctcgccgtcgaggcggcccgcggggacggcctcctcgcgcaggtcggcaacggcgccgggctcgcgtggttcgcgtacacggccgtcgtgctgtccgcggcgtcgctggcgccgctgctccagggggagagcgccgaggacaggagcggcggcttcatgaccgccgacgccgagctctggaacggccgcctcgccatgctcggcctcgtcgcgctcgctgccaccgagtacctcaccggcgcgcctcttgtcaacgtgtaaatacggcgtacattacgtacgcatacgtgtagctgtatgtgtagaggcggtagtgtatatacgtgtgtatttgtatgtacggccggggtacttgtgagctcggctaagtataatttgacacaaaaatgatctt

SEQ ID NO: 12548 - protein, 173 aa, Panicum virgatum
  misc_feature: Ceres CLONE 1763829
  misc_feature (49)..(164): Pfam Name: Chloroa_b-bind Pfam Description: Chlorophyll A-B binding protein
  misc_feature: SWISSPROT Homolog: EC 4.99.1.1 Ferrochelatase
MATMVMASAASSLAFAATVASAGRFPARLPAAAGLAPRRRAPLVRAQANKGPEKPAASPGLWDALAFSGPAPERINGRLAMVGFVSALAVEAARGDGLLAQVGNGAGLAWFAYTAVVLSAASLAPLLQGESAEDRSGGFMTADAELWNGRLAMLGLVALAATEYLTGAPLVNV

SEQ ID NO: 12549 - DNA, 762 bp, Panicum virgatum
  misc_feature: Ceres CLONE 1763833
  misc_feature: Encodes the peptide sequence at SEQ ID NO. 12550
aaaatcacaggaaccaaagatcaaaacatttagcagcccccgagcaaggagaaactttctgtgtgcaccatggctcgttgtggacctagttgcaatcttctcgtcctgctcctagccttgacagccttcaatggcagtttcgcagctcgccatcttttggacacaggagctgcgccagaggctgcaccggcacagccatccacaccaaaggttccaaccacactgcccccagtgccttccataccagcagttccaaccacactgcctccaattccttccattccagcggttccaaaggtggcaatgccaccaattccatccattcccattccaaaggtcgccctgccaccagcagcctctggcacaatcccatctctaccaaaccctgcgattccaaccaccgtgccaaccattcctgcagtgccagttacattgccaccaatgccctcgatccccactactgtgccatcaattccaacaacaatccctaccattcccgggcttcaggtgccacagattccattcgccgccccacccccacaaaccgccagcccttgaagtttatggtagcaggagacttctatttattactgttagtcaggaatttgatttgtcatatctggtcactatcagtgtatttgtcatgtttgttctgctatttggatgatactggctagcattttgtgtgattgtgaatgcagccagtcgactgtactgagtattgtaccatgtcttctgttaataaagtattacttgtttttt

SEQ ID NO: 12550 - protein, 162 aa, Panicum virgatum
  misc_feature: Ceres CLONE 1763833
  misc_feature: SWISSPROT Homolog: EC 2.7.11.22 Cyclin-dependent kinase
MARCGPSCNLLVLLLALTAFNGSFAARHLLDTGAAPEAAPAQPSTPKVPTTLPPVPSIPAVPTTLPPIPSIPAVPKVAMPPIPSIPIPKVALPPAASGTIPSLPNPAIPTTVPTIPAVPVTLPPMPSIPTTVPSIPTTIPTIPGLQVPQIPFAAPPPQTASP

SEQ ID NO: 12551 - DNA, 734 bp, Panicum virgatum
  misc_feature: Ceres CLONE 1763870
  misc_feature: Encodes the peptide sequence at SEQ ID NO. 12552
atcgccgatcgctcgacccccaccatcaacatatcagcaacccccacctcgcaccggtgcaccaaccatccatccgccgccgtcctcactgtcgccgcactccagcatccaccatccatccgtcaggtcccataagcgagaatggccgcccgcttcgccgccctcgtcgcagtcatcgccctcttcgccgcagccgcaacggcgcaggccccggccgcgtcgcccaagagagcgccggcccctgcaccgcccaaaatggccccgctaccgccgccgccgaccaagtccccggcggcctccccgcctgcgccgcccatggcgaccccggtctccgcgccctcggccgccgtcccggccatgagcccgttgggcgccggcgccggcgacgcgctgcccccggctggtgcctccgtcctgaccccggccgctgcgcccgccgccaccgagaagagccccgccgcatctgccaccgccgccaccagcttcgtcgccgttgccggtactgtggtcgcagccctcgtgttctaggtgccgcggcctgatctggcagtgggtgctgacgcgatcctttcgctgttcctgcgctttcgctgctctgctctgttcggctgttgatacatgtactctgtttcttcgtttttggcgattctttatttattatttattttgttgtcatttccaagcctgagacagagatgaggatatgtaatccaattttcagacggcagttgatc

SEQ ID NO: 12552 - protein, 128 aa, Panicum virgatum
  misc_feature: Ceres CLONE 1763870
  misc_feature: Useful for making plants with altered carbohydrate content
MAARFAALVAVIALFAAAATAQAPAASPKRAPAPAPPKMAPLPPPPTKSPAASPPAPPMATPVSAPSAAVPAMSPLGAGAGDALPPAGASVLTPAAAPAATEKSPAASATAATSFVAVAGTVVAALVF

SEQ ID NO: 12553 - DNA, 781 bp, Panicum virgatum
  misc_feature: Ceres CLONE 1763881
  misc_feature: Encodes the peptide sequence at SEQ ID NO. 12554
gagaaaagcacaggcagtggttcgatctctcgttctcagcaacggggcaattactcgtcggaatccctcaagaaattagagtacataaaattcgatcattcttcgaggctcttcgctcgtatcctcagccaccattcgttaatcaggcgttctctccagccagacaagttgccaggtgggtacaatggagcaaaagagggatatgaaataccaaccgggactgatatatttgtttcggtgtacaacctccaccgatccccatacttttgggaccggccaaatgaatttgaacctgagagattttcagttccaaagaaggaagagagcatagaaggctggtctggttttgatcccagcaggagtcccggcgcaatgtaccccaatgagatcatagcggactttgctttccttccctttggcggaggaccccgcaagtgcgtgggagaccaatttgcgctcctggagtcaacggtggcactgtccctgctgctgcagaagtttgatgtggagctgagggggtcgcccgacgaagtggagatggtgacgggcgccaccatccacacgaagaatgggctatggtgcagactaaggcggaggacctgatcaaacatagcttttacaccgagaagtagctctcttgcttgacttctttgatatgctttagccaagctaaacagcttcatgaatccttatttaaaaaaggccctcatgaacagcgaatgagaatcatgtacatggagacatctcttgtagcgcaatagtgacaatcataaaaccattt

SEQ ID NO: 12554 - protein, 200 aa, Panicum virgatum
  misc_feature: Ceres CLONE 1763881
  misc_feature (116)..(198): SWISSPROT Homolog: EC 1.14.15.3 Alkane 1-monooxygenase
  misc_feature (67)..(106): SWISSPROT Homolog: EC 1.14.13.94 Lithocholate 6-beta-hydroxylase
  misc_feature: Useful for making plants with altered carbohydrate content
EKSTGSGSISRSQQRGNYSSESLKKLEYIKFDHSSRLFARILSHHSLIRRSLQPDKLPGGYNGAKEGYEIPTGTDIFVSVYNLHRSPYFWDRPNEFEPERFSVPKKEESIEGWSGFDPSRSPGAMYPNEIIADFAFLPFGGGPRKCVGDQFALLESTVALSLLLQKFDVELRGSPDEVEMVTGATIHTKNGLWCRLRRRT

SEQ ID NO: 12555 - DNA, 873 bp, Panicum virgatum
  misc_feature: Ceres CLONE 1763882
  misc_feature: Encodes the peptide sequence at SEQ ID NO. 12556
ctcctcgcttgaaggtatctccctctcgctcttcccctctcgtgctgctcctcttccgtgagctcgtagattaggtcgtgcgtcagtcgattcctccccttgcttggcaggagcttgtgaagggtccatcagactgacaagatggttcttaagactgaactttgccgttttagtggccagaagatatatccagggaagggtattaggttcattcgtgctgattcccaggttttcctttttgctaactcaaaatgcaagcgttacttccacaaccgcctgaagcctgcgaagcttacctggacagctatgtacaggaagcagcacaagaaggacattcatgctgaagctgtcaagaagaggcgtcgcaccaccaagaagccatactcacgctcaattgttggtgccactttggaagttattcaaaagaagagaagtgagaagcctgaagttcgcgatgctgctagggaggctgctctacgtgagatcaaggagcgcattaagaagaccaaggatgacaagaaggccaagaaagcagaggtggcgaaatctcagaagacacaaactaagggtgcagcaccaaagggtcctaaaggccccaaaatcggtggtggcggtgggaagcgctgaatgcccattgcatcatagagatatagttctgtcaactagccttctctccaatcctatcttagaccttggtcaagttagtctgccgtcttgagtcttcacctatctgatgagattggtgtcctgaatgttttggattatttctggagttgatttacattggcacttatgtcaattattgttcagcaagttttgtcttcgattgccgacaagtgataaccaaatgattttgcatgccgtgtgttgttc

SEQ ID NO: 12556 - protein, 161 aa, Panicum virgatum; identical to SEQ ID NO: 12416
  misc_feature: Ceres CLONE 1763882
  misc_feature (3)..(73): Pfam Name: Ribosomal_L24e Pfam Description: Ribosomal protein L24e
  misc_feature: Useful for making plants with modulated nitrogen use efficiency

SEQ ID NO: 12557 - DNA, 883 bp, Panicum virgatum
  misc_feature: Ceres CLONE 1763888
  misc_feature: Encodes the peptide sequence at SEQ ID NO. 12558
atcagggacagccagcgcacgcaaacgtacacctacctcgtcgagccaacgcagaggcccagcccgatcgaagcaacgaggccaccagccatggccgcggcagctccccgccacgccgcgctcctcgccctgctgctgctcggtctcctctccaccgccgccctcgccgcgcgcgccggcggcgccgtggacgccgacctcgtcacgtccaccaagaagcccgcccccgcggggcccggcggcaagaagcctgccgtcaggccgccgcccgcggtgcccaaccctggaggcgccggcggcgcgatcccgaccatcccgggcttcggcggcggcatccccgggatgagcgggttcgggaacggcatccccgggatggccggcgggtggggcggcggctacggcgggccggcgggcgggtacgcccgcggcggcgtggtggcgcccacggtcacctgcaccgacaaggggccctgctacaggaagaaggtcacctgccccaagaagtgcttctcctcctacagcggcgctggcaagggctacggcggcggcggcggcgggggcagctgcaccgtcgactgcaaggtcaagtgcacggcctactgttgatcggcggcccacctcgccgtcgccggtcgccacgcagcagtgagccagctgctgctgcgtctggtgctgtgtccgcgcgcgtcggtgagctgagtacgagttgcactgttgttaactgcagtgttatagcagtactagtactgcctgaactttatatagagataagggtaatgtgatgtgatgcgggctccatgttcggttaagatgctctgcttatgctgtgtaatcgtctacattatgctcctatacggctatacttatcgcaaagtttgcaggc

SEQ ID NO: 12558 - protein, 171 aa, Panicum virgatum
  misc_feature: Ceres CLONE 1763888
  misc_feature (9)..(159): Pfam Name: GRP Pfam Description: Glycine rich protein family
MAAAAPRHAALLALLLLGLLSTAALAARAGGAVDADLVTSTKKPAPAGPGGKKPAVRPPPAVPNPGGAGGAIPTIPGFGGGIPGMSGFGNGIPGMAGGWGGGYGGPAGGYARGGVVAPTVTCTDKGPCYRKKVTCPKKCFSSYSGAGKGYGGGGGGGSCTVDCKVKCTAYC

SEQ ID NO: 12559 - DNA, 757 bp, Panicum virgatum
  misc_feature: Ceres CLONE 1763918
  misc_feature: Encodes the peptide sequence at SEQ ID NO. 12560
accaccaggtcccgccgagcgccggctcagaagagggaaaaggagagagagagagagagagaagaaatcgatggcgacgggcggcggcgacaacggcggcgctgcgggcgacggcgagttctacctccggtactacgtggggcacaagggcaagttcgggcacgagttcctcgagttcgagttccgccccgacagcaagctccgctacgccaacaactccaactacaagaacgacaccatgatccgcaaggaggtcttcgtctccccctccgtcctccgcgaggccaggaggatcatccaggagtccgacattatgaaggaggacgacagcaactggccggagcccgaccgcatcggccggcaggagctcgagatcgtcatgggcaacgagcacatctccttcaccacctccaagatcggctccctcgtcgatgtccagtccagcaaggaccccgagggcctccgcatcttctactacctcgtccaggatctgaagtgttttgtgttttcgctcatcaacctccacttcaagatcaaaccaattcagtcctgagctccattccatgctgttccgtgactgtgttatgaaactgcgagtgtttaagagagaaccctgtaccatgtaagatcctatttagcttgtgatgatgcactcgggttgtgtggagcattgggtggaagtggaactttgagtttgcctgagattgctgtttggatgtgcaaactgcgagtaatgatatttatgcttctttccttg

SEQ ID NO: 12560 - protein, 160 aa, Panicum virgatum
  misc_feature: Ceres CLONE 1763918
  misc_feature (16)..(158): Pfam Name: Mago_nashi Pfam Description: Mago nashi protein
MATGGGDNGGAAGDGEFYLRYYVGHKGKFGHEFLEFEFRPDSKLRYANNSNYKNDTMIRKEVFVSPSVLREARRIIQESDIMKEDDSNWPEPDRIGRQELEIVMGNEHISFTTSKIGSLVDVQSSKDPEGLRIFYYLVQDLKCFVFSLINLHFKIKPIQS

SEQ ID NO: 12561 - DNA, 740 bp, Panicum virgatum
  misc_feature: Ceres CLONE 1763925
  misc_feature: Encodes the peptide sequence at SEQ ID NO. 12562
atcgttcacagtcacagctccacaaacgaagcactgcaaactcaaatcacagctctccagcttccattcaggaagaaaaagagaagggtcagaggaccaaccatgatcagcgccaagaggatcgctcagctggccaagaagtggcagaggatggcggcgctcgggaggaagcgcctcgcctggcttaaggaggaagccgaccactgctgcacatccgtggcgagcaagggccactgcgcggtgtacacggccgacggggcgcggttcgaggtgccgctggcgtgcctcggcaccgcggtcttcgcggagctcctgcggatgtcgcaggaggagttcggcttcgcgggcggcgacgacggcaggatcacgcttccctgcgacgcggcggtgatggagtacgccatgtgctttctcaggagaggcgcctctgccgagctagagcaggcgttcctgagcaccatagcgatgccgtgccactatgcgagccgtgtggcgccgcacgtagaagccagccggcaggttgctgtctagagttgcagttcagtgtatgtatagtagggcaaagataggtgttcttcagcgccttctgatcctgcagcgatcaaggtgttaaaagtaccaagaagttccttttcaaaagaaaatgcaagaagttagagaagccattgttatcatattctttgtacataagttttactgtgggtatcagagatatatgggtaatcacattgctaggactt

SEQ ID NO: 12562 - protein, 142 aa, Panicum virgatum
  misc_feature: Ceres CLONE 1763925
  misc_feature (7)..(105): Pfam Name: Auxin_inducible Pfam Description: Auxin responsive protein
MISAKRIAQLAKKWQRMAALGRKRLAWLKEEADHCCTSVASKGHCAVYTADGARFEVPLACLGTAVFAELLRMSQEEFGFAGGDDGRITLPCDAAVMEYAMCFLRRGASAELEQAFLSTIAMPCHYASRVAPHVEASRQVAV

SEQ ID NO: 12563 - DNA, 932 bp, Panicum virgatum
  misc_feature: Ceres CLONE 1763928
  misc_feature: Encodes the peptide sequence at SEQ ID NO. 12564
gcgacacgggcggcgaatcagatcacccccttcctccgcgcacctaccatccgggatcgcgaggtgggtttggaaccccgcggttgcgggtcaagtcaggttgtcttggtcccgtcctcgcgccggctccccttgccggccgaatcgctcccgctccgtccccagggagcattttgtttcagtggtgtgcaagctttgttgattggagttcgcaatgggaggctgtgcggggaaggcacgccgtgaagaggaagataagcttgatttcaaaggtggagatgtgcatatcataacaaccaaagagggttgggatcagaagattgcagaagcaaacagagatgggaaaaccgttgtggcaaatttcagcgcttcctggtgtggaccatgccgtgtcattgctccggtctatgctgagatgtcaaagacttatcctcaactcatgttcttgacaatagatgttgatgacttgatggatttcagctcctcatgggatatccgtgcgaccccgacgttcttcttcctcaagaacgggcagcagatcgacaagctggtcggcgctaacaaacctgagctcgagaagaaagtgctagcagccgccggtggcagttcgagcaagtgacagggaactggacaagcttgggctatctacagcttgtctctcattgttccgatagtttcccgatgtatagtttcctgtgtctgtgtgcaagtctgtgttgtcagagatgatgctttacaattttgccggtatgcctggtctcgcacatactcaagctgttaagttatgtgaacctgtgcttgccaaaagaccgagataaaggggggaaaacccagtaatgtgaagcagctcttgacttaagagttttgcaacacaatattggtggatggtgatgtgcttggttggggaaaatgttgtgggtcgtttcattttg

SEQ ID NO: 12564 - protein, 134 aa, Panicum virgatum
  misc_feature: Ceres CLONE 1763928
  misc_feature (22)..(127): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MGGCAGKARREEEDKLDFKGGDVHIITTKEGWDQKIAEANRDGKTVVANFSASWCGPCRVIAPVYAEMSKTYPQLMFLTIDVDDLMDFSSSWDIRATPTFFFLKNGQQIDKLVGANKPELEKKVLAAAGGSSSK

SEQ ID NO: 12565 - DNA, 1110 bp, Panicum virgatum
  misc_feature: Ceres CLONE 1763939
  misc_feature: Encodes the peptide sequence at SEQ ID NO. 12566
atcacgagtgcaaagaatcccctcgatcagaagaaaaaaacaagagaaaccaggcgaaaaatccaatctttccctcgattcagctctcgattccgcggagagaggagccatgaccgagtccgccaacaacgacgccccgatcgccaccaacaaccagcccaccgcggaggaggtgacggttgagagggcggcgacccagcaggaggaggaggaggagaggctgcggtacctcgagttcgtgcagcaggcggcggcgcaggcgctggtgctggcggccgcggcctacgcgtacgccaagcagggcgccgggccgctccgccccggcgtcgaccacgtcgagggcaccgtcaaggccgtcgtcgggcccgtctacgaccgcttccacgccgtcccgctcgacctcctcaagttcctcgaccgcaaggttggcgagtccgttgaggagattgaccgacgtgtccctccagtggtgaaggaagcccccaccctcgcccgctctgctgccaaggaggtccgtcaagctggtctggtgggcacagccactggcctcgcaaagtcggccatcgaccgtgcagagcccaaggccagggagctctacacccgctacgagcccgtggctgagcgccgcgcagctgaggcctgggtggccctgaaccgcctcccactggtgccctcggtgaccagggtggtcctccccactgctgcgcagctgtcggccaagtacaactcagcagtgatggacggcgccaagcgtgggaacactgtggcaacctacctcccgctggtgcccaccgagcggcttgccaaggtgttcaggtaccccatggcggacgccgccccagcgcctgagatgcagcccatcccgtcccagtagaagatgggaggggaacctctctgaactgcatcatcaattatcaaatatagtagcgtctttgctgtagcgagtactcaaaaaagtctttcgtatgtgatgaattgatgataaggtgcgtgtgtggtggcttggttatgttggtccgctattgtggtgatgcaccttgtctgaagtctgaagtgtttgtgaaccctgatgtgtatattgatggctattatgttaccgttgtcaagtag

SEQ ID NO: 12566 - protein, 254 aa, Panicum virgatum
  misc_feature: Ceres CLONE 1763939
  misc_feature (29)..(239): Pfam Name: REF Pfam Description: Rubber elongation factor protein (REF)
MTESANNDAPIATNNQPTAEEVTVERAATQQEEEEERLRYLEFVQQAAAQALVLAAAAYAYAKQGAGPLRPGVDHVEGTVKAVVGPVYDRFHAVPLDLLKFLDRKVGESVEEIDRRVPPVVKEAPTLARSAAKEVRQAGLVGTATGLAKSAIDRAEPKARELYTRYEPVAERRAAEAWVALNRLPLVPSVTRVVLPTAAQLSAKYNSAVMDGAKRGNTVATYLPLVPTERLAKVFRYPMADAAPAPEMQPIPSQ

SEQ ID NO: 12567 - DNA, 1083 bp, Panicum virgatum
  misc_feature: Ceres CLONE 1763991
  misc_feature: Encodes the peptide sequence at SEQ ID NO. 12568
gtcacgaacccaacccaaccccatcagagcccatcttgcgacccgggaccagaccaatcagggcggctctccgacgcggcggcgaccacagagagggagcggggtcgaggccggccgtgggatcgtcggcggggcggggagaaagcgcgcgcgcggcggatgtcccgcggcggcggggactagggcgacggcggcggcggggaccgggaccgggtgctgcggcggcgcgacgaggcggcggcgcgggagggcggcggcaccatgtctgcggtagtctgtggcaagaggtcatcctccaagagctagccaatcaagccgatcgatggccatggccacgcaagcctccgccgcgacgcgccacctgctggcggcggcgtggtcgccggcggcgaaggcgccgcggccgtcgcagctcgcggtcccgtcgtcctcccgcgggccggccccgctccgcgcggccgccgaggaggccgcggcggcgaccgaggaggcgcccaaggggttcgtgcccccgcagctggaccccaacacgccgtccccgatcttcggcggcagcacgggcgggctgctccgcaaggcgcaggtggaggagttctacgtgatcacgtggacgtcccccaaggagcaggtgttcgagatgcccacgggcggcgccgccatcatgcgggaggggcccaacctcctgaagctggcgcgcaaggagcagtgcctggcgctgggcaccaggctgcgctccaagtacaagatcaactaccagttctaccgcgtcttccccaacggcgaggtccagtacctgcaccccaaggacggcgtctacccggagaaggtcaacgccggcaggcagggcgtcggccagaactaccgcagcatcggcaagaacgtcagccccatcgaggtcaagttcaccggcaagagcaccttcgacctctgatgtgttaattactgctagctgttgggttcgtggttgatggatctgaaggctcggtcgatgtgtaattttactatcaagcttttcttggtgattgtggagaggtgatacatggaatcccttaattaattatatgatgtacatgtttatttggt

SEQ ID NO: 12568 - protein, 202 aa, Panicum virgatum; identical to SEQ ID NO: 10188
  misc_feature: Ceres CLONE 1763991
  misc_feature (64)..(201): Pfam Name: PsaD Pfam Description: PsaD

SEQ ID NO: 12569 - DNA, 758 bp, Panicum virgatum
  misc_feature: Ceres CLONE 1764008
  misc_feature: Encodes the peptide sequence at SEQ ID NO. 12570
cgacgtggcccgctccgagccccccaccctcccgggcacccaggcagccgacggcgagggcaccccagatcctcccagcccacgatggccgccggacgcccccagggcgcccccgggagccgggagacggtctgcgtgacgggcgccggcgggttcatcgccccgtggctcgtcaagctcctcctcgcccgcggctacgccgtccacggcaccgtccgcgacctgggaggtcctgatcgaataaggaacaaactttggcacatcgttgacgtccgggacaccgcagatgctcttttgctggtgtatgagacacctgaagcctccggtaggcacatctgcgcacctcatttcatcagcgcccgtgaccttctggacttactgaagagcatgtacactgagtaccctttcatgagcaaggagagcatctgtgacatggatcacccagctccaatgacgtctgacaagctgaagaaactggggtggaaggtcaggctgttgaaggaaactatcgcggataccgttgaattctgccagaacgctgggtttcttgaggatgtggaggggagtccctgccgttttcctgatatttacaacaaaatctagcttaagaaagaatctagggccggaggaagcacacgtgtggcaactgtttcgcttcagctgctgcttgatgcttactgtattgttgagcagcaggaatatttttttttcccaataatatgttttcctgccctctgatttcaactatgagaaccccc

SEQ ID NO: 12570 - protein, 172 aa, Panicum virgatum
  misc_feature: Ceres CLONE 1764008
  misc_feature (12)..(57): SWISSPROT Homolog: EC 1.1.1.219 Dihydrokaempferol 4-reductase
  misc_feature (61)..(156): SWISSPROT Homolog: EC 1.3.1.77 Anthocyanidin reductase
  misc_feature: Useful for making plants with altered carbohydrate content
MAAGRPQGAPGSRETVCVTGAGGFIAPWLVKLLLARGYAVHGTVRDLGGPDRIRNKLWHIVDVRDTADALLLVYETPEASGRHICAPHFISARDLLDLLKSMYTEYPFMSKESICDMDHPAPMTSDKLKKLGWKVRLLKETIADTVEFCQNAGFLEDVEGSPCRFPDIYNKI

SEQ ID NO: 12571 - DNA, 966 bp, Panicum virgatum
  misc_feature: Ceres CLONE 1764013
  misc_feature: Encodes the peptide sequence at SEQ ID NO. 12572
atcacttcatcagggacagccagcgcacgcaaacgtacgcctacctcgtcgagccaacgcagaggcccagcccgatagaagcaacgaagccaacgaggccaccagccatggccgcggcaactccccgccacgccgcgctcctgctcgccctgctgctgctcggtctcctctccaccgccgccctcgccgcgcgcgccggcggcgccttggacgccgagctcgtcacgtccaccaagaagcccgcccccgcggggcccggcggcaagaagcctgccgtcaggccaccgcccgcggtgcccaaccctggaggcgccggcggcgcgatcccgaccatcccgggcttcggcggcggcatccccgggatgagcgggttcgggaacggcatccccgggatggccggcgggtggggcggcggctacggcgggccggcgggcgggtacgcccgcggcggcgtggtggcgcccacggtcacctgcaccgacaaggggccctgctacaggaagaaggtcacctgccccaagaagtgcttctcctcctacagcggcgccggcaagggctacggcggcggcggcggcgggggcagctgcaccgtcgactgcaaggtcaagtgcacggcctactgttgatcagcggcccacctcgccgtcgccggtcgccacgcagcagtgagccagctgctgctgcgtctggtgctgggtccgcgcgcgtcggtgagctgagtacgagttgcactgttgttaactgcagtgttatagcagtactagtactgcctgaactttatatagagataagggtaatgtgatgtgatgcgggctccatgttcggttaagatgctctgcttatgctgtgtaatcgtctacactatgctcctatacggctatacttatcgcaaagtttgcaggcaatgtccgtgtgaaatctactatggatcaataaagagttttgtaatggctgccttctcttctt

SEQ ID NO: 12572 - protein, 172 aa, Panicum virgatum
  misc_feature: Ceres CLONE 1764013
  misc_feature (14)..(160): Pfam Name: GRP Pfam Description: Glycine rich protein family
MAAATPRHAALLLALLLLGLLSTAALAARAGGALDAELVTSTKKPAPAGPGGKKPAVRPPPAVPNPGGAGGAIPTIPGFGGGIPGMSGFGNGIPGMAGGWGGGYGGPAGGYARGGVVAPTVTCTDKGPCYRKKVTCPKKCFSSYSGAGKGYGGGGGGGSCTVDCKVKCTAYC

SEQ ID NO: 12573 - DNA, 773 bp, Panicum virgatum
  misc_feature: Ceres CLONE 1764028
  misc_feature: Encodes the peptide sequence at SEQ ID NO. 12574
acaccagccaatcgcccctctcgctccctccctcttatcccctctcctcggctccgccagctccgcgctcgtcgtcattgccccgctgctgtgttgccgccgccgccgccttcctcgtcgtcccctggcagccggcagctagcagcgatggccctgcaggctccggcgtcgtccctggcgcgcgcgccggcggcgccgctccggtcgtcgttctcggcgccgtggccggcgctgcggctgccggcgcccgcgcggcggcgggcgggcgccgcggccgcgcggatcaccatgcgggtcgcgtccaagcaggcctacatctgccgcgactgcgggtacatctacaacgacaggaccccgtttgagaagctggccgacaactacttctgccccgtttgtggagctccaaagaggaggttcagaccataccagccggcggtgtccaagaacgcgaatgctaccgatgcccgcaaggcgaggaaggagcagctgaagaaggacgaagcaatcgggcaggccttgccgatcgccattgtcgccgggatcatcgctctggccggcctctacttctacctcaacaacgcctacaactagaggaacaaacacgcttcagagacgaccaatcaatttggttccagggacaggattctttacattttgccctttgtttttgtggctgtacatgtgtgcgtcatgctacatgcatactactagggatccaacctccaagactgttatacaactcgtcgttaatcttgaaatgccatacgttacac

SEQ ID NO: 12574 - protein, 147 aa, Panicum virgatum; identical to SEQ ID NO: 10271
  misc_feature: Ceres CLONE 1764028
  misc_feature (55)..(90): Pfam Name: Rubredoxin Pfam Description: Rubredoxin

SEQ ID NO: 12575 - DNA, 743 bp, Panicum virgatum
  misc_feature: Ceres CLONE 1764031
  misc_feature: Encodes the peptide sequence at SEQ ID NO. 12576
agcgccgcacccgcacactcgcgccgccgcccagccgcaggaagggggaggaggaggaggaggaagatgccggcagggcacgggctgcggtcgcggacccgcgacctgttcgcgcggccgttccgcaagaaggggtacatcccgctcacgacctacctccgcaccttcaagatcggcgactacgtcgacgtcaaggtgaacggcgccgtgcacaagggcatgccacacaagttctaccacggccgcaccgggcgcgtctggaatgtcaccaagcgcgccatcggcgtcgagatcaacaagcaggttaatggacgcatcatcagcaagcggatccatgtccgtgttgagcatgtgcagccatcaagatgcacggaagagttccgcctgcggaaggccaagaacgaccagctcaaggcggatgccaaggcccgtggtgaggtgatcagcaccaagaggcagcccttgggtcctaagcctggcttcatggtcgagggtgctacaattgagacagtcactcctattccttatgatgtggtcaatgacctcaagggtggttactagagagaacggttgtatcttgatcagttcaagcgacctagcatcaatgcttatctgaatctttttttggtactggctagttctttttttgttcgctggatgctggtgttataaacctatgtggttattactggttaacattaaagattttgctatggttgattgcatctggttaccctccagct

SEQ ID NO: 12576 - protein, 164 aa, Panicum virgatum
  misc_feature: Ceres CLONE 1764031
  misc_feature (2)..(100): Pfam Name: Ribosomal_L21e Pfam Description: Ribosomal protein L21e
  misc_feature: Useful for making plants with modulated flowering time
MPAGHGLRSRTRDLFARPFRKKGYIPLTTYLRTFKIGDYVDVKVNGAVHKGMPHKFYHGRTGRVWNVTKRAIGVEINKQVNGRIISKRIHVRVEHVQPSRCTEEFRLRKAKNDQLKADAKARGEVISTKRQPLGPKPGFMVEGATIETVTPIPYDVVNDLKGGY

SEQ ID NO: 12577 - DNA, 1010 bp, Panicum virgatum
  misc_feature: Ceres CLONE 1764050
  misc_feature: Encodes the peptide sequence at SEQ ID NO. 12578
atttttctccacaggagcggccgtccaggtccagtccagattcgctccgactcgccatccgcatcagctgccaaatttccccacctcgccgactgtcacaacagcaatggcgactccaccatcaccgatcatccgctgcctcctcctcctcctcgtcaccttcccctctcacccgcgggctacggctgccgaggggcctgcgccgctgtcctcctccccgttcgacgccgcgttggcgaagctccaggcgcggatcggctacgccttccgcgcgccggacctcctccgccgggccatgacccacgcctcctactcccgcgagaacggccgcgcgctcgccgtcctggacctcaccgccgcccagtccgccgcggcgctcggcgccctcaccgccgacaacgacgccgcggcctccgcagtgtcgcgccgcgccagcgaggcggcctccgagaccgcttgcgccgctgcggggacgcacgtcgggatcccggccatcgtgcgcgtcgctagccgcaccagcgcgtccgcggcacccgtcgtctgcggcgcgcttcgggcgctcatcggcgccgtcgccgtcgacgcaaatagcacggacgccgccgtggaggtgttctggaggctgcacgtgctcacagctgctgctgccgccgccgccatgtgaggtggccgggattatcttccagcagcaggcagcagctaccttctagtaatctacgagtattactggactagtgtggatggatttgcaccttcatcagtgttctactagcacgtttctgttgtgtttttagtttagtgattgctcctcaactctcctcttattattatgatgttcaactgctacttactaggctctactacatctactggtagtatgctatgctccaaccaggaagcagaaatgtccatttggatttctggctgcaacaaaatgtcaccaaatatgctgtacaaatattctgtcgccagaaactatgagcaattgagtaacaatcaatgtcacactc

SEQ ID NO: 12578 - protein, 185 aa, Panicum virgatum
  misc_feature: Ceres CLONE 1764050
  misc_feature: SWISSPROT Homolog: EC 3.1.26.3 Ribonuclease III
MATPPSPIIRCLLLLLVTFPSHPRATAAEGPAPLSSSPFDAALAKLQARIGYAFRAPDLLRRAMTHASYSRENGRALAVLDLTAAQSAAALGALTADNDAAASAVSRRASEAASETACAAAGTHVGIPAIVRVASRTSASAAPVVCGALRALIGAVAVDANSTDAAVEVFWRLHVLTAAAAAAAM

SEQ ID NO: 12579 - DNA, 761 bp, Panicum virgatum
  misc_feature: Ceres CLONE 1764088
  misc_feature: Encodes the peptide sequence at SEQ ID NO. 12580
acgaaggctactggaagcctagaagtgccctcctctccggcgccttctcctcagatccccagctgataccgccgaccaaccaggatcgtggatccatggaggcgaagatggggcgcttcttcgagtcggtgggcaacttcttcaccggcggcgacaacatcccctggtgcgaccgcgacatcatcgccggatgtgaaagagagcttgccgatgctgcaactgaagagcagaggaatgctagccttatgaggctttcttgggcccttgtgcactccaggcagacggacgatgtaaatcgtggaattagcatgcttgaagcttctttggatagttctggcagccctctggagactagggaaaagttgtacttgttggctgttgggcattacaggaatggtgactactcaaaaagccggcaacttgtggaacgctgtttgcagattcaacctgattggaggcaggctattactctgaaagctatagaagataaaattgccaaagatggtcttattggaataggaatcgcgacaactgctgtgggacttctggttggtggaattgcagctgctgttgctagaaagaagtaagatgaatggatggtgtctctgctctgctcaccgatgaacaaggagatgcgttcggctattctggggctaaactggtgatacttgagtcgaattgaaatggattttatgtgtacaaagtaagtagatgataatactattgagacaatctagcctctactattcagttttttgccc

SEQ ID NO: 12580 - protein, 163 aa, Panicum virgatum
  misc_feature: Ceres CLONE 1764088
  misc_feature (87)..(120): Pfam Name: TPR_2 Pfam Description: Tetratricopeptide repeat
MEAKMGRFFESVGNFFTGGDNIPWCDRDIIAGCERELADAATEEQRNASLMRLSWALVHSRQTDDVNRGISMLEASLDSSGSPLETREKLYLLAVGHYRNGDYSKSRQLVERCLQIQPDWRQAITLKAIEDKIAKDGLIGIGIATTAVGLLVGGIAAAVARKK

SEQ ID NO: 12581 - DNA, 1028 bp, Panicum virgatum
  misc_feature: Ceres CLONE 1764105
  misc_feature: Encodes the peptide sequence at SEQ ID NO. 12582
actcgccgcctccccccctcccccccgcgtcgccgtcgtctcccgttcggaacgccaagctccactccggcgaaatggccccgaagcgaggtggcaaggcgccggtgccggccaagaagaaaacagagaagattaccaacccgctctttgagaagaggccgaagcagttcggtatcggcggtgcgcttccgcccaagaaggacctgcaccggttcgtcaagtggcccaaggtcgtgcgcatccagcgccagcgccgtatcctcaagcagcgcctcaaggtgccgccggcgctcaaccagtttacccgtaccctcgacaagaacctcgctaccaacttgtttaagatgcttctgaagtaccgccctgaggacaaggctgccaagaaggagagacttttgaagagggctcaggctgagaatgaagggaaaaccgttgaggctaagaaaccaattgtcgtgaagtatggccttaaccatgtgacctacctcattgagcagaacaaggcccagcttgttgtcatcgcccatgatgtggatccgattgagcttgttgtgtggcttccagccctgtgcaggaagatggaggtcccttactgcattgttaaaggaaaggctcgccttggatcgattgttcacaagaagaccgcatccgtgctgtgccttaccactgtcaagaacgaggacaagcttgagttcagcaagatcttggaggctattaaggcaaacttcaacgacaagtttgacgaggtcaggaagaagtggggaggtggcatcatgggctccaagtcgcaggccaagaccaaggccagggaaaagctgctcgccaaggaggccgcccagcggatgacctagattatcttattctgagtcccgtctgtagttcctgtgccgacccggaaaagctgatgagcattgtgcactcgtattgtggtttctgaatctagtttcacatgttttcattcgccagaccatgtctagaaactttgcaagacaagagtttacagtgtttatgagatgttttgagcctcg

SEQ ID NO: 12582 - protein, 258 aa, Panicum virgatum; identical to SEQ ID NO: 10778
  misc_feature: Ceres CLONE 1764105
  misc_feature (113)..(208): Pfam Name: Ribosomal_L7Ae Pfam Description: Ribosomal protein L7Ae/L30e/S12e/Gadd45 family

SEQ ID NO: 12583 - DNA, 786 bp, Panicum virgatum
  misc_feature: Ceres CLONE 1764106
  misc_feature: Encodes the peptide sequence at SEQ ID NO. 12584
gcggagcccccccaaccctagccgccgggccgccgccgcttcttctcctcctcgcttgaaggcaggagcttgtgaagggtccatcagactgacaagatggttcttaagactgaactttgccgttttagtggccagaagatatatccagggaagggtattaggttcattcgtgctgattcccaggttttcctttttgctaactcaaaatgcaagcgatacttccacaaccgcctgaagcctgcgaagcttacctggacagctatgtacaggaagcagcacaagaaggacattcatgctgaagctgtcaagaagaggcgtcgcaccaccaagaagccatactcacgctcaattgttggtgccactttggaagttattcaaaagaagagaagtgagaagcctgaagttcgcgatgctgctagggaggctgctctacgtgagatcaaggagcgcattaagaagaccaaggatgagaagaaggccaagaaagcagaggtggcgaaatctcagaagacacaaactaagggtgcagcaccaaagggtcctaaaggccccaagatcggtggtggtggtgggaagcgctgaatgcccattgcatcatagagatatagttctgtcaactagccttctctccaatcctatcttagaccttggtcaagttagtctgccatcttgagtcttcacctatctgatgagattggtgtcctgaatgttttggattatttccggagttgatttacattggcacttatgtcaattattgttcagcaagttttgtcttcgattgcc

SEQ ID NO: 12584 - protein, 161 aa, Panicum virgatum
  misc_feature: Ceres CLONE 1764106
  misc_feature (3)..(73): Pfam Name: Ribosomal_L24e Pfam Description: Ribosomal protein L24e
  misc_feature: Useful for making plants with modulated nitrogen use efficiency
MVLKTELCRFSGQKIYPGKGIRFIRADSQVFLFANSKCKRYFHNRLKPAKLTWTAMYRKQHKKDIHAEAVKKRRRTTKKPYSRSIVGATLEVIQKKRSEKPEVRDAAREAALREIKERIKKTKDEKKAKKAEVAKSQKTQTKGAAPKGPKGPKIGGGGGKR

SEQ ID NO: 12585 - DNA, 624 bp, Panicum virgatum
  misc_feature: Ceres CLONE 1764125
  misc_feature: Encodes the peptide sequence at SEQ ID NO. 12586
caaagccggcggcgccgccggctcggccccgggcccgacggctgctgccgccgctgccgcggcgcagaagcagaagttgctgctgcagaaggccgatgccgacgtctccagcctcgtcgacaacttctccaacctcatcaacatcgcccgcgtcaacgacccacccgtgcgaaactcgcaggaggccttccagatggagatgcgcgcagcccgcatggtacattcagcagacactctgttgaaattggtgtcggaacttaagagaacagccatcttttccgggcttgcttcgttgaatgagaatgttgataggaggattgaggtgcttggtcagcaggcggagggaacagagagaatgctggagagaattgggcaggaggcggcagcaagcctcaaggagttagaggccaactactactcatccgttgtgcggtctccgtcctacgattaagggttgcctcagctggtagggccttgatttggaacagcacaataacttgtttaattgatattgtgtagaaatcactttgagctatcgattatagaacagctataatcatttctgaaggctgttgtactactctttgatggttgtactttcctgatgtgtgtgttgctattctt

SEQ ID NO: 12586 - protein, 149 aa, Panicum virgatum
  misc_feature: Ceres CLONE 1764125
  misc_feature (15)..(141): Pfam Name: SURF5 Pfam Description: Surfeit locus protein 5
KAGGAAGSAPGPTAAAAAAAAQKQKLLLQKADADVSSLVDNFSNLINIARVNDPPVRNSQEAFQMEMRAARMVHSADTLLKLVSELKRTAIFSGLASLNENVDRRIEVLGQQAEGTERMLERIGQEAAASLKELEANYYSSVVRSPSYD

SEQ ID NO: 12587 - DNA, 871 bp, Panicum virgatum
  misc_feature: Ceres CLONE 1764152
  misc_feature: Encodes the peptide sequence at SEQ ID NO. 12588
aaggcccaaatatatctcgccgcggcccaaagccctagccgccgtccgccgccttcttcgtcgccgtcttctcgagccctcggcgcgctgccttggaggaacgaggagcgccaccgcacagggcacatcccctacccgtaggaggtggctccaacttggtggcgtgggttcctgccggtgagccttggcagatggggagcgatggggaagggggaaaacgtgatatgtggattggttcctttagcttctgattttgatgcttgacgatggtggggtttaatcattagcatcaatgtttgatgctgcatgacaacgattagcatcgaacagcaatggcgaagcatcatcctgatctcatcatgtgccggaagcagcctggcattgcgatcggtcgcctgtgtgagaaatgcgatggcaagtgcgtcatctgcgactcatacgtgcgcccatgcacgcttgttcgggtctgcgatgagtgcaactacgactcattccagggaaggtgtgtgatctgcggaggagtcggcatctcagacgcctactactgcaaggagtgtacccagcaggagaaggaccgggatggttgtcccaagattgtcaatcttggaagcgccaagactgatctcttctacgagcggaagaagtacgggtttaagaagagatgattgagaggagggagttgctgggttctattgtgttctgccgcactgatactgaaagtaggctgctgaggcagcagcgttgtattcatgttatgatttgatattgatgtgagaatacacccctgatatgctttgtaataactggttcaactgtatggtctaagaccccaaagactacttaatgcatatgcaacttgtgcttggtggtt

SEQ ID NO: 12588 - protein, 110 aa, Panicum virgatum
  misc_feature: Ceres CLONE 1764152
  misc_feature (1)..(106): Pfam Name: PHF5 Pfam Description: PHF5-like protein
MAKHHPDLIMCRKQPGIAIGRLCEKCDGKCVICDSYVRPCTLVRVCDECNYDSFQGRCVICGGVGISDAYYCKECTQQEKDRDGCPKIVNLGSAKTDLFYERKKYGFKKR

SEQ ID NO: 12589 - DNA, 804 bp, Panicum virgatum
  misc_feature: Ceres CLONE 1764162
  misc_feature: Encodes the peptide sequence at SEQ ID NO. 12590
gaggcaagaaaccacggagcgtcttcctcctaccgtctataaattcccctccctttctccttccctatataggaggcatcgacgccaagaagagggaggagcaccaaggacttccggcgcctgttcaggatctacatcttcccgagcgagttcttggttgatctcttcctcttcgaccacctccaaggcccttggtgtagcttgccactctcgccagtcaagttttcatgtctgatcttggcattcagatcccaactgccttcgatccctttgctgaggccaatgctggggactctggtgcggcagcaggatcaaaggactacgttcatgtacgcagccagcagcgtaatggtcgcaagagtctgactactgtccagggattgaagaaggaattcagctacagcaagatcctaaaagatctcaagaaagagttctgctgcaatggtacagtggttcaggacccagagcttggacaggtcattcaactccagggtgatcagaggaagaacgtctcaaatttccttgtccaggccggcattgtgaagaaggaacatatcaagattcatggtttctgagcaaccgtcgggtctatagcaagccctgcatgcaaagcagctatatatccggggtggagcatatccggctgtgtaaaagcaggcctacgcctgtgcgttctactatacacataaaacctagccacctctctgcttgtatgcttgttaccattgtgtccaaacctgtacgaggcaccatcgttcgatggcttgcttctctatcagaaggttgaataaatgttatttcgct

SEQ ID NO: 12590 - protein, 115 aa, Panicum virgatum
  misc_feature: Ceres CLONE 1764162
  misc_feature (27)..(108): Pfam Name: SUI1 Pfam Description: Translation initiation factor SUI1
  misc_feature: Useful for making plants with modulated biomass
  misc_feature: Useful for making plants with modulated flowering time
MSDLGIQIPTAFDPFAEANAGDSGAAAGSKDYVHVRSQQRNGRKSLTTVQGLKKEFSYSKILKDLKKEFCCNGTVVQDPELGQVIQLQGDQRKNVSNFLVQAGIVKKEHIKIHGF

SEQ ID NO: 12591 - DNA, 760 bp, Panicum virgatum
  misc_feature: Ceres CLONE 1764163
  misc_feature: Encodes the peptide sequence at SEQ ID NO. 12592
gatgcgcacacactgcagatccttacccttactcccctgcgatcgagctgcttgctgtgatcgttcaatccccactccatctgaatccaatcccgtcaggtcagtctgcacggcaggccgcctccgctccgatcagccatggcgaacgcggcgtccggggtggcggtggcggaggagtgcacggcgcggttccaggagctgcgcacggcgcgcgcgcaccgcttcgtggtgttcaagatcgacgactccctggagcgggtggtggtcgacaaggtgggcgcccgggacgccggcttcggcgacctcaccgccagcctccccgccgacggctgccgctacgccgtgtacgaccacgacttcaccgtcggcgacgccaccgcgggcgaggggccgcgcagcaagatcttcttcgtgtcgtggtccccggcgacggcggacgtgaagagcaagatggtgtacgcgagctcctgcgaggggttcaagaaggagctggacggcgtgcagatcgacctgcaggccacggagcccagcgagctcaccctcgacgtcctcaacgaccacgtctcctgaacgattgatgctactccgtaataataataaacaagtacgcctacctgtgtacagcgtacgatacaagatgtgtacatgtgtgtatccatgtacgtacgggttgtcgtgtttggattctttcctgtggattggatgtgttcctgataaatacatgttgctgttacgtgcacgaataaattgacgattggcg

SEQ ID NO: 12592 - protein, 143 aa, Panicum virgatum
  misc_feature: Ceres CLONE 1764163
  misc_feature (12)..(143): Pfam Name: Cofilin_ADF Pfam Description: Cofilin/tropomyosin-type actin-binding protein
MANAASGVAVAEECTARFQELRTARAHRFVVFKIDDSLERVVVDKVGARDAGFGDLTASLPADGCRYAVYDHDFTVGDATAGEGPRSKIFFVSWSPATADVKSKMVYASSCEGFKKELDGVQIDLQATEPSELTLDVLNDHVS

SEQ ID NO: 12593 - DNA, 715 bp, Panicum virgatum
  misc_feature: Ceres CLONE 1764166
  misc_feature: Encodes the peptide sequence at SEQ ID NO. 12594
atcacagaggaagagcgagtggaaatcgaagcagcagcagcaatggcggcatccatgatcacgtcgtcagctctggtggcgccggccagggcccagggcctgccgtcccacggccgccgcgcctcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggaaccaccggacttctgatctggtccgtcaccctcgtcgggctccttgccggcggcgccctccttgtttacaacaccagcgccctcgccagctagcaacattattcatgcatagtccatgaaagcgcttgcggccggtccatatataagatttatcatcagcccgggtgtctgtgtgtaatctagcctgcagcttcgatgcccaatataatgcttggttcatgcaacaatgctactacggctctccatacttttggaacaattaattattatattacttcatgctatatatttagattaataactggtaactttatttctctgtgccttgcattgtgagcctttgtgaagaagatgatgctgatgctacttg

SEQ ID NO: 12594 - protein, 131 aa, Panicum virgatum
  misc_feature: Ceres CLONE 1764166
  misc_feature (35)..(131): Pfam Name: PsbR Pfam Description: Photosystem II 10 kDa polypeptide PsbR
MAASMITSSALVAPARAQGLPSHGRRASSFAVVCGTGKKIKTDKPFGIGGGLTVDHDASGRKVKGKGVYQFVDKYGANVDGYSPIYKEEDWSPTGDVYVGGTTGLLIWSVTLVGLLAGGALLVYNTSALAS

SEQ ID NO: 12595 - DNA, 526 bp, Panicum virgatum
  misc_feature: Ceres CLONE 1764181
  misc_feature: Encodes the peptide sequence at SEQ ID NO. 12596
attcttgagccaccttcttatgacatgaatccagtgcaagtacctgaaaactcagtttttgtaatgggagataaccggaacaacagttatgattcgcatgtgtggggccctcttccagcaaagaacatattggggagatcggttttccggtattggcctcctggtcgcataggtggtacagccaagggttgcctcaaccccgaactgagccctgagacaaagccaggatcacttattgatgtcaaattgaccaagtagaagttgatcaattagttatttttttcgcgaccgtgcctaagcacatttttcattaagaggaagaagaatgtgttacaagagggctcgactgcggaaaggagcccgcctgacacaaatacaaaagatcattacaccgtaattgttgcgcgacctgtgagcctgcctagagcggctaccgctaactccaactgtttgtacccggcttggtaccaagacataatctcctctatgaccctagacaataaatcatcgattgtttggactcggc

SEQ ID NO: 12596 - protein, 85 aa, Panicum virgatum
  misc_feature: Ceres CLONE 1764181
  misc_feature: SWISSPROT Homolog: EC 3.4.21.89 Signal peptidase I
ILEPPSYDMNPVQVPENSVFVMGDNRNNSYDSHVWGPLPAKNILGRSVFRYWPPGRIGGTAKGCLNPELSPETKPGSLIDVKLTK

SEQ ID NO: 12597 - DNA, 635 bp, Panicum virgatum
  misc_feature: Ceres CLONE 1764210
  misc_feature: Encodes the peptide sequence at SEQ ID NO. 12598
ctgacaaacttaccaaagctcgcggcggcttccttccacacccctccgccttgttcggctggcggattcagccagccacaacagtatttttctctcacacaaaatcaacccagtcaccaaccagccagccaacagtattttcctcccacgcgaaatcaaccagccatccagccagccgaacaagggtgcgtgctcgccccgagatctcgcccggccgccatggacgcgatcgactcggtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttctttgtcaagctcatcttcatccccatcaacaacatcatcgtcggttccggctagacctcgagtcccggagaaatgcagaacgagcgactagcatgggtgtagtgcaatacttttgaggagagcaaaggataacgaggtttttctcaaagtattgtaaaagacagtttctcatttgtgtttttggagtaatcctcatactgtttaagacttcaggatgcctgtatacccgattttgagtagacatgcactctgttcgtagc

SEQ ID NO: 12598 - protein, 69 aa, Panicum virgatum
  misc_feature: Ceres CLONE 1764210
  misc_feature (10)..(66): Pfam Name: SecE Pfam Description: SecE/Sec61-gamma subunits of protein translocation complex
MDAIDSVVDPLRDFAKDSVRLVKRCHKPDRKEFTKVAARTAIGFVVMGFVGFFVKLIFIPINNIIVGSG

SEQ ID NO: 12599 - DNA, 913 bp, Panicum virgatum
  misc_feature: Ceres CLONE 1764212
  misc_feature: Encodes the peptide sequence at SEQ ID NO. 12600
atctccctcttcgatcacacggacagggtgtggaggatccagtccggcaagctccggccgaccggccggccgtcgtcgtatgccagttgccagtatatttgatctggaagtatactagagcgagtgcggccggactggtcgttacgttcgccggcgatggacgcggaggagctcctgaagaggatacgggagctggaggagggccaggcggagctcaagcgggaggtgtccgacctcgtgacggcgacggagcaccgcgccaagcagcaacctgctgctgctgtgccgacggcgtcgcgccgggagctcaggcgggacgtgtccaagcatcagctcctcctgccgccgccggagcgccgcggcgcgcccagctcctcttcacggcgccgcctcccgccgccgccgccgcccgtgggccgcaccgggctgtcccgcaggcaccacgccatggtcctgcagtctctggggcaggccgtgcacatcctagatctccaggggaatgtcatctactggaaccgatgtgccgagcatctgtatgggtaccctgcatcagaagcaatcggtcgcaatgtcacggacctgctggtgcatgctgacgacattggcccatcaaccaacatcatcgggagcatattcgcagggaaatgctggagagggaagtttcctgtcaagaacaagtcaggggagaggttttcgattctcaccaatggcactcctctgtatgatgatgatggcaccatgcatgatcggcctcgtctgtctctcagatgatacacggaagctgcagcagatcgttggcttttcaccgacctcgggatactattattaaccaatgaattaatttcttttacatgtttgtaaacatgatttcgccgggtaatcttttttagaacatgggtggagtctcttgtgc

SEQ ID NO: 12600 - protein, 204 aa, Panicum virgatum
  misc_feature: Ceres CLONE 1764212
  misc_feature (94)..(198): Pfam Name: PAS Pfam Description: PAS fold
MDAEELLKRIRELEEGQAELKREVSDLVTATEHRAKQQPAAAVPTASRRELRRDVSKHQLLLPPPERRGAPSSSSRRRLPPPPPPVGRTGLSRRHHAMVLQSLGQAVHILDLQGNVIYWNRCAEHLYGYPASEAIGRNVTDLLVHADDIGPSTNIIGSIFAGKCWRGKFPVKNKSGERFSILTNGTPLYDDDGTMHDRPRLSLR

SEQ ID NO: 12601 - DNA, 513 bp, Panicum virgatum
  misc_feature: Ceres CLONE 1764234
  misc_feature: Encodes the peptide sequence at SEQ ID NO. 12602
aagaacaagaagcatactacagctctaactactctgacagctagctagccaatcagctgcctgcaggtgataagatcaaacagaaaaaaggagaggatgtcggactggggccccgtggtgatcgcggtggtgctgttcgtgctcctctcgccggggctgctcttccagctccccggccactgcagcttcgtcgagttcggcaacctgcacaccagcgccgcctccatcgtcgtccactccatcatcttcttcgcgcttatcaccgtcttcgtcatcgtcgtcggggtgcacatcaccaccggcgaccagcctgcctactagctacctgctcgtcgattggctcctccgatccttatttcctggagatagtcactaatactgctcctccaatgtagccacgcaatcttacgattctgcttttgtttctcaattattgttccccctttctttctttgcatgcatggctctgtactgtccttcagaaatatatatacataaactgcttcttttctt

SEQ ID NO: 12602 - protein, 74 aa, Panicum virgatum
  misc_feature: Ceres CLONE 1764234
  misc_feature: Useful for making plants with altered cell wall content and/or composition
MSDWGPVVIAVVLFVLLSPGLLFQLPGHCSFVEFGNLHTSAASIVVHSIIFFALITVFVIVVGVHITTGDQPAY

SEQ ID NO: 12603 - DNA, 744 bp, Panicum virgatum
  misc_feature: Ceres CLONE 1764246
  misc_feature: Encodes the peptide sequence at SEQ ID NO. 12604
accaaacaaccgcagcgagccaaaccaaaccgctcctcactctcccctagctccccagcagcagcagcagctcccaagcaagccaaggcggccatgagcgtggtgatcctggacggctcgacggtgcgcgccttcgtggcggacgaggcggcgttcgcgcgcagcgtggacgcgcgcttcgcggcgctggacgccaacggcgacggcgtgctgtcgcgcaccgagctccggcgcgcgctcgagtcgttccgcctcctcgacggcggcggcttcgggtccgccgcgccggcgccgctcccagccgaggtcgccgcgctctacgacgccgtcttcgagcagttcgacgccgaccacagcggcgccgtcgaccgcgccgagttccgcgacgagatgcgccgcatcatgctcgccgtcgccgaggggctcggctcgcagccgctccaggtcgccgtcgacgacgagggcggcagcttcctgctcgaggccgccgagcacgaggccgccgcgatcgccgccaaggtcgacgccgagcgcaaggcagaggccgacaccgccaataagtgacgcgtgccgcgtgggggcggtgccggtgccggtgggtgacccgtaaccttgtgctctgcgctgctcgctgtactgcttctagatgttggtgtgcttggacgtgtcagccgttgcgctgctacacttgtacgttaacagaaaaccggccggcggtggcgctcctcctgctgctgctgctgg

SEQ ID NO: 12604 - protein, 156 aa, Panicum virgatum; identical to SEQ ID NO: 12364
  misc_feature: Ceres CLONE 1764246
  misc_feature (24)..(52): Pfam Name: efhand Pfam Description: EF hand
  misc_feature (75)..(103): Pfam Name: efhand Pfam Description: EF hand

SEQ ID NO: 12605 - DNA, 787 bp, Panicum virgatum
  misc_feature: Ceres CLONE 1764264
  misc_feature: Encodes the peptide sequence at SEQ ID NO. 12606
agcgagtgagcaatggcaaccatcagcgccgccgcatccgccgccctcttccccgtcgccaggccgtctcagggtcacggggtgcctcagctgagagcaagggccggcaagatgcggtgcggcgcctgctccaagcagcaggacggcaacggcaagacgccggcggcggctccggccggcgcgtccctgctggccgcggcgagcgcgatgacggcatcgcccgcgctggcgctggtggacgagcggatgtcgacggagggcaccgggctcagcctggggctgagcaacaacctgctggggtggatcctgctgggcgtcttcggcctcatctggtccctctacaccgtctacacctccacgctcgacgagaacgaggactccggcggcctctccctgtgaaatccttttgatttccagcagtttacttcagccctgacctgtgcaagttcgacgctctgtgggtgcaactggaagtctgcaactgaagacatatggttgtatgcgactgtgattgggttgttgcatcggagatggtaatgacgagtacttagtagttggctttatggtggtttgagattgcacctatgaggctctgatgcatgaaagatgctgggcacacactgtactgtatgaagtttgatagcagtccgatttggttgctgagtgtcatagtgtggcatgagaaaagaaatattctagagtcgtgttgcaactaaactcagtttcatgcgactatgtgagtgttaatgttgccgatgtcaacatgaagcagagttaaagttatgtt

SEQ ID NO: 12606 - protein, 128 aa, Panicum virgatum
  misc_feature: Ceres CLONE 1764264
  misc_feature (1)..(128): Pfam Name: PsbW Pfam Description: Photosystem II reaction centre W protein, PsbW
MATISAAASAALFPVARPSQGHGVPQLRARAGKMRCGACSKQQDGNGKTPAAAPAGASLLAAASAMTASPALALVDERMSTEGTGLSLGLSNNLLGWILLGVFGLIWSLYTVYTSTLDENEDSGGLSL

SEQ ID NO: 12607 - DNA, 517 bp, Panicum virgatum
  misc_feature: Ceres CLONE 1764310
  misc_feature: Encodes the peptide sequence at SEQ ID NO. 12608
agcagtctcgctcgctcgctcgcctttctccacctcccccctcgtcgccgcggcgcccgccagctagggtttcgtgcccccgcgccccgatccgccatgtcgaagcaaggagggaaggccaaaccgctcaaggcgcccaaggtagacaagaaagagtacgacgagtctgatcttgcgtatctgcagaagaagaaagaggaggaaaaggcactgaaggatctgaaggccaaggcacagaagggtgcaatcggaggctctggcttgaagaaaagcgggaagaaatgagtctgttatgtgtatctgtgatacttgggaaatgataaacctcctgccaatatgtgtggtctttggccatatgtgattgtgacaaaactagtggttctgtgttagtaatgctgcagttggttgcttgatccgaaaagatgatgttggctatgatgcaggtggttctatgataataacaaggcattctaagatgttatctcaaattttcggtgctaattttgttttctttgcc

SEQ ID NO: 12608 - protein, 62 aa, Panicum virgatum
  misc_feature: Ceres CLONE 1764310
  misc_feature (1)..(62): Pfam Name: TMA7 Pfam Description: Translation machinery associated TMA7
MSKQGGKAKPLKAPKVDKKEYDESDLAYLQKKKEEEKALKDLKAKAQKGAIGGSGLKKSGKK

SEQ ID NO: 12609 - DNA, 741 bp, Panicum virgatum
  misc_feature: Ceres CLONE 1764314
  misc_feature: Encodes the peptide sequence at SEQ ID NO. 12610
tcggctcaagtgctggaggcctggagccccgaccaaatctcgcggcgactgccgactgctactccgaaccccggcggaagaccacgacctcgcttctgaagctctgatctccggccggtgcgaccccaggcgactcgaagatgcagcagggggacggcacggaggcgcaggtgacgtgggaggaccaacaggacatcaaccgcttcggccgcctcaacaaccgcctccacgagctccaggacgagatcaagctcgccaaggaagcaaatgaaaaccttgacgatgctgggaacgagctcatcttgtcagatgaagatgtggtacgcttccagattggggaagtgtttgcccacatgccaagggacgatgttgagactaggctggagcagatgaaagaggacgcggcgaagaagctggagaggctggaggaggagaaggaatccatcctcgcccagatggccgagctgaagaagatactgtacggcaagttcaaggatgccatcaacctggaggaggattagcagcgagtacttgagctgttgcccgtagcttgtgtaacagaagacagttgagcttcggaagcttttttacccatgatgcatgaactttggtgaagtgaatgatttgattcggagcgtgtgtatgaattgaagccgagtggccgtgagcctgggacatacgcggaagcaatgatctttctgtcagttttatttcactcgtgaagatcaccaaccttttttc

SEQ ID NO: 12610 - protein, 126 aa, Panicum virgatum
  misc_feature: Ceres CLONE 1764314
  misc_feature (16)..(120): Pfam Name: Prefoldin_2 Pfam Description: Prefoldin subunit
MQQGDGTEAQVTWEDQQDINRFGRLNNRLHELQDEIKLAKEANENLDDAGNELILSDEDVVRFQIGEVFAHMPRDDVETRLEQMKEDAAKKLERLEEEKESILAQMAELKKILYGKFKDAINLEED

SEQ ID NO: 12611 - DNA, 773 bp, Panicum virgatum
  misc_feature: Ceres CLONE 1764328
  misc_feature: Encodes the peptide sequence at SEQ ID NO. 12612
aaaccctcgcgctttgcccccatctccgccccgccgctgcagcgctccgcctccctccccctcgcacccgcaggctagggttctcctctagaggcggcgccatgttggtctaccaggatctgctcaccggcgacgagctgctctcggactcgttcccgtacaaggagatcgagaacggcgtgctctgggaggtcgagggcaagtgggtcgtccaaggagcagtggaggtgaacattggtgccaacccgtctgctgagggtggcgaggatgagggcgtagatgatcaggctgtgaaggttgtggacattgtcgacaccttccgtctacaggaacaacctgccttcgataagaagcagtttgtcacatttattaagcgctacataaaaaacctcacttccaagctggagctggagaaggctgatgagttcaagaagggcattgagggtgccaccaagtaccttcttggcaagttgaaggacctacagttctttgttggcgagagcatgcatgacgatgggagtctcgtgttcgcgtactacaaggaaggagccaccgacccgaccttcctctactttgcacatggcctgaaggagatcaagtgctaggtgcccctgaccatacgggtgttatcgtgttcttaatttgtgttcttaatttgtctgattttgttcgtattgtgctgagaaacattgtgctgagaaacggttgtcggcttttaccgccaaaagatactcttactttctggatgtgatctgttactccgtgtttctgtt

SEQ ID NO: 12612 - protein, 167 aa, Panicum virgatum
  misc_feature: Ceres CLONE 1764328
  misc_feature (1)..(164): Pfam Name: TCTP Pfam Description: Translationally controlled tumour protein
MLVYQDLLTGDELLSDSFPYKEIENGVLWEVEGKWVVQGAVEVNIGANPSAEGGEDEGVDDQAVKVVDIVDTFRLQEQPAFDKKQFVTFIKRYIKNLTSKLELEKADEFKKGIEGATKYLLGKLKDLQFFVGESMHDDGSLVFAYYKEGATDPTFLYFAHGLKEIKC

SEQ ID NO: 12613 - DNA, 702 bp, Panicum virgatum
  misc_feature: Ceres CLONE 1764334
  misc_feature: Encodes the peptide sequence at SEQ ID NO. 12614
gagccgcccattcgcgccgccgccgctcgccgccacccttcgcgccgccgccctcggttgtcgccgcccgcggccgctcgatccgatggctcccacgaagaagtcgaagaagagcacggagagcatcaacaacaagctgcagctggtgatgaagagcggcaagtacacgctcggctacaagaccgtcctcaagacgctgcgcaactccaaggggaagctgatcatccttgcgaacaactgccctccgcttaggaagtctgagatcgaatactatgccatgcttgccaaagttagcgtgcatcatttccatggaaacaatgttgatctcggcactgcctgcggcaagtactacagagtgtgctgcctcagtatcattgacccaggtgactcggacatcatcagcaccacccctggcgcccagtgagcaaagaagaggagcgagctttgcctatccctagttgagatgagatatagggctcagaccttgccaggccaatggccgtttcttgtttgtctttagtcttatgatgagttgatcttgcatacatacctcatatggttgttatgtatggcatatctatggttttgtttgatgagatcgtcataattattccgttgtctcatcgaagcgggtaacgtatatgtgatattgctgggtaacgctggttggctgtggttgcgttgcccagtaaacttggtacg

SEQ ID NO: 12614 - protein, 112 aa, Panicum virgatum
  misc_feature: Ceres CLONE 1764334
  misc_feature (12)..(106): Pfam Name: Ribosomal_L7Ae Pfam Description: Ribosomal protein L7Ae/L30e/S12e/Gadd45 family
MAPTKKSKKSTESINNKLQLVMKSGKYTLGYKTVLKTLRNSKGKLIILANNCPPLRKSEIEYYAMLAKVSVHHFHGNNVDLGTACGKYYRVCCLSIIDPGDSDIISTTPGAQ

SEQ ID NO: 12615 - DNA, 850 bp, Panicum virgatum
  misc_feature: Ceres CLONE 1764335
  misc_feature: Encodes the peptide sequence at SEQ ID NO. 12616
gtttcttcccccgttcccttctctcttggtcttcctttcacggcggcgcacgactgggcgagcggcggcgcaattcggtcttcgacgtgccctttgccggcgacgagcacccaccagccatgtcctacgctgggtccgcccccggagagaggcctaggactcgccctcatggcctcacccagcagaagaggcaggaaataaaggaagcctttgatctttttgatactgataactctggaaccatcgatgccaaggagctcaatgttgccatgagagccttgggattcgagatgactgaagagcaaatcaaccaaatgattgctgatgttgacaaagatggcagtggagcaatagactatgaggagtttgagcacatgatgactgccaaaatcggagaaagggatagcaaagaggagcttacaaaagcattccgcattatcgaccaagatagaaatggaaagatttcaaacattgatattcagcggattgccaaagagctgggtgtaaatctcacccttgaagagatccaggacatggtgcaaaaggcggatagaaatggtgacggtgagattgactttgacgagttcaccaggatgatgaggaggaccagctacggcgtccgtggcaggtgacggtgatgagttcaccaagatgacgaggaggaccagtaagcttgatttctgtgcgggcgctcgatgttgtgcagttgttctaaaggtaccgtttgtgctgttaatgtgttggctgctgtagtcactctgaagttgtgcttcacagtggcatatgatgttattagggccctgtttagatccgatcccgtaaaccccataaacgcaaaaaaaatcacatc

SEQ ID NO: 12616 - protein, 170 aa, Panicum virgatum
  misc_feature: Ceres CLONE 1764335
  misc_feature (135)..(163): Pfam Name: efhand Pfam Description: EF hand
  misc_feature (26)..(54): Pfam Name: efhand Pfam Description: EF hand
  misc_feature (62)..(90): Pfam Name: efhand Pfam Description: EF hand
  misc_feature: SWISSPROT Homolog: EC 2.7.11.1 Non-specific serine/threonine protein kinase
MSYAGSAPGERPRTRPHGLTQQKRQEIKEAFDLFDTDNSGTIDAKELNVAMRALGFEMTEEQINQMIADVDKDGSGAIDYEEFEHMMTAKIGERDSKEELTKAFRIIDQDRNGKISNIDIQRIAKELGVNLTLEEIQDMVQKADRNGDGEIDFDEFTRMMRRTSYGVRGR

SEQ ID NO: 12617 - DNA, 787 bp, Panicum virgatum
  misc_feature: Ceres CLONE 1764367
  misc_feature: Encodes the peptide sequence at SEQ ID NO. 12618
agaagcgaccgtccgtccggagctgcgcgcgaggcaaggccatccgccatgacgctctccctctccaccgccttcctccccacccccgtcgccgcgagggccacggcccgcaccctccgctccgtcgtcccgtcacaggtacgcgcgcgcgcgcgacccttcccctttcgcgattcccgcacgaatagccatcggcggcgccacttattcggagaccggaacctgggcggggcggtgcaggggatgcgctgctcgatgcgcaagaaggggctgcacccgcagatctacgaggacgcgaaggtgtactgcaacggcgagctggtgctggtgacggggggcaccaagccggagtacacggtggacgtgtggtccgggaaccacccctactacgtcggcgacacctcggcgctggtggtgatggacagccagatcgagaagttccgcaagaagtggggccacatcaaggagtactggcccgaggaccagtggagggagatgcaccccgacggcgacccggagttcgagcccgagggggacaactgatcgacggcgactcctcattcatcatcgtcttcctcctcctcttcttcccgccctcgcccggtgcgtggtcacggctcctgtttaccatgctctcttggttggaatttgagacttggcccgttcgcaatgctctccaggtgttcgattaatgttcgcaatgtaatcgtaccagtatgtgacggtgtcttgcttgtgcagtgcactctaatcttagtattcatatatgatcctgccgattgccacg

SEQ ID NO: 12618 - protein, 164 aa, Panicum virgatum
  misc_feature: Ceres CLONE 1764367
  misc_feature (70)..(138): Pfam Name: Ribosomal_L31 Pfam Description: Ribosomal protein L31
MTLSLSTAFLPTPVAARATARTLRSVVPSQVRARARPFPFRDSRTNSHRRRHLFGDRNLGGAVQGMRCSMRKKGLHPQIYEDAKVYCNGELVLVTGGTKPEYTVDVWSGNHPYYVGDTSALVVMDSQIEKFRKKWGHIKEYWPEDQWREMHPDGDPEFEPEGDN

SEQ ID NO: 12619 - DNA, 543 bp, Panicum virgatum
  misc_feature: Ceres CLONE 1764387
  misc_feature: Encodes the peptide sequence at SEQ ID NO. 12620
ttctcccacttgcagtcctccgtcccgcccgccgcgcgcgcttcagcttgggttggagatccgtgatccatggctgctgagttgaccatgcagactgttgtcctcaaggtgactatgtcatgcgagggttgcgccggggcggtcaggagagtgctctcaaagatggaaggagttgagacctttgacatagacctcaaggagcagaaggtgacagtcaaaggcaatgtcaagcctgaagatgtcttccagacggtttccaagtcggggaagaagacctcctactgggagggcgaatttttttcaccgtctgctccggctccagtagcagaagcagctctcagcaccgaggcagaagcgcctgccgcggaggctgcaccagagatcaccccagtcaagcctgacgcttgatcatcacatgagatgctgtgacccctaaaccttactctagaactagctgggaaaaccgagtcttgtgcgatttgcatcatgttgttgccactctagcaagtgattgcgaattataaaataaatgatgaaacccag

SEQ ID NO: 12620 - protein, 112 aa, Panicum virgatum
  misc_feature: Ceres CLONE 1764387
  misc_feature (10)..(71): Pfam Name: HMA Pfam Description: Heavy-metal-associated domain
  misc_feature: SWISSPROT Homolog: EC 3.6.3.4 Copper-exporting ATPase
MAAELTMQTVVLKVTMSCEGCAGAVRRVLSKMEGVETFDIDLKEQKVTVKGNVKPEDVFQTVSKSGKKTSYWEGEFFSPSAPAPVAEAALSTEAEAPAAEAAPEITPVKPDA

SEQ ID NO: 12621 - DNA, 700 bp, Panicum virgatum
  misc_feature: Ceres CLONE 1764411
  misc_feature: Encodes the peptide sequence at SEQ ID NO. 12622
tggaaaacatgtgccatcggcagaatattgaacatttttttgttccagtcagcaatgcacatgaatgtcacagtaaggaggatcatcacagaggaagagcgagcggcaatcgaaacagcagcaatggcggcctccatgatctcgtcgtcagctctggtggcgccggccagggcccagggcctgccgtccctcggccgccgcgcctcctccttcgccgtcgtccgcggcaccggcaagaagatcaagaccgacaagcccttcgggattggcggtggcctcaccgtcgacgtcgatgcctccgggaggaaggtcaaggacaagggcgtgtaccagttcgtcgacaagtacggcgccaacgtcgacggatacagcccaatctacaaagaggaggactggtctcccaccggtgacgtctacgtcggtggaaccactggacttctgatctgggccgtcaccctcgccgggctccttgaaggcggtgccctccttgtttacaacaccagcgctctcgccagctaagaacactattcatgcacagtccatgcaagcacttgcagttcatgtaagatcagcttgggggtgtctgtctgtaatctagcctgcagctttgatgtccaatataatgcttggttcatgtaacaatgctactacggctctccatacttttgggacagttattatattaattacttgatgctac

SEQ ID NO: 12622 - protein, 131 aa, Panicum virgatum
  misc_feature: Ceres CLONE 1764411
  misc_feature (35)..(131): Pfam Name: PsbR Pfam Description: Photosystem II 10 kDa polypeptide PsbR
MAASMISSSALVAPARAQGLPSLGRRASSFAVVRGTGKKIKTDKPFGIGGGLTVDVDASGRKVKDKGVYQFVDKYGANVDGYSPIYKEEDWSPTGDVYVGGTTGLLIWAVTLAGLLEGGALLVYNTSALAS

SEQ ID NO: 12623 - DNA, 522 bp, Panicum virgatum
  misc_feature: Ceres CLONE 1764419
  misc_feature: Encodes the peptide sequence at SEQ ID NO. 12624
agctcgacaagcaaagtccacatccacgcacaagccaagcaatggctcgcgctcctcaggtggtggctatcgccgtggttgccgccgtcctggtgctcgccgccgcggcgaccaccaccgaggccgccgtgacctgcgggcaggtgacctcggccatcggcccctgcatcgcctacgcccgcggcagcggctccggccccacggcagcctgctgcagcggcctgaggaacctccacctcccggccacgagcaccgccgacaggtttttttcatgcaactgcctcaagtccgccccccgcagggtgagtggcctcaaacttggaaacgacgcaagcatcccgtccaagtgcggagtcagcatcccctacaccatcaacccaaacgtcgactgctccacggtgagctaaacgacgaccagtactcgtcactaccctatctacttaattatcgtctatgatccacctcgatgatgaccaataaaaatcactccgccgtcgcgtgcactgtcgtcatgcgcctagc

SEQ ID NO: 12624 - protein, 121 aa, Panicum virgatum
  misc_feature: Ceres CLONE 1764419
  misc_feature (32)..(117): Pfam Name: Tryp_alpha_amyl Pfam Description: Protease inhibitor/seed storage/LTP family
MARAPQVVAIAVVAAVLVLAAAATTTEAAVTCGQVTSAIGPCIAYARGSGSGPTAACCSGLRNLHLPATSTADRFFSCNCLKSAPRRVSGLKLGNDASIPSKCGVSIPYTINPNVDCSTVS

SEQ ID NO: 12625 - DNA, 999 bp, Panicum virgatum
  misc_feature: Ceres CLONE 1764430
  misc_feature: Encodes the peptide sequence at SEQ ID NO. 12626
agctgtccctctatccatccccttcacttcgtctcccaactcaaccattctccctgtgtcatcaccagcaacaggaagatgggctcgttagatgccacacgagctgaactcggcctcgttgttctgtacctgaacaaagccgaggctagggacaagatctgcagggcgattcagtatggctcaaagttcataagcaacgggcagcccggcaccgcgcaggatgtcgatagatcgaccaccttggctcgaaaagttttccgtctcctcaagtgggtcaatgatcttcatgctcttatcagcccgcctgctaaagggactcctctcacacttgtcctgcttggcaagtccaaaaacgcgctgctttcgacgttcttattcctggatcaatttgtgtggttaggacgaacaggaataatcaagaacaaggaggcgacggaccgggttgccaggatatccctctactgttggatggcttcttctgcctgcgctagtctagtggagcttggagagcttaagaggctatcgaaatcgatgaggaagcttgcaagagagctgaggcacactgataaatacgagaacgaacagtaccagaacaaaatgaagcagtcggatgagcggctcctggccctggtgaaggcggccatggacgtggtcgtggccatcgggcttcttcagctggcacccaagaaggtcacccccagagtgacgggagctctcggattcgtcacctcgctcatctcctgctatcagcaactcccttcccgtggccccgcggccaaagtcaaggcgtgagatgggtccgggtcctccctactatggaagtagccgtcgctggaaattgaggtagctatacttgagcatggaccgcacgataataatgtatatatatacgtatgtgccagtgtagaatacatggggtggcagtgctcctggctttatgctttcagcatgcgctactctttttttggttgcatggtaatggacatggttatgtcttgt

SEQ ID NO: 12626 - protein, 237 aa, Panicum virgatum
  misc_feature: Ceres CLONE 1764430
  misc_feature (11)..(226): Pfam Name: PEX11 Pfam Description: Peroxisomal biogenesis factor 11 (PEX11)
MGSLDATRAELGLVVLYLNKAEARDKICRAIQYGSKFISNGQPGTAQDVDRSTTLARKVFRLLKWVNDLHALISPPAKGTPLTLVLLGKSKNALLSTFLFLDQFVWLGRTGIIKNKEATDRVARISLYCWMASSACASLVELGELKRLSKSMRKLARELRHTDKYENEQYQNKMKQSDERLLALVKAAMDVVVAIGLLQLAPKKVTPRVTGALGFVTSLISCYQQLPSRGPAAKVKA

SEQ ID NO: 12627 - DNA, 734 bp, Panicum virgatum
  misc_feature: Ceres CLONE 1764434
  misc_feature: Encodes the peptide sequence at SEQ ID NO. 12628
acagcaaacaggtccggtgggcgccgcagcacctccacccaaaaaacgtgagcgcatccgccgccgaagccgccgcccgccgccagtgcgtgcttgctgcgaccgggcgttcgattgatcgggttgctagggtttagagggttttgggcgcggacaggcaggagattaggcggaggcgatggcgtcagcggaggaggagatcgcggtgaaggagccgctggatctgatacggctcagcctcgacgagcgcatctacgtcaagctccggtccgaccgcgagctccgcggcaagctccatgcatacgatcaacacttaaacatgatccttggtgatgttgaggaggttgtaacaactgttgagatagatgatgaaacatatgaagaaattgtgcgtacaacgaaacgcactatccccttcctttttgtccgaggtgatggtgtcatattggtttctccacccctgcgaactgcatgatgctagaagttagatggagctgattgccaactatttactctgtatttggccacttgatggcttggagtgtatgccatgtgctgcactgttactgttttctgatggattgtaggcttaacgagtgatacgatcatgtaactactgcctggtgtttaaatcttcagtcgaattattcttatgtgctgttctcagctaattcaacgcgcttgcataacagcctaagtgacttgagtaacgagttggcaagttacacattcat

SEQ ID NO: 12628 - protein, 98 aa, Panicum virgatum
  misc_feature: Ceres CLONE 1764434
  misc_feature (15)..(93): Pfam Name: LSM Pfam Description: LSM domain
MASAEEEIAVKEPLDLIRLSLDERIYVKLRSDRELRGKLHAYDQHLNMILGDVEEVVTTVEIDDETYEEIVRTTKRTIPFLFVRGDGVILVSPPLRTA

SEQ ID NO: 12629 - DNA, 844 bp, Panicum virgatum
  misc_feature: Ceres CLONE 1764438
  misc_feature: Encodes the peptide sequence at SEQ ID NO. 12630
gttcccttctgtcccctcacttggtcttcctttcccggcggcgagcggctgggcgagcggggcgtaattcggtgttcgacgggcccttcgccggcgacgagcacccaccagccatggcctacactgggtccgcccccggagagaggcctaggactcgccctcatggcctcacccagcagaagaggcaggaaataaaggaagcctttgatctatttgatactgataactctggaaccatcgatgccaaggagctcaatgttgccatgagagccttgggattcgagatgactgaagagcaaatcaaccaaatgattgccgatgttgacaaagatggcagtggcgcgatcgactatgaggagtttgagcacatgatgactgccaaaatcggagaaagggatagcaaagaggagcttacaaaagcattccgcattatcgaccaagatagaaatggaaagatttcaaacattgatattcagcggattgccaaagagctgggtgtaaatctcacccttgaagagatccaggacatggtgcaagaggcggatagaaatggtgacggtgagattgattttgacgagttcaccaggatgatgaggaggaccagctacggcgtccgtggcaggtgacggtgagactgactttgactgagttcaccaggatgacgaggactagtaaacttgatttctgcacgggtgctcgatgttgtgcagttgttctatagctaccgtttgtgctgttaatgtgtttgggtgctgtagtcactctgaagttctgcttcacagtggcatatgatgttattaggtgttctaaagactcgtataagaataaacactgataccccatc

SEQ ID NO: 12630 - protein, 170 aa, Panicum virgatum
  misc_feature: Ceres CLONE 1764438
  misc_feature (135)..(163): Pfam Name: efhand Pfam Description: EF hand
  misc_feature (26)..(54): Pfam Name: efhand Pfam Description: EF hand
  misc_feature (62)..(90): Pfam Name: efhand Pfam Description: EF hand
  misc_feature: SWISSPROT Homolog: EC 2.7.11.1 Non-specific serine/threonine protein kinase
MAYTGSAPGERPRTRPHGLTQQKRQEIKEAFDLFDTDNSGTIDAKELNVAMRALGFEMTEEQINQMIADVDKDGSGAIDYEEFEHMMTAKIGERDSKEELTKAFRIIDQDRNGKISNIDIQRIAKELGVNLTLEEIQDMVQEADRNGDGEIDFDEFTRMMRRTSYGVRGR

SEQ ID NO: 12631 - DNA, 696 bp, Panicum virgatum
  misc_feature: Ceres CLONE 1764444
  misc_feature: Encodes the peptide sequence at SEQ ID NO. 12632
atccagtactccagtatccacgaccacgcagcacctgcgactgcgagcacacagctgcttcggccccttctcagcgcgcgagcgttgcctgtgtgtgtgttgttcgtgagcaggcgcggcggcacggatggcgcagtccatgctcatgtcgacgagcgtcggcggcggccgcgcgctgccgtcactgcaggccggccggccggcgccgtacccgcggctcgcgctgccgtcagcatacaggcactccaggtccgtctccgtgaagaccctggccctcttcggcaagtccaaggccgcgccggcgaagaaggctcctgcgcccaaaccgaaggttgaggacgggatcttcggcacgtccggcgggatcggtttcaccaaggagaacgagctgttcgtcggccgtgttgccatgcttggttttgccgcatccctactcggagaggccatcaccgggaagggcatccttgcccagctgaacctggagacgggcatccccatctacgaggcggagcccctcctcctcttcttcatcctcttcaccctggttgtttgtggttgattgatcagtgcgtctctgcgcgtgtgcgtgcaactcgctgtgtattgcacgtgaggctttggaggttagggtgttgcgttgggttgtcttgtaaaacaagagcttatctaatatccaatggctgccggtgttctctt

SEQ ID NO: 12632 - protein, 143 aa, Panicum virgatum
  misc_feature: Ceres CLONE 1764444
  misc_feature: Useful for making plants with modulated light quality response
  misc_feature: Useful for making plants with modulated nitrogen use efficiency
MAQSMLMSTSVGGGRALPSLQAGRPAPYPRLALPSAYRHSRSVSVKTLALFGKSKAAPAKKAPAPKPKVEDGIFGTSGGIGFTKENELFVGRVAMLGFAASLLGEAITGKGILAQLNLETGIPIYEAEPLLLFFILFTLVVCG

SEQ ID NO: 12633 - DNA, 560 bp, Panicum virgatum
  misc_feature: Ceres CLONE 1764447
  misc_feature: Encodes the peptide sequence at SEQ ID NO. 12634
ggacgtcgccgcacacgtcaccggcgacttccgcaagcttttggtgcctcttgtaagtgcataccgctatgatggcccagaggtgaacacttcattggctcattctgaagccaaaatacttcatgagaatattcacaagaaggcttacagtgatgaggaggtcatcaggattctcaccacacggagcaaagctcagctacttgctacattcaatagctacaaggatcagtttgatcatccaatcaacaaggatctgaaagctgatcccaaggatgagttccttgcaaccctgcgggctatcattcgttgcttcacttgccctgacagatactttgagaaagtccttcggttggctcttggaggcatgggcacagacgaggatgatctcaccagggtcataactactcgcgccgaggtcgacctgaagctgataaaggaggcctaccagaaaaggaacagcgtgccgctggagcgtgcagttgctaaagatacaaccagagactatgaggatattctcctcgcactgctaggggcagagtgaggactgaggaggcgtgtct

SEQ ID NO: 12634 - protein, 179 aa, Panicum virgatum
  misc_feature: Ceres CLONE 1764447
  misc_feature (110)..(175): Pfam Name: Annexin Pfam Description: Annexin
  misc_feature (35)..(100): Pfam Name: Annexin Pfam Description: Annexin
DVAAHVTGDFRKLLVPLVSAYRYDGPEVNTSLAHSEAKILHENIHKKAYSDEEVIRILTTRSKAQLLATFNSYKDQFDHPINKDLKADPKDEFLATLRAIIRCFTCPDRYFEKVLRLALGGMGTDEDDLTRVITTRAEVDLKLIKEAYQKRNSVPLERAVAKDTTRDYEDILLALLGAE

SEQ ID NO: 12635 - DNA, 872 bp, Panicum virgatum
  misc_feature: Ceres CLONE 1764462
  misc_feature: Encodes the peptide sequence at SEQ ID NO. 12636
aaagtggttgcgcagacgacgacggcgaggcagaaccgaatccgatggcgctcccgctgcccctcctcctagtcgcgctgctcctgccggccgcccgcggagcggagacgccgcagtacacgacggtgcacgcggagtcggacttcgaggtgcggctctaccgcgacaccgtctggatgtccgcccctgcccccgacatcccctccttccacaccgccaccaagctcggcttccaccgattgttccaatacttgatgggcgcaaacctcaactcttccaggatcagaatgaccacccctgttcttacaagtgtggttccaggtgcagggcccctgcattcttcagcctactttgtccgtctctacttaccagtaaagttccaggcttcccctcctgttcctctcccagaactgaacctccacccagacagatggccaggccactgcattgcagtgaggagcttctcaggttatgcacgagacaacaacgtggttgaggaagctgagaagcttgctatgagcttgagccggtcgccctgggctaacttcccaaagtaccctagcaagaacgcgtactcgattgcacagtacagcagtccattccgcttcatcggccgtgtcaatgaggtgtggtttgatatcgactgcaagtctactggcgtggagacgtactgagaaccaagtgtactgcgcatcaatatcatgtaagctgtggaaaactttgtgtacatgtgtactttgtaatggtaacggtgaatgtcaaatgtagcacgtgcaactgtataaaatgtgtcacaagctcagctcagagtgatgttgcctgtgacttgggagtgtgtgattaacatgatgatgccactgatcgttctagtc

SEQ ID NO: 12636 - protein, 209 aa, Panicum virgatum
  misc_feature: Ceres CLONE 1764462
  misc_feature (19)..(200): Pfam Name: SOUL Pfam Description: SOUL heme-binding protein
MALPLPLLLVALLLPAARGAETPQYTTVHAESDFEVRLYRDTVWMSAPAPDIPSFHTATKLGFHRLFQYLMGANLNSSRIRMTTPVLTSVVPGAGPLHSSAYFVRLYLPVKFQASPPVPLPELNLHPDRWPGHCIAVRSFSGYARDNNVVEEAEKLAMSLSRSPWANFPKYPSKNAYSIAQYSSPFRFIGRVNEVWFDIDCKSTGVETY

SEQ ID NO: 12637 - DNA, 816 bp, Panicum virgatum
  misc_feature: Ceres CLONE 1764464
  misc_feature: Encodes the peptide sequence at SEQ ID NO. 12638
gctgctccgaagtccgacctactcctcctcctcctcctacccagcagcctccctaccctgtcgctctcacgcgcttcgtgctcgccgcctcccccacttccgcgtcgcgccccgcgccccatggcctccatcgccggatccgctctctccttcgccgggcccgtcaaggccgtcaacactagctcgctctctttctctgctgcgagaaagggcaatgcatatctccgcctgcagccagtgcagaagagattcgctgtttgctatgctgccaaaaaggatacagtggacaaggtttgtgaaattgtgaagaagcagcttgctgttcccgagggcactgaagtttgtggtgcctctaagttctctgatctcggtgcagattcacttgatacggttgagatcgtgatgggccttgaggaggagtttcaaatcagcgtcgaggaatcaagcgctcagtcaattgcgacagttgaggatgctgccgagctcatcgacaagcttgttgctgagaaatcgtcctgaagtcacaaggcgtgatgttggggacgaactcggaaactagttctaccttgttcctgccctgcccactcacaccatatctagaggtttctatgctctgtaggcttggcgattttctcagcattgttgtccactgtgtctgtaataataccgatatgattttaagctgttgaaccttacggtggtgcgcattctgtcagttcattgttgtatgaatggttcttcctggaagaaaaatggaatcctgggagcatgtagcaaagattgcctaattgatcgtgttggcttgttataatgagc

SEQ ID NO: 12638 - protein, 132 aa, Panicum virgatum
  misc_feature: Ceres CLONE 1764464
  misc_feature (56)..(123): Pfam Name: PP-binding Pfam Description: Phosphopantetheine attachment site
MASIAGSALSFAGPVKAVNTSSLSFSAARKGNAYLRLQPVQKRFAVCYAAKKDTVDKVCEIVKKQLAVPEGTEVCGASKFSDLGADSLDTVEIVMGLEEEFQISVEESSAQSIATVEDAAELIDKLVAEKSS

SEQ ID NO: 12639 - DNA, 666 bp, Panicum virgatum
  misc_feature: Ceres CLONE 1764471-R
  misc_feature: Encodes the peptide sequence at SEQ ID NO. 12640
gtttgaacagaacggagttagcaatggtagccaagaagacaaagcaaatgacagaaatggcgaaaggattggttacccaggcccctcaatcgaagaagctgatctcgaatggagatcgctgagcggtccattcgtttcggtttggcttggcaacgtccctttcgctagtgaagatgccatggcagcacccaaagcagagttctccgatgggtacctggatgcagctataatcagggactgcccgcggtgggacgtgcttgggctcctgttccagatgaaggacggcgcgtacgtgaactcgccgtacgtggagtacttcaaggtgaaggcgatccggatcgagccgggcctgcgcgtgggcggcagcgccaagggcggcatcatcgactcggacggggaggtgatcgcgcggggcgacgggccccgcggcggcgaggcggagcacctgatggcgtacggcccgcccatccagctgtcggtggaccaggggctggccaccatcttctccccgaggtcgagatgacacggctcttcttcaccatttattagtgatctccacttcattagccccgccattttattatctcgtttgttatagtactgtgtaaatactcacaccacaccacaatgcaagaagcaagagccaaggaggcaaggatgtctgtc

SEQ ID NO: 12640 - protein, 173 aa, Panicum virgatum
  misc_feature: Ceres CLONE 1764471-R
  misc_feature: SWISSPROT Homolog: EC 2.7.1.91 Sphinganine kinase
FEQNGVSNGSQEDKANDRNGERIGYPGPSIEEADLEWRSLSGPFVSVWLGNVPFASEDAMAAPKAEFSDGYLDAAIIRDCPRWDVLGLLFQMKDGAYVNSPYVEYFKVKAIRIEPGLRVGGSAKGGIIDSDGEVIARGDGPRGGEAEHLMAYGPPIQLSVDQGLATIFSPRSR

SEQ ID NO: 12641 - DNA, 637 bp, Panicum virgatum
  misc_feature: Ceres CLONE 1764471
aacccccatcgatacttcccagcaagctacaagctcctccgctcagcctcatcattccatggccgatccccagacccaggccgaggccctggcggagcccgcgcggatcaacggcgccgcggcggaggccacgctctctggcggcgagctgacctggcgccccgccggcggcggggaggggcaggagcggcggctggagctggagtcggaggtgctcgggtgccgggtcgaggggaggaagctcagggttgcgacctttgccgctggcggcggcggagacggggagcggccctcggcgctagcctgcggcggcgggggcaaagggggaggaggggacgggagccggaggagaggggaggtggaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacgacgttgcg

SEQ ID NO: 12642 - DNA, 891 bp, Panicum virgatum
  misc_feature: Ceres CLONE 1764495
  misc_feature: Encodes the peptide sequence at SEQ ID NO. 12643
gttcgggttcggtgagggagtcgagtcgattggcaccgagctaccagctagcagcaggacgatgcagcagggggaccagatggagtgcggcggcaaggaggagcagctgctgcagctcgtgtgcgtgcggagcgcgtcgacgggcgaggaggcgatggcggagtgggcggcggagcagtcgtcgtcgcggtcggcgctgtcgctgttcaaggagaaggaggcggagatcgagcgcaggaagctggaggtgcgggacaaggtgttctccatgctgggccgggtggaggaggagagcaagcgcctcgccttcatccgccaggagctcgaggtcatggccgaccccacgcgccgggaggtcgacgccatccgcaagcgcatcgacaaggtcaacaagcagctcaagccgctcggcaagacgtgcctcagaaaggagaaggaatacaagatgtgcctcgatgcctacaacgagaagagcaacgagaaagctacgctcgtcaacaggctcatggagctcgtgagcgagagcgagaggctgcggatgaagaagcttgaagagctcaacaagacgatagagtccctctactagatctgctctgcacgcctcaagggacgacgaagacgaagacgaagacgaagacgccgatcaggtagtagtccggaggcaccacaggaggagcagagcatgcattgctggttgcatgctccacgtgcaactttttcaggcgacgtgggtgtgattgaatttgttgctttacatttgtgtgctagcttaacggatggtcaggctagagtactgttgcactctctgggcatgcaatgcaactgctctggcgcagcgtcacaaccgtgctaggtgtgcaaacggacatttctcacattctcaaaaacatt

SEQ ID NO: 12643 - protein, 174 aa, Panicum virgatum
  misc_feature: Ceres CLONE 1764495
  misc_feature: Useful for making plants with modulated biomass
MQQGDQMECGGKEEQLLQLVCVRSASTGEEAMAEWAAEQSSSRSALSLFKEKEAEIERRKLEVRDKVFSMLGRVEEESKRLAFIRQELEVMADPTRREVDAIRKRIDKVNKQLKPLGKTCLRKEKEYKMCLDAYNEKSNEKATLVNRLMELVSESERLRMKKLEELNKTIESLY

SEQ ID NO: 12644 - DNA, 1203 bp, Panicum virgatum
  misc_feature: Ceres CLONE 1764501
  misc_feature: Encodes the peptide sequence at SEQ ID NO. 12645
agaaacgtcgccgtctcctcgctagggtctgggcatcgccgcctcagagtcgacggcgaggtcgtaggcacgagcggcggcggcggcgatggactggagctctgtgacggctgaagatctggtggacgcgctgcgggaggtggactggtcgacaccgccgcgctccgtctccgagttcttctcccgcttcaccgccccccgatcctactccaagtggaccagccgcctcaagtgcaacctctactattataggacgaactacttcatcttggtaatgttcattcttggaatgggctttcttaggaagccagttgccatccttgctgctttagcaactggtctcagcattgcgtttctcaatgacagttttgcagttactttcaatgagaaagtcacaaggagcgtcagacaattttcaccacatttagccgcaaagatgaggccaaccataacgcctgtcatccgaggccaaccaagtaaaagaagatcaattcatatctgtggtcgacctcggtgggtctttgtcgtgttgttttccgcagttagctgcatgctctggttaacttcgtgcagcctcctcacggttttgtgggccctacttattggtctgcttgcaaccttgcttcatgccagcttcagaacacctaatttgaaagcacgtttgaacacattcagggaggaatttcgagcagtatggcggaattacagtgagctgtagttgtctttgttgttccatgtgagtgccttcctcaatattagcttcaagacagcttcaagttgtaggatgttgcaacgtgttatgtgagtgcatcacagcggaaatgcctgctggctattggtggacaccttgcagtggtatatgatggagcagcctacattttcctgcttgcttatcttgggctcatttcgccatgcaggtttgtcataaagaatgatgcaagtgtcaaatctgtctccaatgctgtctctaggcctttttctcttgggagattttcgcagggtcctttctccttgcttcttgttgcaatgcttcttgttggattgcaactatgtagatatcattaggtggtgaaatatttgagtttcagggtcagtttccaccctagttttagcttgtgccttgtttccaatgtttggaggaaacctgtatgtgtgaaggttgtataaagctattctcgagtgaactaggaagatgctgctttc

SEQ ID NO: 12645 - protein, 209 aa, Panicum virgatum
  misc_feature: Ceres CLONE 1764501
  misc_feature (16)..(178): Pfam Name: PRA1 Pfam Description: PRA1 family protein
MDWSSVTAEDLVDALREVDWSTPPRSVSEFFSRFTAPRSYSKWTSRLKCNLYYYRTNYFILVMFILGMGFLRKPVAILAALATGLSIAFLNDSFAVTFNEKVTRSVRQFSPHLAAKMRPTITPVIRGQPSKRRSIHICGRPRWVFVVLFSAVSCMLWLTSCSLLTVLWALLIGLLATLLHASFRTPNLKARLNTFREEFRAVWRNYSEL

SEQ ID NO: 12646 - DNA, 770 bp, Panicum virgatum
  misc_feature: Ceres CLONE 1764504
  misc_feature: Encodes the peptide sequence at SEQ ID NO. 12647
cgccgccgcagccgccgcctctcgctaccgccgccgccatgggccgaagacctgcgaggtgctatcgccagatcaagaacaagccatatcccaagtcgaggtactgccgtggtgttcctgaccccaagatcaggatctatgatgttggaatgaagaagaagggagttgatgagttcccctactgtgtgcatctcgtctcttgggagaaggagaatgtctccagtgaggctcttgaggctacccgtatcgcatgcaacaagtacatgaccaagtctgcagggaaggatgccttccacctcagggtccgggttcaccccttccatgtgctccgtatcaacaagatgctttcgtgcgctggggctgataggctccagactggaatgaggggtgccttcggcaagccccagggtacctgtgctagggtcgacattggccaggttctcctttctgtgcgctgcaaggacaacaatgctgcccatgccagcgaggctctgcgtcgcgccaagttcaagttccctggtcgccaaaagatcattgagagcagaaagtggggcttcaccaagttcagccgtgctgattacctgaagtacaagagtgagggtagaattgtgcctgatggtgtaaacgcgaagttgctcggtaaccatggccggcttgagaagcgcgctgctgggaaggctttccttgatgctgttgcttaagttgcccagacttctaccgcaggaatgcaattccagatgttttgcgtagtctatcttattttgctttgt

SEQ ID NO: 12647 - protein, 220 aa, Panicum virgatum
  misc_feature: Ceres CLONE 1764504
  misc_feature (5)..(167): Pfam Name: Ribosomal_L16 Pfam Description: Ribosomal protein L16
MGRRPARCYRQIKNKPYPKSRYCRGVPDPKIRIYDVGMKKKGVDEFPYCVHLVSWEKENVSSEALEATRIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKFSRADYLKYKSEGRIVPDGVNAKLLGNHGRLEKRAAGKAFLDAVA

SEQ ID NO: 12648 - DNA, 805 bp, Panicum virgatum
  misc_feature: Ceres CLONE 1764545
  misc_feature: Encodes the peptide sequence at SEQ ID NO. 12649
atcacaaccgacctccgatccacttctgctcaccagacactgctaagctagctagctgctttacacttcactcactagtcactagcagcttgatcattcgacgatcagtgagtgttatcatatatcagtcgtagctgcaatattatatatagaattttatatatggctcgcctctccgccgttgtcgccgtcgtcctggtggctgcgctggtggcggccgagaccgcttcggctgcggtgagctgcagccaggtgacgtcggccgtggcgccgtgcctggggtacgccatgggcagctcggcgtcgccctcgtcggcgtgctgcaacggggtgaggtcgctcaacagccgggcgtcgtcgacggcggacaggcaggcggcgtgcgcctgcctcaagaacatggcggggaggctaggtggcaacatgggcaacgccgccgccagcatcccaagcaagtgcggcgtcaacgtcggcgtgccaatcagcccaaacgtcgactgcgccaagattaactgataagatgctatggatggatgctcagctctttccttctctttgggtatgatgtcggccaacagagcagagagcagtcgtttaatttactacctcttccttttacatttgtacaacaccacgcaccacctgtgcacgtcgtcgtctatgtacaacaataatcctctctctgcttatgtgtttgctgggtctctgttttcatgtactactaccatgctgctgctgctactgcttgttataggcaggtcaggcagctctccgctcaatcaataaactttttttctgtatacct

SEQ ID NO: 12649 - protein, 117 aa, Panicum virgatum; identical to SEQ ID NO: 12304
  misc_feature: Ceres CLONE 1764545
  misc_feature (28)..(113): Pfam Name: Tryp_alpha_amyl Pfam Description: Protease inhibitor/seed storage/LTP family

SEQ ID NO: 12650 - DNA, 660 bp, Panicum virgatum
  misc_feature: Ceres CLONE 1764554
  misc_feature: Encodes the peptide sequence at SEQ ID NO. 12651
acaaaccgctcccgacccgcgagctcgcccccggccggatcgaacagctagggtttcggaggaggaagaagcgcgcggcgacgagatgttcgggcgcgcgccgaagaagagtgacaacacgcggtactacgagatcctcggcgtgcccaaggacgcgtcccaggatgacctcaagaaggcctaccgcaaggccgccatcaagaaccaccccgacaagggcggggaccctgagaaggtgagcgcgcgcggcctgggtctggcctcctcgcttggctccgatctgtctgcggcgggggagtaggcggcaggttcgtttgattggcgggctcgggacggtgtggctaggtcgatttgaggcggcgccgtggatctgacgcggcctgggactcgatgggtttaagggttgggatggcggatgcgttttcagcggagggattcagatggggaagtagatgcggctctgaattgttaggataattacctgctacctagacgcatctaaagttgttcatgtgatcctgaaaatagttactctatgtgattttgattaatcaggtggttgttgattatgcctcccgccttgcttggtactctagtcccgtggagtgacacagctatagcttaattctatgataacgagatgatcattttattagtgtc

SEQ ID NO: 12651 - protein, 71 aa, Panicum virgatum
  misc_feature: Ceres CLONE 1764554
  misc_feature (13)..(71): Pfam Name: DnaJ Pfam Description: DnaJ domain
  misc_feature: Useful for making plants with altered lignin content
MFGRAPKKSDNTRYYEILGVPKDASQDDLKKAYRKAAIKNHPDKGGDPEKVSARGLGLASSLGSDLSAAGE

SEQ ID NO: 12652 - DNA, 566 bp, Panicum virgatum
  misc_feature: Ceres CLONE 1764561
  misc_feature: Encodes the peptide sequence at SEQ ID NO. 12653
agcaaaaccagcggcgcaaagaccacatctttcctccccccctcccactccccggcgccgcccagctcctccacctccgtccggcccggcatggcggcgctgtcccgcgcggcctcctgcctgacccggcggccgcaggtgcagccgtcgaggctgcaggcggcgagggcgatggcgtcgtcgctgttcggccacgtcgagccggcgcccaaggaccccatcctcggcgtcaccgaggcctacctcgcggacccctcgcccgacaagatgaacgtcggcgtcggcgcctaccgggacgacaacggccagcccctcgtgctcaactgcgtgcgcgaggccgagcgccggattgccggcaacctcaacatgtcagtgagatctcccccctcctgctcctttccagggcggtaccaaaaactttgaggccgaaatacaaaatgtggcccccacatctagaaattaaaataacaaaaaattgtatttagatttcattatatagcttcatgtattttgtaatcctaagaactatcttaggaattcatgagtttgagtaaatttcaagtccg

SEQ ID NO: 12653 - protein, 110 aa, Panicum virgatum
  misc_feature: Ceres CLONE 1764561
  misc_feature: SWISSPROT Homolog: EC 2.6.1.1 Aspartate transaminase
  misc_feature: Useful for making plants with modulated nitrogen use efficiency
MAALSRAASCLTRRPQVQPSRLQAARAMASSLFGHVEPAPKDPILGVTEAYLADPSPDKMNVGVGAYRDDNGQPLVLNCVREAERRIAGNLNMSVRSPPSCSFPGRYQKL

SEQ ID NO: 12654 - DNA, 825 bp, Panicum virgatum
  misc_feature: Ceres CLONE 1764600
  misc_feature: Encodes the peptide sequence at SEQ ID NO. 12655
gtgcggccactagatttttcctgacgcggtcgctgctcccacttgccctcccgaagtcgcaggggcggccggggtctagcatttgcgcggcgagggctttctccatggcggcctcggggttcggcggcggcgaggcgttccggctctcggccgcgccgggggccggcgcgctgaagctgcacaagggcgacatcaccctctggtccgtcaacggcgccacggacgccatcgttaatgctgctaatgagcgaatgctaggaggtggaggtgttgatggagcaatacatcgagctgctggaccagaattagtgcaagcatgccgcaaagttccagaggtcagaccagaagttcgttgcccaactggagaagctaggattactccagctttcaagcttcctgtgtcccgagtgattcacactgttggacccatatatgacatggacaagcatccagaggtgtcgttgaagaatgcctatgaaaatagcttgaagcttgctaaagagaatggcattcagtacatcgcattccctgctatatcttgtggtgtttaccgttatccgcccaaagaagcatcgaaaatagctgtttctactgcacaacaattttcggaggatatcaaagaggtgcattttgttctgttttcggatgatttgtacgagatttggcacgagactgcccaggagatgctgtcacaatttcagaaatgagtggtcctatagtttctgatgcggctgtgtacttggctgctgtccttgttgacatgcgagagccagaggccgtttaccgatgtaacaactaacaatatgagtgtattaaatgacattt

SEQ ID NO: 12655 - protein, 234 aa, Panicum virgatum
  misc_feature: Ceres CLONE 1764600
  misc_feature: SWISSPROT Homolog: EC 2.4.2.30 NAD(+) ADP-ribosyltransferase
AATRFFLTRSLLPLALPKSQGRPGSSICAARAFSMAASGFGGGEAFRLSAAPGAGALKLHKGDITLWSVNGATDAIVNAANERMLGGGGVDGAIHRAAGPELVQACRKVPEVRPEVRCPTGEARITPAFKLPVSRVIHTVGPIYDMDKHPEVSLKNAYENSLKLAKENGIQYIAFPAISCGVYRYPPKEASKIAVSTAQQFSEDIKEVHFVLFSDDLYEIWHETAQEMLSQFQK

SEQ ID NO: 12656 - DNA, 681 bp, Panicum virgatum
  misc_feature: Ceres CLONE 1764601
  misc_feature: Encodes the peptide sequence at SEQ ID NO. 12657
gagccacgacccaccacactctccagcacccggcggagcaactagcaagcggccagcgagatcgagatccagaggcagcagccatggccaccgtcagcgccgccgcggcgaccaccgtcgttgcccgcgccaccctagggctgccgcagctgagggcgaggagcgagagggtgcggtgcagctactccagggacgccaagagcgcggcggccgccgtgagcgctaggggcgccggcgcgtcgctgctggccgcggcgggcgcggtgaccgcgtcggcggggccggcgctggcgctcgtggacgagaggatgtcgacggagggcaccgggctgagcctggggctcagcaacaacctgctggggtggatcctcctgggggtcttcggcctcatctggtcgctctacaccgtctacacctccgacctcgacgaggacgaggagtccggcggcctctcgctctagatcatgtccatcctctgctcctgttactacgactgctccggatgtaaacatggcggtggtcatcggtgtaatgtggattcgaatcggatacggatgaaatcgaatccggatgtcaccttttaacacattttaatccgaatgtgaatgcggatctcatcggatacgaatacaaaacggatagttcgaatccggattcggatccggataccttctcgatttg

SEQ ID NO: 12657 - protein, 125 aa, Panicum virgatum
  misc_feature: Ceres CLONE 1764601
  misc_feature (1)..(125): Pfam Name: PsbW Pfam Description: Photosystem II reaction centre W protein, PsbW
MATVSAAAATTVVARATLGLPQLRARSERVRCSYSRDAKSAAAAVSARGAGASLLAAAGAVTASAGPALALVDERMSTEGTGLSLGLSNNLLGWILLGVFGLIWSLYTVYTSDLDEDEESGGLSL

SEQ ID NO: 12658 - DNA, 842 bp, Panicum virgatum
  misc_feature: Ceres CLONE 1764676
  misc_feature: Encodes the peptide sequence at SEQ ID NO. 12659
aaagcgctgagccgctcgcccccatcagcgcacgcccaagcatggcgctctccgtctcctccctcgccgccgccctctcccatctctccctcccctccacctccaagcctcatcaggcttccctcctccgcctccacccctccacctcccgccgcgccgtcagcctcgcgctccgcgcctccgcggccgaggccgccgagccgggcctgcccgcggaggaggtggtggccgtcgaggcggaggcggaggaggatgcggtgtcgggcgtcgcgctgcggaagtacgtcaagcagcggctgccgggcggcttcgcggcgcagcggatcaccgccacgggccgccgcaagacggccatcgcccgcgtcgtgctccaggagggcaccggcaaggtcttcatcaacttccgcgacgccaaggagtatctgcagggaaacccaatgtggatggagtactgcaaggtccccttggtgactctcggatttgagaacaactacgacgtcttcgtcaaagttcatgggggcggtttgtcaggccaggcccaggcaatttgccttggtgtcgcccatgcgctagtgaagatcagcactgccaacaaggttcctcttagatcagaaggtttgctgacgagagacacccgtattgttgaaaggaagaaggctggtctcaagaaggcacgcaagcgcccacagttctcaaagcgttgagggtgctcggttgttcttacagttttctcatttccatctcttcaccactcagaaagcccttctgtatcatttgctgtgcaaattctgtaatggacgccgcgtatctgtaatagttgattcttgaaagcaattttcctg

SEQ ID NO: 12659 - protein, 220 aa, Panicum virgatum
  misc_feature: Ceres CLONE 1764676
  misc_feature (99)..(220): Pfam Name: Ribosomal_S9 Pfam Description: Ribosomal protein S9/S16
MALSVSSLAAALSHLSLPSTSKPHQASLLRLHPSTSRRAVSLALRASAAEAAEPGLPAEEVVAVEAEAEEDAVSGVALRKYVKQRLPGGFAAQRITATGRRKTAIARVVLQEGTGKVFINFRDAKEYLQGNPMWMEYCKVPLVTLGFENNYDVFVKVHGGGLSGQAQAICLGVAHALVKISTANKVPLRSEGLLTRDTRIVERKKAGLKKARKRPQFSKR

SEQ ID NO: 12660 - DNA, 703 bp, Panicum virgatum
  misc_feature: Ceres CLONE 1764683
  misc_feature: Encodes the peptide sequence at SEQ ID NO. 12661
acccctaacagttcaaacccaaaaaccccccgccgccgggagggagggacagcgcgaggcccgccgccgatcgcgatggctcgcaccaagcacccggccgtgaggaaatcgaaggagcagcccaagaagaagctccagttcgggcgctccccgcacgggagggcgacgccgacaggtggagcgagcacatcggcgactccggcaagcgctgcagggaccggggagagagcggcggctggaggtacggcggggccgcagcagcagaaggtaaagaaaccacaccgttggaagccagggactgtagcgctgcgggagatcagaaagttccagaaatccaccgagatgcttatcccctttgcaccatttgcccgtctggtgagggagatcactgagttctactcaagggggaatgtgacacgctggaccccggaagccatccttgcaatacaagaggcagcagaattccacctgatagaactgttcgaagtggcaaatctttgtgccatccacgccaaacgtgttaccatcatgcaaagggacatacagcttgcaaggcgtatcggtggaaggcgctggtgaatggtgatagactaatcatgtgtatttgtggaccctatacctgatgaaggactcgttggccttagcatcttagagtgtaatgtagatgtatatcttaatccagtggtgtcattgaatgttgcat

SEQ ID NO: 12661 - protein, 167 aa, Panicum virgatum
  misc_feature: Ceres CLONE 1764683
  misc_feature (87)..(163): Pfam Name: Histone Pfam Description: Core histone H2A/H2B/H3/H4
MARTKHPAVRKSKEQPKKKLQFGRSPHGRATPTGGASTSATPASAAGTGERAAAGGTAGPQQQKVKKPHRWKPGTVALREIRKFQKSTEMLIPFAPFARLVREITEFYSRGNVTRWTPEAILAIQEAAEFHLIELFEVANLCAIHAKRVTIMQRDIQLARRIGGRRW

SEQ ID NO: 12662 - DNA, 840 bp, Panicum virgatum
  misc_feature: Ceres CLONE 1764712
  misc_feature: Encodes the peptide sequence at SEQ ID NO. 12663
atttcgccccgtcaacaaaagctcagtcttggaggggcgtcacccgttacagagtcacgagcgccaaattccagaatcttccagaagcgtcgggactcgggagagccggaagctaccagcaatggcggagaagctggcccccgagaagcgtcacgccttcgtccacaacgagcagaaggtgttcgaatgggaccagacgctggaggaggtgaacatgtacatcgagctccccaagggcgtgcccaccaagctcttctgctgcaccatccaggcaggccacgtcgaggtcggcatccgcggcaacccgccatacctcaacgtccgtgcttctccccatcctccccttgcgcacgacctgacgcaccccgtgaagacggactcgtcgttctggacaatagaggatggtgagatgcatatcacactgcaaaaaagagagaaggggaagacatggtcatctcccatacaagggcaaggtatcttggacccatatgcggcagatcaagagcaaaaacggcttatgctgcaaaggtttcaagaagagaaccctgggttcgacttttcgcaggctcagttcagtggaacctgccctgacccaaggaccttcatgggaggaatacgctcggaatgaatcttcctggctgaaccacattttctccctatgctcctgctgctacccccagcatctttgttagatgcagcagctatactgtatgaatccattatgtaaattggttggtgtttacccttcaaataatgatgatgactcttgtaagttcatcagctgactggaagttcccagaatcgggctaccggtgtaaatgctaactttttttttaggat

SEQ ID NO: 12663 - protein, 168 aa, Panicum virgatum
  misc_feature: Ceres CLONE 1764712
  misc_feature (19)..(103): Pfam Name: CS Pfam Description: CS domain
MAEKLAPEKRHAFVHNEQKVFEWDQTLEEVNMYIELPKGVPTKLFCCTIQAGHVEVGIRGNPPYLNVRASPHPPLAHDLTHPVKTDSSFWTIEDGEMHITLQKREKGKTWSSPIQGQGILDPYAADQEQKRLMLQRFQEENPGFDFSQAQFSGTCPDPRTFMGGIRSE

SEQ ID NO: 12664 - DNA, 935 bp, Panicum virgatum
  misc_feature: Ceres CLONE 1764725
  misc_feature: Encodes the peptide sequence at SEQ ID NO. 12665
acaacttgcaccaaactaaagcccaaagggccaaatcgcagctcacacgaaccagctacctccctccctctcctctcctctcctcccgttgaccaacaactccagccagcgaggcagccgcaagctccccgtccgtcctcctcctgcccgccatgtccggcagcggccgcacctcccgcgagaagacgtgctgcggcagctgctgcaccctgctcatctccctgggcctcgtcgtgctcatctactgggccatcttccagccgcaccagatacgcgccaccgtcgagtacgccgagctctccaacctcgccgtctccaacgcctcctccccggtcgcggtcacctaccacgtcgccgtgaacctgagcctctacaaccccagcaagcgcgtcaacatctactacgacgccatcgacgcggcgctcctgttccgcggcgccgtcctcagcccggccgccgccgccgcgtcccccgccgagttctaccagcgcaggaaggccgcccagccggtgcgcctggagttcgacggcaagggcgtcgccgtctccgagggcgtctcggcggagctggagagcgaggtgaagaccgcggcgtcgctgggcctggacctgagcgtcagcgtgcgggtgaggtacgtgttcgggagaatcaagatacggcagaagcccaaggtgtggtgcgcggtgagcatcccggtcccgccggcgccgggcggcctcggcgttcttggctctggcaaccggtgctgggtcaagtactgatgattggagtcgagttcccttctcttggtggctgtggcttcttggatggagattggtggccggttttggtttggttcgtggagagattgctattgtttgggttgggttaattgtttctgcgtttgtatcaatgtagagatttactgagctattggattatttgtttgcccggtg

SEQ ID NO: 12665 - protein, 202 aa, Panicum virgatum
  misc_feature: Ceres CLONE 1764725
  misc_feature (32)..(176): Pfam Name: Hin1 Pfam Description: Harpin-induced protein 1 (Hin1)
MSGSGRTSREKTCCGSCCTLLISLGLVVLIYWAIFQPHQIRATVEYAELSNLAVSNASSPVAVTYHVAVNLSLYNPSKRVNIYYDAIDAALLFRGAVLSPAAAAASPAEFYQRRKAAQPVRLEFDGKGVAVSEGVSAELESEVKTAASLGLDLSVSVRVRYVFGRIKIRQKPKVWCAVSIPVPPAPGGLGVLGSGNRCWVKY

SEQ ID NO: 12666 - DNA, 807 bp, Panicum virgatum
  misc_feature: Ceres CLONE 1764728
  misc_feature: Encodes the peptide sequence at SEQ ID NO. 12667
actcctaccatttcgcccccgctccctctctcccagtctcctcgccgcgagggtgacggaaagcgacgcggcgcgagcgcgagaggagggccaggggcaagggacgccctagtagacactccgcgccgccgccgcctcagggctcgagattgtgtcagctttcaagatgtcgatcagcacatttgctactccctgcgtgctgttgagcaatgttagaacacagagctcccagacagcggtgaagagcccttcatctctaaacttcttcagccaaggcatgaaggttccaagcctgaagacctccaagaaactcgatgtctctgcgatggctgtgtacaaggtgaagctcgtcacaccagaaggggtagagcatgagtttgaggctccagatgacacctacatcctcgacgcagctgagaccgccggagtggagttgccatactcatgccgtgctggagcttgctccacctgtgctggcaaaattgaggctggcgaggtcgaccagtcagatgggtccttccttgatgacgggcagcaggctgagggctatgtgctgacatgcgtctcctaccccaagtctgactgtgtcatccacacccacaaggaaggtgacctgtactagggctttcagtccggcaagggaccaatgctatcgagtgtgttgtcaagcaaagctccatcctccaagttgtgtcaactctctggcatcaaacttgcatggtggttgtcttgtttgttctgtttgtgcgagttcagggaatcactgaaatcagggttggcgcattaagattgggaacccgtgggaat

SEQ ID NO: 12667 - protein, 151 aa, Panicum virgatum; identical to SEQ ID NO: 12312
  misc_feature: Ceres CLONE 1764728
  misc_feature (62)..(138): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase

SEQ ID NO: 12668 - DNA, 770 bp, Panicum virgatum
  misc_feature: Ceres CLONE 1764750
  misc_feature: Encodes the peptide sequence at SEQ ID NO. 12669
gttcagccttcctgcccgttcgtatccttttcatgttcaatcgttccccacctcgccgacaagctagggtttcctccgccgcccgttccagccgccaccatgcctcgccgcagctcaggaaggtctgcatcgcgccctgctccgcgtgctgctccgatgaggaacccgccacagcgagcgcgccaggctcctcctccagctcctgctcagagtggtggtggctctatccttggaggaattgggtccacaattgctcaaggtatggcatttggtactggcagtgccatggcacacagagctgttgatgctgtaatgggcccccgtatttttcagcatgagactgttgtctcggaggcggctgctgctgctcccgctgctccgatgatgaacgctgattcttgtggcaaccattccaaggccttccaagactgtctcaaccactatggcagcgacatcagcaagtgccagttctaccttgacatgctgaacgagtgccgccggggtggcgccacagcttaagctgctgcttcattggagttgattcctgggttcccttttcactttcattaataagacttaagtgaaactatgaactgcagccacaacctgatgttgtgtgccgtgaccattatcattggtgcatgctgttgaggttgtggtaatgttctgttatcctgggagtagtacattcagctatcctatattgttggtgcagacttctatagcactgatgattataaatatttgaatcaagcagtgatcttgggatt

SEQ ID NO: 12669 - protein, 139 aa, Panicum virgatum
  misc_feature: Ceres CLONE 1764750
  misc_feature (94)..(135): Pfam Name: CHCH Pfam Description: CHCH domain
MPRRSSGRSASRPAPRAAPMRNPPQRARQAPPPAPAQSGGGSILGGIGSTIAQGMAFGTGSAMAHRAVDAVMGPRIFQHETVVSEAAAAAPAAPMMNADSCGNHSKAFQDCLNHYGSDISKCQFYLDMLNECRRGGATA

SEQ ID NO: 12670 - DNA, 720 bp, Panicum virgatum
  misc_feature: Ceres CLONE 1764754
  misc_feature: Encodes the peptide sequence at SEQ ID NO. 12671
ggacgtcgccgcacacgtcaccggcgacttccgcaagcttttggtgcctcttgtaagtgcataccgctatgatggcccagaggtgaacacttcattggctcattctgaagccaaaatacttcatgagaatattcacaagaaggcttacagtgatgaggaggtcatcaggattctcaccacacggagcaaagctcagctacttgctacattcaatagctacaaggatcagtttgatcatccaatcaacaaggatctgaaagctgatcccaaggatgagttccttgcaaccctgcgggctatcattcgttgcttcacttgccctgacagatactttgagaaagtccttcggttggctcttggaggcatgggcacagacgaggatgatctcaccagggtcataactactcgcgccgaggtcgacctgaagctgataaaggaggcctaccagaagaggaacagcgtgccgctggagcgtgcagttgctaaagatacaaccagagactatgaggatattctcctcgcactgctaggggcagagtgaggactgaggaggcgtgtctcagcattcagcaccatttcatgtgttcctccttgtctaatgggaagatgaaacttcataaaataaagttctgaacgcatggttctgtttctgaacaataagtttgtgacctagcctgcatatatagcagtgctcgttaaataaaagatgtttagcttttc

SEQ ID NO: 12671 - protein, 179 aa, Panicum virgatum; identical to SEQ ID NO: 12634
  misc_feature: Ceres CLONE 1764754
  misc_feature (110)..(175): Pfam Name: Annexin Pfam Description: Annexin
  misc_feature (35)..(100): Pfam Name: Annexin Pfam Description: Annexin

SEQ ID NO: 12672 - DNA, 727 bp, Panicum virgatum
  misc_feature: Ceres CLONE 1764768
  misc_feature: Encodes the peptide sequence at SEQ ID NO. 12673
agtccattccgtgcccaaccaacgccaagcacgagccggaaccaggaagaaacaatttgttcttcgctggctcgctcgccattcttatttctgctcattctccgcccagcgccccggctcccagcagcgaagggagctaggactagaagtctagaacaagtagagacgtagagtacagggagaagccatggccggcaggagcttcttgatccggtctcccaaggaggagtccgacgccgccgtcaaagaggctgtactactgggagcgaagaatgctgcaatagctggtactgtggtagcggttcccacgttggtcggctgccgtgtccttccttgggctaaggctaatctcaactacactgcacaagcactcatcatatctgcagcctgtatcgctggcttcttcatcactgccgataaaaccattctacggaacgcaagacaaaacaccatcgggaagcttgacaagtagatttcggtgcagaactatggctgtaatggctcactgattttggtgtttcgctactcaagccaattgtgctgtaaagacttgcttacctgacggactcaaccggtgcatgcagttttcccctaattttatttggaataaaatatggggctaatgggtatacgcctttgtaatgtggaatacgagacctgcttctttgtcacttgtcaggggttgtaagactgttcagtaaaatgctatatggtatttgttgcctcc

SEQ ID NO: 12673 - protein, 94 aa, Panicum virgatum
  misc_feature: Ceres CLONE 1764768
  misc_feature (10)..(88): Pfam Name: ENOD93 Pfam Description: Early nodulin 93 ENOD93 protein
MAGRSFLIRSPKEESDAAVKEAVLLGAKNAAIAGTVVAVPTLVGCRVLPWAKANLNYTAQALIISAACIAGFFITADKTILRNARQNTIGKLDK

SEQ ID NO: 12674 - DNA, 782 bp, Panicum virgatum
  misc_feature: Ceres CLONE 1764801
  misc_feature: Encodes the peptide sequence at SEQ ID NO. 12675
actcgcccgggtcttccccacttcctcctcgccgacgatctcgcggagcagcggcgcagatggcgagcgacggctcgacagccacgccggcgaaggtgaccccgaagaaggccaacctcctcgacccgcactccatcaagcacctcctcgacgagaccatctccgatgtcgtgaagagcaaggggtacacggaggacacgcggttgggcaacttgaagctggggatcggggcggccgtgatcgccgtcgcccttctcgcgcagttctacccgaagaagttcccacagaaccgcgagttcctcctcggctgcatcgcattgtatgtggtgttgaatgtggtgctgctgatccttagctacaccaaggagaaggatgccatcctcttcacccatcctcctatgggttctttcaacagcaccggcctcattatttcttctaagctaccaaggttctcggacatgtacaccctcacaatagccagtgcagacccgcaatctatctctgctaataagccagtccatttcactaagagcgtgacaaagtggtttactaaggaaggggttcttgtggaaggtctattctggaaggatgttgagaagctgattgatgactacaacagcgagcgcaagagtaaatgaatcggtagctcgtcttggaccgtcaggagaaacattggttatctagggaaacccctcttatggaagagagcttagtctaatctaaacagacatttttgcatactgtactggttgatcaatgaatgaatacccttcaagacatag

SEQ ID NO: 12675 - protein, 192 aa, Panicum virgatum
  misc_feature: Ceres CLONE 1764801
  misc_feature (12)..(190): Pfam Name: SPC25 Pfam Description: Microsomal signal peptidase 25 kDa subunit (SPC25)
MASDGSTATPAKVTPKKANLLDPHSIKHLLDETISDVVKSKGYTEDTRLGNLKLGIGAAVIAVALLAQFYPKKFPQNREFLLGCIALYVVLNVVLLILSYTKEKDAILFTHPPMGSFNSTGLIISSKLPRFSDMYTLTIASADPQSISANKPVHFTKSVTKWFTKEGVLVEGLFWKDVEKLIDDYNSERKSK

SEQ ID NO: 12676 - DNA, 862 bp, Panicum virgatum
  misc_feature: Ceres CLONE 1764826
  misc_feature: Encodes the peptide sequence at SEQ ID NO. 12677
gcttctccgcgcactccatctccctccctccgccgccgccgccgcacgcagccgcatcggccatgggggcgtacaagtacgtgtcggagctatggaggaggaagcagtccgatgtgatgcgcttcgtgcagcgcgtccgctgctgggagtacaggcagcagccggcgatcgtccgcctcaccaggcccacccgccccgacaaggcccgccgcctcggcttcaaggccaagcagggctatgttgtttaccgtgtccgtgtcaggcgtggtggtaggaagaggcccgtgcccaagggtattgtctatggcaagccaaagcaccagggtatcacccaactcaagttccagaggaacaagaggtctgttgctgaggagagggctgggcgtaagctgggtggactgagggttctcaactcctactgggtgaacgaggatagtacgtacaagtactttgaggtcatcctcgttgatgttgcccacactgccatccgcaacgaccccaggatcaactggctgtgcaaggatgtgcacaagcaccgcgagctccgtggcctcacctctgctggcaagaagtaccgtggtctgcgcggcaagggccacacccaccacaagaacaggccctccaggagagccacctggaagcgcaaccagaccctctccctccgccgctaccgttgagctctgtgcctggatactggaacccccatcccaagcaaaacttcggctgtgtttggttgcatttttcaaattttggtacttgtgttctgagcacttggaactatgttagatgtctactatggagcatatgtcgtgaactatttgcaatttgcctgtgttatcagacaaagaatggttagtgatcg

SEQ ID NO: 12677 - protein, 204 aa, Panicum virgatum
  misc_feature: Ceres CLONE 1764826
  misc_feature (2)..(193): Pfam Name: Ribosomal_L15e Pfam Description: Ribosomal L15
MGAYKYVSELWRRKQSDVMRFVQRVRCWEYRQQPAIVRLTRPTRPDKARRLGFKAKQGYVVYRVRVRRGGRKRPVPKGIVYGKPKHQGITQLKFQRNKRSVAEERAGRKLGGLRVLNSYWVNEDSTYKYFEVILVDVAHTAIRNDPRINWLCKDVHKHRELRGLTSAGKKYRGLRGKGHTHHKNRPSRRATWKRNQTLSLRRYR

SEQ ID NO: 12678 - DNA, 773 bp, Panicum virgatum
  misc_feature: Ceres CLONE 1764835
  misc_feature: Encodes the peptide sequence at SEQ ID NO. 12679
  misc_feature (255)..(255): n is a, c, t, g, unknown, or other
agcccgaagcaccttttacggaaccaagcagccacgacacaccagagcaccggatcacacacgaaagggcagggcagaagaagacgcaggccgccgccgccacagccgccgggcccccggccgcggcgcccgggaagggcaggcgggcggcgaggagcacgggggacgcccgcgacccggccacgaggaggagcgcccgcgccgccggggccgccgccagcgccgcggcggagccggccgaggacgacgacagcncgagcggcacggcgcgccccaaggaggcccgcgagccgcgcggcggcgacgcctgtttttcgcagatgtacccggaggctaagctcgccggcgcggcggaggcggccgcgggcaggagggaggaggaggtggagagggactacctgtcctacgacgagccgaagacggtgttccccggcgaggcgtgcgacgacctcggcggcgagttctgcgaggcgccgtaccaggccggcgtgtccagggagctggcgcacgcctgatccatcgtccatctatccgcaacatgaattgatctcgccgtcgagtcgatgggtgatgggtccatatgctgctatgcacgtacgtgttgcagatgatactcgagtggtggaggggaagctagcctacgtgtgctagaataacagcagccaagcaaggccaaggacgttgtcacgtgtgtaattgtgcatgtcttgggtcgtgccagctgtgcctgtctgtagaaactaaagatgaaatactacgatccgtatcgcttt

SEQ ID NO: 12679 - protein, 170 aa, Panicum virgatum
  misc_feature: Ceres CLONE 1764835
  misc_feature (29)..(158): Pfam Name: Lir1 Pfam Description: Light regulated protein Lir1
  misc_feature (85)..(85): Xaa is any aa, unknown, or other
PEAPFTEPSSHDTPEHRITHERAGQKKTQAAAATAAGPPAAAPGKGRRAARSTGDARDPATRRSARAAGAAASAAAEPAEDDDSXSGTARPKEAREPRGGDACFSQMYPEAKLAGAAEAAAGRREEEVERDYLSYDEPKTVFPGEACDDLGGEFCEAPYQAGVSRELAHA

SEQ ID NO: 12680 - DNA, 822 bp, Panicum virgatum
  misc_feature: Ceres CLONE 1764836
  misc_feature: Encodes the peptide sequence at SEQ ID NO. 12681
gactcgggcagacaaatcctatcctcctccacctagtcaccacagtcgtctctccctgcgccgcgtgagctgccaacgatggcccttgagacgtgcttcagagcgtgggcgctgcacgccgcccctgccggcggcaaggacaggctcgccgtcggcggcggcggcagcagcttcgcgccgtccaagcgggccgccgccgccgccgcgccgctgtccgtcggccgcgtcgccacgcggcggccccggcacgtctgccagtccaagaacgccgtcgacgaagtgctggtggcggatgagaagaactgggacgggatggtgatggcgtgcgagacaccggtgctggtggagttctgggcgccgtggtgcgggccctgccggatgatcgcgccgttgattgacgagctggccaaggactacgccggcaagatcaagtgctgcaaggtgaacacggacgactgccccaacgtcgcctccacctacggcatccgcagcatccccaccgtgctcatcttcaaggccggcgagaagaaggagagcgtcatcggcgccgtgcccaagaccacgctcaccaccatcatcgacaagtacatcggcagctcgtgatcgagccaactggggttgatgggtgatgttgttgttggagatgaactaaatacatacgtgtccgtgctcgcgcatacacaccatgtatctcttgttgcgatgatgcgataactcaggcagccgtctgctcctgctcccttatactatgtcgaatccaactccattaattagtttccagtgcatgatttcacagtgaatattataaattaagtcgtgtgt

SEQ ID NO: 12681 - protein, 174 aa, Panicum virgatum; identical to SEQ ID NO: 10152
  misc_feature: Ceres CLONE 1764836
  misc_feature (67)..(170): Pfam Name: Thioredoxin Pfam Description: Thioredoxin
  misc_feature: SWISSPROT Homolog: EC 1.8.1.8 Protein-disulfide reductase
  misc_feature: Useful for making plants with modulated heat sensitivity

SEQ ID NO: 12682 - DNA, 701 bp, Panicum virgatum
  misc_feature: Ceres CLONE 1764842
  misc_feature: Encodes the peptide sequence at SEQ ID NO. 12683
  misc_feature (101)..(101): n is a, c, t, g, unknown, or other
  misc_feature (115)..(115): n is a, c, t, g, unknown, or other
  misc_feature (163)..(163): n is a, c, t, g, unknown, or other
  misc_feature (190)..(190): n is a, c, t, g, unknown, or other
  misc_feature (254)..(254): n is a, c, t, g, unknown, or other
  misc_feature (257)..(257): n is a, c, t, g, unknown, or other
  misc_feature (269)..(269): n is a, c, t, g, unknown, or other
ggatcaaggacaccgccgcccgagagccccttccagatccccaagaggcaagagcagcagcagcagcagcagcgagccacggccaccccgaccgccgccgngctgcccccgccgnccgcggcggggctccgcccggcgccgccgccccgggcgcgcgagacgnaccgcgcggcgccggcgaggcggaggnccgcggcggcgcgggcggagccgagcccgacgcaggagagcagccccagcacggggggggcgcncgnccagggccgcanacgacacaacaacaaccagcgggagaacgaggccaagcaggcgcccgagcagaacggcattttttacttcgaagccggcgacgagcgcgccaaggagttcgccgccctgctcaagtccaacgaccccgtcggcttcaacctcgtcgacctcctcgcctggggctcgctcggccacatcgtcgcctactacatcctcgccacctccagcaacggatacgaccccaacttcttctgagcgcggggcggtgtccctgacgggcttgctgtaatctaagactcagtcactgtgttggtgtttgctgcgttttggtgatgtatctggtgccggaaagattggttaatttggacaagtagtgcgactgcgtgtgtatattgccgcatgaatttgatcttcatctgtgtctctgtgaattcatctacttccacgcttcc

SEQ ID NO: 12683 - protein, 167 aa, Panicum virgatum
  misc_feature: Ceres CLONE 1764842
  misc_feature (70)..(164): Pfam Name: PSI_PSAK Pfam Description: Photosystem I psaG / psaK
  misc_feature: Useful for biocontainment applications 220>
  misc_feature: Useful for making plants with modulated nitrogen use efficiency
  misc_feature (34)..(34): Xaa is any aa, unknown, or other
  misc_feature (39)..(39): Xaa is any aa, unknown, or other
  misc_feature (55)..(55): Xaa is any aa, unknown, or other
  misc_feature (64)..(64): Xaa is any aa, unknown, or other
  misc_feature (85)..(85): Xaa is any aa, unknown, or other
  misc_feature (86)..(86): Xaa is any aa, unknown, or other
  misc_feature (90)..(90): Xaa is any aa, unknown, or other
GSRTPPPESPFQIPKRQEQQQQQQRATATPTAAXLPPPXAAGLRPAPPPRARETXRAAPARRRXAAARAEPSPTQESSPSTGGAXXQGRXRHNNNQRENEAKQAPEQNGIFYFEAGDERAKEFAALLKSNDPVGFNLVDLLAWGSLGHIVAYYILATSSNGYDPNFF

SEQ ID NO: 12684 - DNA, 656 bp, Panicum virgatum
  misc_feature: Ceres CLONE 1764867
  misc_feature: Encodes the peptide sequence at SEQ ID NO. 12685
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccacaggtcccgcggcttcggcttcgtcaccttctcgagcgagcaggcgatgcgcgatgccatcgaggggatgaacggcaaggagctggacggccgcagcttcaccgtcaacgaggcccagtcccgcggcggcccgcgctccggcggcggcggcggcggcgggtacgggcgcctcgagggcggcggcggctacgggcgccgcgagggcggtggtggcttcggcggccgcggctacggtggccgtggaggctacggtggcgtccgctgcgtctgctcccgcatctccgatgggaactggaggagctgaccggggggggccgcgtggctcagttatcctgtccttgctactgttacctgagttatgctgtgccatgatctccctgtgtttggtgtctttcatgtccgttgttgcccatctgtgtttttc

SEQ ID NO: 12685 - protein, 146 aa, Panicum virgatum
  misc_feature: Ceres CLONE 1764867
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content 220>
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAASDVEYRCFVGGLAWATDDNSLHNAFSPFGEVLESKIILDRETHRSRGFGFVTFSSEQAMRDAIEGMNGKELDGRSFTVNEAQSRGGPRSGGGGGGGYGRLEGGGGYGRREGGGGFGGRGYGGRGGYGGVRCVCSRISDGNWRS

SEQ ID NO: 12686 - DNA, 944 bp, Panicum virgatum
  misc_feature: Ceres CLONE 1764868
  misc_feature: Encodes the peptide sequence at SEQ ID NO. 12687
aaatcttccattgccctctctctctctctcgtcctccgtccgtccatccatgaggatcaggaggcggcctccgtgccagcctgtcgcctacctgctgccctcagatccgcccgcgccacagccgccgcggggcgcgtcgggggatcaccaggaccgccccgccggggacaagagagaggaggaggggttgcacttgcacccgagcgcggccgcggatctcggggacgaccgctcctcggcggcgaggcgcccggcattgctgccattgctgccgcaggacggtgcggtggaacgcggcaggggcctgggtgcacaacaacaggggcctgcagatggccacaagagcctagagaatggtcgtcaccgagtgctggagtcggtgatgaaggccggagagcgtctcgatcccagcaacggcggcgacaggttagccttggcaatagtgacatcaacaacaacaatggtcgcgtacgggacgaagcctcaacagatgaaggatgtcggcggcggcagcagcagcaagaagtcgcgggtcccgggtgtgctgctggaggggtcacggtgcagccggaagaacgggcgcgggtggcgctgcagccagccgacgatggtgggctacgccctctgccagtaccacctcggcaagggccggatgcggagcgcggcggcggcggccgccgcgcgcgtcgccgctgggcagctcggccgcaccgagaacgggaagaaagggcccgccaccgccaccgccgcgccgcccagggccgccgacgtgccgccggcgagcgtgcagcactggtaggcgcgcgcacggctgctggctggcggagatcgatgggaccgtaagattcttggacatcgtggtggggttgcacatatcccattcccaaacttgcaaatgctgtggtgccgtaccccgtggggaaaagttttcgcggcggattgcg

SEQ ID NO: 12687 - protein, 249 aa, Panicum virgatum
  misc_feature: Ceres CLONE 1764868
  misc_feature (166)..(211): Pfam Name: WRC Pfam Description: WRC
MRIRRRPPCQPVAYLLPSDPPAPQPPRGASGDHQDRPAGDKREEEGLHLHPSAAADLGDDRSSAARRPALLPLLPQDGAVERGRGLGAQQQGPADGHKSLENGRHRVLESVMKAGERLDPSNGGDRLALAIVTSTTTMVAYGTKPQQMKDVGGGSSSKKSRVPGVLLEGSRCSRKNGRGWRCSQPTMVGYALCQYHLGKGRMRSAAAAAAARVAAGQLGRTENGKKGPATATAAPPRAADVPPASVQHW

SEQ ID NO: 12688 - DNA, 697 bp, Panicum virgatum
  misc_feature: Ceres CLONE 1764900
  misc_feature: Encodes the peptide sequence at SEQ ID NO. 12689
ctccgccgccctctcacttccttccttccccacccggcggctgcgctccccgacccgaagagatggcggtgccgctgctgacgaagaagatcttgaagaagcggctcaagcagttcaagaggccccacctcgaccgctacaagtgcctcaagccaagctggcgcaggccaaagggtattgactcccgtgtcaggaggaagttcaagggatgcaccttgatgcctaacattgggtacggctctgacaagtcaaccaggcactaccttcccaacaagttcaagaagtttgtggtgcacaatgtctctgagctggaggtgctcatgatgcacaacaggacatactgcgccgagatcgcccacaacgtctcaacaaagaagcgcaaggagattgttgagcgtgctgctcagctcgacattgtggtcaccaacaagctcgccaggctccgcagccaggaggatgagtaggctgggttgctcgtcaggacaactgttgggtcttgcctttcttggctgtaggaaaactactctgtttcgtgtcgtgttgctaccgaggttacctgctatgccgacctttttgctatcaatagcgactctaatctgtcaaattctgctgttaccgtatgcctatctgaattatttgcatgttgttgcaaacctgtctttcgcatgcagtttctgtcgatgcactacctgttatc

SEQ ID NO: 12689 - protein, 133 aa, Panicum virgatum
  misc_feature: Ceres CLONE 1764900
  misc_feature (14)..(123): Pfam Name: Ribosomal_L32e Pfam Description: Ribosomal protein L32
MAVPLLTKKILKKRLKQFKRPHLDRYKCLKPSWRRPKGIDSRVRRKFKGCTLMPNIGYGSDKSTRHYLPNKFKKFVVHNVSELEVLMMHNRTYCAEIAHNVSTKKRKEIVERAAQLDIVVTNKLARLRSQEDE

SEQ ID NO: 12690 - DNA, 893 bp, Panicum virgatum
  misc_feature: Ceres CLONE 1764916
  misc_feature: Encodes the peptide sequence at SEQ ID NO. 12691
ggccccgttcaagctagagacaagagccacccacgcgaacgccgccacctcgctctgctcgcttcgccctcgcccggtgctccggcaattgttcgctgctgtttgattccgccgaggggaggagggaggcggagggggaagaagcgatgatggggcggatgcgggcggctgcggcggcggcgctgctggtgctggcggcgtgcgcggcgctgccgccgaggacggcggcgaacaagatcagcatcaactggaagcccaacaccaactactccgactgggtggcgcagcacagccccttctacaaggacgactggctcgtgttctactacacggcggggcaggcggacgtggtgcaggtggacgaggccgggtacaacaagtgcgacgccagcaacgccatctacaactacagcaagggccgcaccttcgcgttccagctcaacgagaccaagacctactacttcatctgcagctacggatactgcttcggcgggatgcgcctcgccatcaagaccgagaagctgccgccgccgtccccgccgccgtccggcagcaacgggtccggcagcgccgccgccttcgccaggtcccacgccgcggtcatctacgccgccgtcgccgtgctcgccgcgctcctcagggtgctctagcaaggagggggggggggatctccgccgttctttcgttaaatttggagctcttgttttctttttttttggtgtgcttggatgggctctgaagaggagtcgtagtagtggaggagtgtgttgtgttgggttgatttagtggcgtggatttgcggaagcgattgattcatctgagagattgatttattgttccgagtgtgaagaactcatcaagctgaagtaacctagctttgcattttgtcacgg

SEQ ID NO: 12691 - protein, 167 aa, Panicum virgatum
  misc_feature: Ceres CLONE 1764916
  misc_feature (35)..(117): Pfam Name: Cu_bind_like Pfam Description: Plastocyanin-like domain
MMGRMRAAAAAALLVLAACAALPPRTAANKISINWKPNTNYSDWVAQHSPFYKDDWLVFYYTAGQADVVQVDEAGYNKCDASNAIYNYSKGRTFAFQLNETKTYYFICSYGYCFGGMRLAIKTEKLPPPSPPPSGSNGSGSAAAFARSHAAVIYAAVAVLAALLRVL

SEQ ID NO: 12692 - DNA, 807 bp, Panicum virgatum
  misc_feature: Ceres CLONE 1764931
  misc_feature: Encodes the peptide sequence at SEQ ID NO. 12693
actcggcccagcccccctcgcttcctttcccctcctcgtcgctcggctcgctcgctcgtctgcacagcggaatcccccctccgccgccgctccttccggcttcggaactcgcccgagatggcaaacgcaagatcaggagtcgcggtgaatgatgactgcatgctgaagttcggcgagctgcagtcgaagaggctgcaccgtttcattgtttacaagatggatgacaagttcaaggagattattgtggataaggttggggatcgcgagaccagctatgaggatttcaccaacagcctacctgaaaatgactgccgatatgctatctatgattttgactttgttactgcagaagacgtccaaaagagcaggatcttctatatcctatggtccccgtccactgccaaggtgaagagcaagatgctttacgctagctcaaaccaaaaattcaagagtgggctcaatggcatccaggtggaactgcaggctactgatgctagtgaaatcagccttgatgagatcaaggatcgggcgcgctaggctccatcgtgcagctcatgaccattcatcgtggacttgcctactgctgtggatttgtatgccattatagacttggtgctatgaaagaccgcttggtgatttatgggtttgttgatgtgtaaaaagatcctcgtggcttttccagaaagaccatgaaggtttggatctaccatgtacttccttgtctgccaaatgatgtgttgcgctgtccaagttactaaaataagtaatcgatatgttccctactcgtcattctgtgagaggattgcc

SEQ ID NO: 12693 - protein, 139 aa, Panicum virgatum
  misc_feature: Ceres CLONE 1764931
  misc_feature (12)..(139): Pfam Name: Cofilin_ADF Pfam Description: Cofilin/tropomyosin-type actin-binding protein
  misc_feature: Useful for making plants with modulated time to senescence
MANARSGVAVNDDCMLKFGELQSKRLHRFIVYKMDDKFKEIIVDKVGDRETSYEDFTNSLPENDCRYAIYDFDFVTAEDVQKSRIFYILWSPSTAKVKSKMLYASSNQKFKSGLNGIQVELQATDASEISLDEIKDRAR

SEQ ID NO: 12694 - DNA, 630 bp, Panicum virgatum
  misc_feature: Ceres CLONE 1764966
  misc_feature: Encodes the peptide sequence at SEQ ID NO. 12695
cgttaccgttaattacagcgccgccgccgccacccccgccccatcttcttcctcccctgtttcctggcataccgccgtcctccgcttccaagaatcgacggccaaggccagggactccctgagaaaaacctccagtctcaaaggtgttgtcctgcacgttctatactgtattaatctttggtttgctgccatgttctatactgtgcgttacattgaaataggatgtaacaatatgtgcatttaagcttcctgctcagtatatgtacttatctatatctatactattatgtaccataaacatcaaaaactttcgaaaacactttttacccaaatcgaacccatcgtaccctgtcggtgttttaccatcacgtctatcttgggatagaggagggatcaatagatctttaacctggaggaggcggctcgtgttgttaacgacaggatgcagccccctcatcctagttatgtagattccaggtccgtcttggaatggttcaagcaagttccgaaatggttgagggatcggaatctccaaagaagaggtcgtccaggagatcggctagtagcttgatgtaggaccttgatgtataaacttttgctattgcttgatatatgtaatatttttttcat

SEQ ID NO: 12695 - protein, 39 aa, Panicum virgatum
  misc_feature: Ceres CLONE 1764966
  misc_feature: Useful for making plants with modulated flowering time
  misc_feature: The sequence is a functional homolog of SEQ ID NO 1233 in the 10/666,642 US patent application
LPLITAPPPPPPPHLLPPLFPGIPPSSASKNRRPRPGTP

SEQ ID NO: 12696 - DNA, 794 bp, Panicum virgatum
  misc_feature: Ceres CLONE 1764974
  misc_feature: Encodes the peptide sequence at SEQ ID NO. 12697
tgtcatccaggcggcggcggcgcggtaggagaaggaggaggaggagcagcagcagcaggcggcgccgaagagcagctacccacccccaacccgcaaccatggctaggagattgaagaagcatctgaagaggctcaatgcgccgaagcattggatgttggacaaacttggtggagcttttgcccccaaaccatcttctggtcctcacaagtccagggagtgccttcccctcatcctcatcatcaggaacaggctcaagtatgctctgacataccgtgaggttatttctatcctgatgcaacgccatgtcttggttgatggcaaggtcaggactgacaagacctacccagcagggttcatggatgtcatttctattcccaagaccaatgagaactacaggcttctgtacgacactaagggtcgcttccgtcttcaccccatcagagatgaggatgccaagttcaagctctgcaaggttaggtctgttcagtttggccagaagggcattccctacctgaacacttatgatggtcgcaccatccgctaccctgacccactcatcaaggccaacgacaccatcaagatcgaccttgagaccaacaagattgttgacttcatcaagtttgatgttggcaacgttgtcatggtgactggtggaaggaacactgggcgtgttggtgtgatcaaaaacagggagaagcataagggcagcttcgagaccatccatgttgaggatgccctaggccaccagtttgccccccgtctgggcaatgtgttcaccatcggcaaggggcac

SEQ ID NO: 12697 - protein, 231 aa, Panicum virgatum
  misc_feature: Ceres CLONE 1764974
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (177)..(211): Pfam Name: KOW Pfam Description: KOW motif
  misc_feature (42)..(90): Pfam Name: S4 Pfam Description: S4 domain
MARRLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDALGHQFAPRLGNVFTIGKG

SEQ ID NO: 12698 - DNA, 736 bp, Panicum virgatum
  misc_feature: Ceres CLONE 1764985
  misc_feature: Encodes the peptide sequence at SEQ ID NO. 12699
accgcgaggccgcacgcctttcacactagatgggttgctgccgctcctcgctccggccgggggcgggagcgggggcggggacggggacccacgcggcggggaagccggccccccggcggcggcagggccgtctcgctccgcggctcgtcccctccagtagcagcagcagtagcagcaacatctggtagtattgctccagctatttcgttgaccgaaaaggccttgaaacatctgaacaaaatgagggctgaacagaatgaggatctgtgtttgagaattggagtgaaacagggtggctgctctggcatttcttacaccatggagtttgaaagtcgagcgaatgccagccctgatgattcagttgtagaatatgatgggttcgcaatagtatgtgatccaaagagccttctcttcatgtttggaatggagctggactacagcgacgcacttatcggcggtggcttctccttccagaatccaaatgcgaccaaaacctgtgggtgcggcaaatctttcgcgaccagcaaagaaactgagaccgccgcaactgcttgcaacaactaagatagatccataatcatgccaagcagtgttgtactaagttgtaacatgccatatagcttgcaccagttggattctggtggctataccacggtgcatacagaagaccgtaagggtgactcaatttgtaaaactgcattcaacagtctagtatgtattcagcaatggagtctgc

SEQ ID NO: 12699 - protein, 187 aa, Panicum virgatum
  misc_feature: Ceres CLONE 1764985
  misc_feature (68)..(160): Pfam Name: Fe-S_biosyn Pfam Description: Iron-sulphur cluster biosynthesis
TARPHAFHTRWVAAAPRSGRGRERGRGRGPTRRGSRPPGGGRAVSLRGSSPPVAAAVAATSGSIAPAISLTEKALKHLNKMRAEQNEDLCLRIGVKQGGCSGISYTMEFESRANASPDDSVVEYDGFAIVCDPKSLLFMFGMELDYSDALIGGGFSFQNPNATKTCGCGKSFATSKETETAATACNN

SEQ ID NO: 12700 - DNA, 656 bp, Panicum virgatum
  misc_feature: Ceres CLONE 1765001
  misc_feature: Encodes the peptide sequence at SEQ ID NO. 12701
acagaggaagagcgacttaaaatccccccagcagcagcaatggcggcatccatgatcacgtcgtcagctctggtggcgccggccagggcccagggcctgccgtcccacggccgccgcgcctcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggttttttaccggtgacgtctacgtcggtggaaccaccggacttctgatctggtccgtcaccctcgtcgggctccttgccggcggcgccctccttgtttacaacaccagcgccctcgccagctagcaacattattcatgcatagtccatgaaagcgcttgcggccggtccatatataagatttatcatcagcccgggtgtctgtgtgtaatctagcctgcagcttcgatgcccaatataatgcttggttcatgcaacaatgctactacggctctccatacttttggaacaattaattattatattacttcatgctatatatttagattaataactggtaactttat

SEQ ID NO: 12701 - protein, 131 aa, Panicum virgatum
  misc_feature: Ceres CLONE 1765001
  misc_feature (35)..(131): Pfam Name: PsbR Pfam Description: Photosystem II 10 kDa polypeptide PsbR
MAASMITSSALVAPARAQGLPSHGRRASSFAVVCGTGKKIKTDKPFGIGGGLTVDHDASGRKVKGKGVYQFVDKYGANVDGYSPIYKEEDWFFTGDVYVGGTTGLLIWSVTLVGLLAGGALLVYNTSALAS

SEQ ID NO: 12702 - DNA, 880 bp, Panicum virgatum
  misc_feature: Ceres CLONE 1765014
  misc_feature: Encodes the peptide sequence at SEQ ID NO. 12703
acagcaaaaaagtgagaaaagtgaagcaaagcaacaaacaagcgagatcacccgtgacactacagcgagcctctccgtccatctccggttctccacctcacctgggcacgcaagcttcgatggcagccacggtgatggcctccatgagctccctcgccttcaccaccgccggcgcgcgtgccggcgccctccccgtccgcgtcccggcggccgctgcgctcgcgccgcggcggcgcgccatggtcgtcagggcccaggccgaggacgccgagccagcagctgaggagacaaccgcggcgccctccactcccctgacggcgaagcccaaggcggcggcggcgaggcccgggctgtgggacgcgctggcgttcagcgggccggcccccgagcgcatcaacgggcggctcgccatggtgggcttcgtgtccgcgctcgccgtcgaggcggcccgcggggacggcctcctcgcgcaggtcgggaacggcgccgggctcgcgtggttcgcgtacaccgccgtcgtgctgtccgcggcgtcgctggcgccgctgctccagggggagagcgccgaggacaggagcggcggcttcatgaccgccgacgccgagctctggaacggccgcctcgccatgctcgggctcgtcgcgctcgccgccaccgagtacctcaccggcgcgcccttggtcaacgtgtagatacggcgtacattacgtacgcatatgtgtagctgtatgtgtagaggaggtagtgtatatacgtgtgtatatgtatgtacggccgggggacttagtgagctgagctgctcggccaagtatagtagtcttggaacaccgtagcttgggttccctggtaaaaataagaggaaacgtggaaggacttcctt

SEQ ID NO: 12703 - protein, 190 aa, Panicum virgatum
  misc_feature: Ceres CLONE 1765014
  misc_feature (64)..(181): Pfam Name: Chloroa_b-bind Pfam Description: Chlorophyll A-B binding protein
  misc_feature: SWISSPROT Homolog: EC 4.99.1.1 Ferrochelatase
MAATVMASMSSLAFTTAGARAGALPVRVPAAAALAPRRRAMVVRAQAEDAEPAAEETTAAPSTPLTAKPKAAAARPGLWDALAFSGPAPERINGRLAMVGFVSALAVEAARGDGLLAQVGNGAGLAWFAYTAVVLSAASLAPLLQGESAEDRSGGFMTADAELWNGRLAMLGLVALAATEYLTGAPLVNV

SEQ ID NO: 12704 - DNA, 822 bp, Panicum virgatum
  misc_feature: Ceres CLONE 1765026
  misc_feature: Encodes the peptide sequence at SEQ ID NO. 12705
atcttgcgccgccgcctcctcccatccgctcctccgtccccctccctgctcacgcgacgtcaccggccccgcgccgccctccaccgccaagatgaacaaggagaggctcatgaagatggccggcgccgtccgcaccggcgggaagggcaccgtccgcaggaagaagaaggctgtccacaagacggccaccacggacgacaagaggctgcagagcacgctcaagagagtaggagtcaataccattcctgcaatcgaggaggtcaacatcttcaaggacgacctcgtcatccagttcttgaatcccaaagtccaagcgtccatcgctgcaaatttttgggtggtcagtggatccccacagacgaaaaagctacaagatgttctccctgggatcattaaccagttgggtcctgacaacatggagcacctgaagaggattgctgaagagatgcagaagcaggtggctgctgctggtgcagcagcacaggccaaggaagataatgatgatgatgttcccgagcttgttccaggagagacttttgaggaagtagctcaggaggcaaaggcctgatcatagactccaaatagtgaaatgttactcgaccgctgctatgtggtcatggttttcttgtgatggcactgttttgcgccccccacttaggccagccaccctttgtattcgcagtcggaaacttttagtttctccaagcatttacctaaagttatgcatgttgagatgccatggaatccattttgctggttttgatgattacatttgtggttggttcgcaaacatacgttaacagcactacagctgatgttacg

SEQ ID NO: 12705 - protein, 158 aa, Panicum virgatum
  misc_feature: Ceres CLONE 1765026
  misc_feature (34)..(92): Pfam Name: NAC Pfam Description: NAC domain
  misc_feature: The sequence is a functional homolog of SEQ ID NO 1614 in the 11/479,226 US patent application
  misc_feature: The sequence is a functional homolog of SEQ ID NO 784 in the 10/412,699 US patent application
  misc_feature: Useful for making plants with modulated biomass
  misc_feature: The sequence is a functional homolog of SEQ ID NO 1617 in the 11/479,226 US patent application
  misc_feature: The sequence is a functional homolog of SEQ ID NO 786 in the 10/412,699 US patent application
MNKERLMKMAGAVRTGGKGTVRRKKKAVHKTATTDDKRLQSTLKRVGVNTIPAIEEVNIFKDDLVIQFLNPKVQASIAANFWVVSGSPQTKKLQDVLPGIINQLGPDNMEHLKRIAEEMQKQVAAAGAAAQAKEDNDDDVPELVPGETFEEVAQEAKA

SEQ ID NO: 12706 - DNA, 751 bp, Panicum virgatum
  misc_feature: Ceres CLONE 1765034
  misc_feature: Encodes the peptide sequence at SEQ ID NO. 12707
ctacccgccgccgccgcttgctcctcctcaaagcagcgcctccgctgccatctcccgcgcctcgtctcgagcccccgctctccctttcggccatggcggccgtggaggtggatccggaggtggcggccgcggggcagccgaagaagaggacgttccgcaagtacagctaccgcggcgtggacctcgacgcgctcctcgacatgtccaccgacgacctcgtccagctcttccccgcgcgcgcgcgccggaggttccagaggggtctgaagaggaagcccatggcgctcatcaagaagctgcgcaaggcgaaaaaagatgctcctgctggtgaaaagccagagcccgtcaggacccacctccgcaacatgatcattgtgcctgagatgattggtagcatcatcggtgtctacaatggcaagacattcaaccaggttgagatcaagcctgagatgattggccactacctcgcagagttctccatctcgtacaagcctgtcaagcacggtaggcctggtatcggtgccacccactcctcacggttcattcccctcaagtgaggccggatatgtggttttgttctcttccagagtttgcttctccatgtagtttgggcagtcaagttgaactccatatagatgctatgtactgagtgttctattcagaaccttttattaactgttatgttactgtgacgtattatttcaatcaccttttcaccatttcggctcattgaatgaaaaattactttcat

SEQ ID NO: 12707 - protein, 154 aa, Panicum virgatum
  misc_feature: Ceres CLONE 1765034
  misc_feature (56)..(137): Pfam Name: Ribosomal_S19 Pfam Description: Ribosomal protein S19
MAAVEVDPEVAAAGQPKKRTFRKYSYRGVDLDALLDMSTDDLVQLFPARARRRFQRGLKRKPMALIKKLRKAKKDAPAGEKPEPVRTHLRNMIIVPEMIGSIIGVYNGKTFNQVEIKPEMIGHYLAEFSISYKPVKHGRPGIGATHSSRFIPLK

SEQ ID NO: 12708 - DNA, 681 bp, Panicum virgatum
  misc_feature: Ceres CLONE 1765070
  misc_feature: Encodes the peptide sequence at SEQ ID NO. 12709
acaaactcatcatacttacgcggcgctcgctcagcctagcccttcgatctccagagcttgttgcttccttcacgcgagcctagttaggcgaagcggccggcgtcgagtcgtcaatggagaagcatcgcgtcgacggcggcgtcaaggtcacctacatcgagacgcggttcgtcacctccgacgccgccggattcaaggacctcgtgcagcgcctcaccggcaggtcccccgccgccgccgccggcgacgcgccaacggccccaccgccggcggcgccgtgcaggccaggtgggggccggtccacgacggccgctgcggccggagctggggcgccgcaaggctacggttattattaccggccggtgcccgaggcggtgcgctgcccgggcgtcgacggccgcgcgccgccgtgcaaggaggaggacctgctgctcggcatcgacgacttgatctccgacctgttctacgttggtgccggcgagcagcggcgtcacgggctcagtagtgctggttacagcgatcttccctactattgatcgggcatatgtacgcccatgatcgttctccccctattattctttgagacggagcgagataagcttggtgccagtgaattacatgtacaaacagctgtaaccattacattcatttattcatttatagcacagtgtgcatatgtac

SEQ ID NO: 12709 - protein, 140 aa, Panicum virgatum
  misc_feature: Ceres CLONE 1765070
  misc_feature (13)..(43): Pfam Name: VQ Pfam Description: VQ motif
MEKHRVDGGVKVTYIETRFVTSDAAGFKDLVQRLTGRSPAAAAGDAPTAPPPAAPCRPGGGRSTTAAAAGAGAPQGYGYYYRPVPEAVRCPGVDGRAPPCKEEDLLLGIDDLISDLFYVGAGEQRRHGLSSAGYSDLPYY

SEQ ID NO: 12710 - DNA, 677 bp, Panicum virgatum
  misc_feature: Ceres CLONE 1765115
  misc_feature: Encodes the peptide sequence at SEQ ID NO. 12711
aaacagagtctcccaccctcgaggtccaggaccttgccgtgtaaactccgctccgagtccgggcagagcaggaggagcagaagccgcgtgagcagcatggcttccaagtggcacatctctatcattgtcctcgcgctgctttttgggggatccaaagccaacccagctgcaccttcccatagccagctggatgtaaaccacaagaagccactacaaacattcagaccttacaacattgcccacaggggctcaaatggtgaattaccggaagaaacagcagcggcctacctgagagctattgaagagggtgcagacttcatcgaaactgatatactcgcatcaaaggatggacatctgatctgttttcatgatgtaacattggacgcaacaaccgatgttgcgaaccggacagagtttgcccacaggaaaagaacttatgaagtccaaggaaccaaagttactggatggtttgttgtggacttcactcttaaagagcttaaatcgctgagggtgaaacaacggttcagtttcagggaccaacgatacaatggaaaataccagattattacatttgaggagtatatcttgattgcgctttatgcggacaggatagtaggaatatacccagagatcaaaaatccagttttcatcaaccagcatgtcaagtggtcgaatgg

SEQ ID NO: 12711 - protein, 193 aa, Panicum virgatum
  misc_feature: Ceres CLONE 1765115
  misc_feature: SWISSPROT Homolog: EC 3.1.4.46 Glycerophosphodiester phosphodiesterase
MASKWHISIIVLALLFGGSKANPAAPSHSQLDVNHKKPLQTFRPYNIAHRGSNGELPEETAAAYLRAIEEGADFIETDILASKDGHLICFHDVTLDATTDVANRTEFAHRKRTYEVQGTKVTGWFVVDFTLKELKSLRVKQRFSFRDQRYNGKYQIITFEEYILIALYADRIVGIYPEIKNPVFINQHVKWSN

SEQ ID NO: 12712 - DNA, 834 bp, Panicum virgatum
  misc_feature: Ceres CLONE 1765123
  misc_feature: Encodes the peptide sequence at SEQ ID NO. 12713
agcccctcgcgccgcccaccacacaacccccacccggcggaggagaggaggagcctctcggcggcggaggaagaagatggtgtcgctgaagctgcagaagcgcctcgccgcgagcgtcctcaagtgcggcaagggcaaggtctggctcgaccccaatgaggtcagcgagatctccatggcgaactcccgccagaacatcaggaagttggttaaggatggtttcatcatcaggaagcctcagaagatccactccaggtcccgtgcaaggagggcgcatgaggccaagcagaagggacgccactctggatatggtaagcgcaggggtaccagggaggctaggctccccaccaagattctctggatgcgtcgcatgagggttctgaggcgcctactccgcaagtacagggaggcaaagaagattgataaacatatgtatcatgagatgtatgttaaggtcaagggaaacagcttcaagaacaagagggtgctgatggagagcatccacaagtcaaaagctgagaaggcgagggagaagactctatctgatcagttcgaggccaggcgtgccaagagcaaggcgagcagagagagaaagcttgctaggagggaggagaggttggcccagggcccgagggaatctgcagcaccatcagctgctgctccagctccgtctgcagtggcaccaaagaaggctaagaagtgaagggttgatctgaagccttacctttcttgttccatgactagcctataattttgaagcgcctctgaactgcattttctgtcatatatcttcctgcactttggttggaaggataatgtagtagacttatttat

SEQ ID NO: 12713 - protein, 208 aa, Panicum virgatum
  misc_feature: Ceres CLONE 1765123
  misc_feature (2)..(149): Pfam Name: Ribosomal_L19e Pfam Description: Ribosomal protein L19e
MVSLKLQKRLAASVLKCGKGKVWLDPNEVSEISMANSRQNIRKLVKDGFIIRKPQKIHSRSRARRAHEAKQKGRHSGYGKRRGTREARLPTKILWMRRMRVLRRLLRKYREAKKIDKHMYHEMYVKVKGNSFKNKRVLMESIHKSKAEKAREKTLSDQFEARRAKSKASRERKLARREERLAQGPRESAAPSAAAPAPSAVAPKKAKK

SEQ ID NO: 12714 - DNA, 705 bp, Panicum virgatum
  misc_feature: Ceres CLONE 1765131
  misc_feature: Encodes the peptide sequence at SEQ ID NO. 12715
agaaacgcgcagatacccccaatcgccgccgcctcctcgactcttcgccgctccgctcccctccccccgcgacctcgctgccggcttcgccaaatcgccgcctccccgactctcgccgctcccgccggctccatcccgcccgcgagtcgccgccggcttcgggtcgccccgctcccctccatggctgggagacacaccattatcctgatgcaaccatcccaaaatagggcttctaggacatttatggattataattcaattaaccatgcattggatggaatctgtgggctttatgaaaggaaaattagggatatcaaccccatggcccccataacctatgatatcagtgacctttataatttcattgatggcctagctgacataagtgcactggtttatgatcactcaattcaggcatttctgccatatgatcgacagtggatcaagcaaaagttgctccaacacctgaagaagctggctcagcggtagcatgactgtttgtttgctccggtaccttgtcaccaacaagcaagcatgtgtggtgatgggtgtccagtgagtgtatcgggcggtgtttcttgtaaaattatgaaatgttacacttacattgcagattgcacccttgtgctgtggatgttggactcggttattagcggattgcctgtggcaccctatatatttgataaacttgtctggttgtttttg

SEQ ID NO: 12715 - protein, 102 aa, Panicum virgatum
  misc_feature: Ceres CLONE 1765131
  misc_feature (3)..(102): Pfam Name: ER Pfam Description: Enhancer of rudimentary
MAGRHTIILMQPSQNRASRTFMDYNSINHALDGICGLYERKIRDINPMAPITYDISDLYNFIDGLADISALVYDHSIQAFLPYDRQWIKQKLLQHLKKLAQR

SEQ ID NO: 12716 - DNA, 665 bp, Panicum virgatum
  misc_feature: Ceres CLONE 1765136
  misc_feature: Encodes the peptide sequence at SEQ ID NO. 12717
atcgggacgggaaccgaggaggagtagagggaggagacacaacacaacaaccgcgtccgtccagtgtgtccactcctcgcgtgagaaagaagcggtagtgggcgcgcgcgagagacagagatggcaactccggcgacggcggcggcggcgacaccggtggcaccggctgaggggacggtgatcgcgatccacagcctggacgcgtggagcacccagatcgagcaggccaacagcgccaagaagctggtgctgatcgacttcaccgcatcttggtgtggaccatgccgcatcatggctccaattttcactgatatggccaagaagaatccaaatgtcgttttcctgaaggttgatgttgatgaaatgaaggccattgctgagcaattcagtgtcgaggccatgccgaccttcctgttcatgaaggaaggtgacgtcaaggacagggtcgtcggcgcaattaaggatgaactggcccagaagcttcagctccaccagaccctgtagaccagtataatgctataatgaagtagtattcgcctaaataagaagaagcatcaactcagagagaactagtgcctctataatggtacttcgtatgtagtattaactatcctactctgctgcccagtttctggataatgatatgatcaggccctgcttgttcc

SEQ ID NO: 12717 - protein, 127 aa, Panicum virgatum
  misc_feature: Ceres CLONE 1765136
  misc_feature (20)..(124): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MATPATAAAATPVAPAEGTVIAIHSLDAWSTQIEQANSAKKLVLIDFTASWCGPCRIMAPIFTDMAKKNPNVVFLKVDVDEMKAIAEQFSVEAMPTFLFMKEGDVKDRVVGAIKDELAQKLQLHQTL

SEQ ID NO: 12718 - DNA, 808 bp, Panicum virgatum
  misc_feature: Ceres CLONE 1765137
  misc_feature: Encodes the peptide sequence at SEQ ID NO. 12719
cggcttctctctggcacgcccccgaccaacccccgccatggcgctcgcttccggcacctccagcaccctcctcggccgccccgctggcaccgcgcggccccaccccgcggtctcctcctcctccgcctcatcgatccggttcccccgcggcggcggcagggctgtctcgcttcgcgtctcctcccctccagtagcagccgccgcagcagcagcaacatctggtagtattgctccagctatttcattgaccaaaaaggccttgaaacatctgaacaaaatgagggctgaacgggatgaagatctgtgtttgagaattggagtgaaacagggtggctgctctggcatgtcttacaccatggagtttgaaagtcgagcgaatgccagccctgatgattcaattgtagaatatgatgggtttgcaatagtatgtgatccaaagagccttctcttcatgtttggaatggagctggactacagcgacgcgcttatcggcggtggcttctccttccagaatccaaatgcaacaaaaacctgtgggtgtggcaaatctttcgcgaccagcaaagaaactgagagcgcagcaactgcttgcaacaactaagatagatccataatcatgccaagcagtgttgtaacatgccatatagatatagcttgcaccagttggattctggtggctataccacgggtgcatacagaagactgtaagggtttctcgatttgtaatactgcattcaacagtctagaatgtattcagcaatatgttactgctgtaagcctgtaaactgctcaatagaattcaaagatg

SEQ ID NO: 12719 - protein, 187 aa, Panicum virgatum
  misc_feature: Ceres CLONE 1765137
  misc_feature (68)..(160): Pfam Name: Fe-S_biosyn Pfam Description: Iron-sulphur cluster biosynthesis
MALASGTSSTLLGRPAGTARPHPAVSSSSASSIRFPRGGGRAVSLRVSSPPVAAAAAAATSGSIAPAISLTKKALKHLNKMRAERDEDLCLRIGVKQGGCSGMSYTMEFESRANASPDDSIVEYDGFAIVCDPKSLLFMFGMELDYSDALIGGGFSFQNPNATKTCGCGKSFATSKETESAATACNN

SEQ ID NO: 12720 - DNA, 626 bp, Panicum virgatum
  misc_feature: Ceres CLONE 1765143
  misc_feature: Encodes the peptide sequence at SEQ ID NO. 12721
attcctactcgccgcctccacgcctccgagccaccccaaaacctagcgccggcgccgccacctcgtcgtccggatcctccgcgcccccagcagcagcgatggcccgcctctccgcagccgccgtgatcgcctccttcgtggccgtggccgcgctggccaccgcggcctccgccgccgatgcgccggcccccgcaccggcctccggcgcgggcgccctctcggcgccgctctccgtgtgctgcctggccgcgctcctcgcggccgtcctccgccactgagccggcggcggccgcctctcccctcccgcgtccgcgtcttcgtcagatctagtagtacagtggtagcgagagtctcttagtggtagtagcagtgttcttagcggtggtggcagtgtcgtggtggggagaggccattgtgctttggtgtccgccgggccgatggatctgagggttttcgtctggggatttcgagagctttttttgttgggtggatttgatttgattagcatggttggtgtgagtcaattcctattatttattgtgtgcgtttgtgtacctatagtgctcagtggctctgagagtattattattattatttattatttattgttgatttatgatattatt

SEQ ID NO: 12721 - protein, 59 aa, Panicum virgatum
  misc_feature: Ceres CLONE 1765143
  misc_feature: Useful for making plants with altered carbohydrate content
MARLSAAAVIASFVAVAALATAASAADAPAPAPASGAGALSAPLSVCCLAALLAAVLRH

SEQ ID NO: 12722 - DNA, 380 bp, Panicum virgatum
  misc_feature: Ceres CLONE 1765156
  misc_feature: Encodes the peptide sequence at SEQ ID NO. 12723
accgacaaccattttttttcccgcggcggcggcggcggcggctacggcggcggtcgtcagggtggctacggcggcggcggcggcggctacggaggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttcc

SEQ ID NO: 12723 - protein, 75 aa, Panicum virgatum
  misc_feature: Ceres CLONE 1765156
  misc_feature: Useful for making plants with altered alkaloid content
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with modulated nitrogen use efficiency
  misc_feature: Useful for making plants with altered lignin content
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Useful for making plants with modulated flowering time
  misc_feature: Useful for making plants with altered terpenoid content
  misc_feature: Useful for making plants with modulated phosphate use efficiency
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Useful for making plants with modulated biomass
TDNHFFSRGGGGGGYGGGRQGGYGGGGGGYGGGGGYGGGRREGGYGGGGGGGRREGGYGGGGYGSRGDSGGNWRN

SEQ ID NO: 12724 - DNA, 446 bp, Panicum virgatum
  misc_feature: Ceres CLONE 1765174
  misc_feature: Encodes the peptide sequence at SEQ ID NO. 12725
ccgaaaccctagctttcctcacgctgcgccgccgacggtgactaggagcaggagccgccgagccggaagagggatctgcgatggccaagtcaaagaaccacacggcgcacaaccagtcgttcaaggcgcacaagaacggcatcaagaagcccaagcgccaccgccagacctccaccaaggggatggacccaaagttcctgaggaacctgaggtactcgaggaagaacaacaagaagagcggtgaggctgaggctgaggagtaaactggtggaatttcagatgatgaattcctgttttgtatcgctagggtctactgcagtcttgaatttaatgctctgttctgtatgatctaaggagattccttagttggtactaaagctttttttctttcttttttgtcttgctgcctggctggattttgaattaaaatcgttatttgcagcgtt

SEQ ID NO: 12725 - protein, 60 aa, Panicum virgatum
  misc_feature: Ceres CLONE 1765174
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSRKNNKKSGEAEAEE

SEQ ID NO: 12726 - DNA, 712 bp, Panicum virgatum
  misc_feature: Ceres CLONE 1765181
  misc_feature: Encodes the peptide sequence at SEQ ID NO. 12727
gcacagctagcggcctgtcgagcttagcagccgtagtgcctgtcaactgtcatacccatccctctcgccccgggctctctccagctctcggccagccatggcggcggagaggctggaggcggcgccggccgccggcgacgagtacacgcaggacggcacgaccgacctccacggcaaccccgtgctccggtccaagcggggagggtggaaagcctgcggcttcgttgtagtgtacgaggtgttcgagcggatggcgttctacggcatctcgtcgaacctggtgctgtacctgacgacgaagctgcaccagggcgtggtgccgtcggcgaacaacgtcaccaactgggcgggcaccatctggatgacgcccgtcatcggcgcctacgtcgctgacgcgcacctcggccgctaccgcaccttcatggccgcctccgtcatctacctctgcgtaagtcgccgccgttcatgaccagcaggcagcagcagaatatttttctttttttgtggtcttgttccctgcagccttttcccgtttcctctgtcgcgctctctgttcgtttctcccttggattgggattggatggcgctttcttgtgcagcttgctttcactttcagtgtagtaatagtacagtgttagctgttgtttgcagtgtgctgtgtttcttgtgatttttaataatgagaaaaaaaaggtgtgcttgtcgtaaagct

SEQ ID NO: 12727 - protein, 123 aa, Panicum virgatum
  misc_feature: Ceres CLONE 1765181
  misc_feature: Useful for making plants with altered carbon content
  misc_feature: Useful for making plants with altered nitrogen content
MAAERLEAAPAAGDEYTQDGTTDLHGNPVLRSKRGGWKACGFVVVYEVFERMAFYGISSNLVLYLTTKLHQGVVPSANNVTNWAGTIWMTPVIGAYVADAHLGRYRTFMAASVIYLCVSRRRS

SEQ ID NO: 12728 - DNA, 856 bp, Panicum virgatum
  misc_feature: Ceres CLONE 1765187
  misc_feature: Encodes the peptide sequence at SEQ ID NO. 12729
tctctcttcccagcactctctctctactcctcacgagcacgcacaccatcaccacaagaccccaaggctagacagctcaggcttctctccactcccccccgttccccaacgcgctttcttcccccttcccctcctctcgccgccgccgcctgcattccgtcgagcaactccgcgcggcggccatggcgaagctcgcgctggcgctgctgctgctcctggccgtggccctcggcgtcggccgcggcgtccgtcgacctggacctgggcttcctcgcctcgggcggcggcgcccggagggagtgccgcggcacggtggccgagtgcctggccgaggacgaggaggccgagctcggctccgcctccgccgagtcgcaccgccgcgcgctcgccggccgcggctacatcagctacggcgcgctccgccgcgacaacgtgccctgctcccgccgcggcgccagctactacaactgccgccccggcgcgcaggccaacccctaccaccgcggctgctcccgcatcacccgctgccgcggctgagctcccgccgccggccgccgccccctccctcctcaggtgccctccgccgccggatccgccgccgggagcggggaaaggccggatctttcgccgctcctcctcctcccccggcgccgccgccgccgctgagttctaaaaaaataagttcttttttgtttctgctgctgctactgttgccttacaagtactagagctatggatttgttggttgtcggtgtatggatttgtgttgggttcgtcgtgctgtttgtaaagtaagacgtcgattgattcgtgcccctatggctacttaaatatgaacatatactcctattctttt

SEQ ID NO: 12729 - protein, 178 aa, Panicum virgatum
  misc_feature: Ceres CLONE 1765187
  misc_feature (113)..(178): Pfam Name: RALF Pfam Description: Rapid ALkalinization Factor (RALF)
  misc_feature: Useful for making plants with modulated biomass
SLFPALSLYSSRARTPSPQDPKARQLRLLSTPPRSPTRFLPPSPPLAAAACIPSSNSARRPWRSSRWRCCCSWPWPSASAAASVDLDLGFLASGGGARRECRGTVAECLAEDEEAELGSASAESHRRALAGRGYISYGALRRDNVPCSRRGASYYNCRPGAQANPYHRGCSRITRCRG

SEQ ID NO: 12730 - DNA, 772 bp, Panicum virgatum
  misc_feature: Ceres CLONE 1765198
  misc_feature: Encodes the peptide sequence at SEQ ID NO. 12731
agataagcctttccagatcatactaaaccaagcagccacttcacactagagcacttggatcacacaagaaagttcaggtcagaagaagatgcaggccgccgccgctacagccgtcgggttctcggctgcggcgcccgtgaagagcaggccggcggcgaggagcacggtggtcgctcgtgtcccagccacacggaggagcgttcgcgtcgccgtggccgccgccatcgtcgcggcggagcccgccgaggtcgactacagctcgagcttctcggtgttccccatggaggcctgcgatctgctcggcggcgacgcctgcagcgcgcagatgtacccggaggctaagctcgcctgcgcggcggaggtggcgggcaggagggaggaggaggcggtggagagggactacctgtcctacgacgagccgacgacggttttccccggcgaggcgtgcgacgacctcggcggcgagttctgcgaggcgccgtaccaggccggcgtgtccagggagctggcgcacgcctgatcgggtcgaagggtgatgggaagctagcagatgatgcttacgcggtagatggggagctagcgtacgcgcacgtacagaataacagcagccaagcaaggccaaggacttgtcacgtgtgtaaatgtgcatgtctctttggtcgtgtcagctgcctgtctgtagaaactaaagatgaaatatatggtactggtggtgatgctgttttacagcttcaaaagattcagtaaacaagctatgaacataccttaaacc

SEQ ID NO: 12731 - protein, 143 aa, Panicum virgatum
  misc_feature: Ceres CLONE 1765198
  misc_feature (1)..(131): Pfam Name: Lir1 Pfam Description: Light regulated protein Lir1
MQAAAATAVGFSAAAPVKSRPAARSTVVARVPATRRSVRVAVAAAIVAAEPAEVDYSSSFSVFPMEACDLLGGDACSAQMYPEAKLACAAEVAGRREEEAVERDYLSYDEPTTVFPGEACDDLGGEFCEAPYQAGVSRELAHA

SEQ ID NO: 12732 - DNA, 819 bp, Panicum virgatum
  misc_feature: Ceres CLONE 1765215
  misc_feature: Encodes the peptide sequence at SEQ ID NO. 12733
gagcgaatccaacatcgggagaagattcgcgtggaaacgacctttcccctttctccggccaaggcgatcgaacaaaccctcaaacccaaccccgtcggctcctgctcctgctcctctcggccccgtcgatccatcggcgatgacgccacgaagctccgccgccggatcgggcgtcgttgttcctcggaacttcagactactagaagagctcgagcgtggggagaagggcattggagatggtacagtgagctatggaatggatgatgcagatgacatctacatgagatcatggactggcactatcattggcccacataatacagtccatgagggtcgcatctaccagctgaagttgttctgtgacaaggactaccctgagaagccaccatctgttagatttcattcaagaataaacatgacatgtgttaatcatgagactggagtggttgacccaaagaagttcagtatactggcaaactggcagcgggagtacacaatggagtacattctgacccagctcaagaaagagatggcctccccgcataaccgcaaactagtgcagcctccagaaggaacattcttctgaaatagctatttgctgccccatctgcggattcaacagcagaatctcatggccatccatggtgactccaaaaacagcttcttcacttggtagctatggttgatttctagtatgtgtgcctactatctgttaacccaccgcctcgatagcgtacgagtgaatttggttccttcaaatttttctggtggttgctaaagagatggaatgaaatggttcccagtttggctggtcttctt

SEQ ID NO: 12733 - protein, 148 aa, Panicum virgatum
  misc_feature: Ceres CLONE 1765215
  misc_feature (19)..(140): Pfam Name: UQ_con Pfam Description: Ubiquitin-conjugating enzyme
  misc_feature: SWISSPROT Homolog: EC 6.3.2.19 Ubiquitin--protein ligase
MTPRSSAAGSGVVVPRNFRLLEELERGEKGIGDGTVSYGMDDADDIYMRSWTGTIIGPHNTVHEGRIYQLKLFCDKDYPEKPPSVRFHSRINMTCVNHETGVVDPKKFSILANWQREYTMEYILTQLKKEMASPHNRKLVQPPEGTFF

SEQ ID NO: 12734 - DNA, 779 bp, Panicum virgatum
  misc_feature: Ceres CLONE 1765235
  misc_feature: Encodes the peptide sequence at SEQ ID NO. 12735
ctctcgctcgctcgctcgccacgcatcgctcttcctgctcatctccgaggtcggtccttcttgcaactgcagccatggctgctcccgtcgccgcagccaccggaagatccgcctactcccctgcgctacggggaatggatgcggtgtcgtttcgagtatcagcatctttccccaggcaaagagcaagctttccatcaattcgggtgcagcggattccaaagcgctttcaggtgtcatgctcggctaaacaagaaactattgagaaggtttgtgaaatagtgaagggtcagttagctctacctgaagacagcactgtaacaggaaagacaaagtttgtggaccttggagctgattcacttgacactgtcgaaattgtgatggggcttgaggaggcattccaaatcagcgtggatgaatcaagcgctcaggagatccaaacggtgggggacgctgcggctctcatcgacaagcttatcacagagaaggttgcttgaaaggactggagtcatggagtatccttaatgaatagttttgcaggcacctacgttgctctctggatggtggaggccatgcttcctagcaatgcatttagttagaactctctgggatgcgtgccttttgggattaataaaagagggaatcgtcctatttccctgatagacgtagtctttttttgtcttaatattgtgagagacagtattccattcacgtagctgaaaacgttgtcgcaatttgttgcaatgaatttgaaccttttcacccataacttccaagccagt

SEQ ID NO: 12735 - protein, 139 aa, Panicum virgatum
  misc_feature: Ceres CLONE 1765235
  misc_feature (63)..(130): Pfam Name: PP-binding Pfam Description: Phosphopantetheine attachment site
MAAPVAAATGRSAYSPALRGMDAVSFRVSASFPRQRASFPSIRVQRIPKRFQVSCSAKQETIEKVCEIVKGQLALPEDSTVTGKTKFVDLGADSLDTVEIVMGLEEAFQISVDESSAQEIQTVGDAAALIDKLITEKVA

SEQ ID NO: 12736 - DNA, 755 bp, Panicum virgatum
  misc_feature: Ceres CLONE 1765269
  misc_feature: Encodes the peptide sequence at SEQ ID NO. 12737
acacctcagtgacctcaccctctctcactctttcactctctccatccagcgcgagagggggcagcaggtcggcagcagagcgagagcgcgcgtgccagcccatggcgagcaccaacatggcgtcggccacctcgcggttcatgctggccgcgggcgtgcccgcggcggcgggcagcggcggccgcgtcggcttcgcgtcgccgcccggcagggtgcagggcaggaggctcgtggcgcgcgccgaggaggaggccgcgcccgcggcggaaggggagggcgccgtggccaccaagcccaaggccgagaagccgccgccgatcgggcccaagaggggcgccaaggtgaagatcctgaggagggagtcctactggtacaacgggattggcaacgtcgtcacagttgatcaggaccccaacacccgctacccggtggtggtgcggttcaacaaggtgaactacgccggcgtgtccaccaacaactacgccttggacgagatccaggaggtgaaaggaaaatgagccaggctgcctcaagggccgccgtgcccccgtgttgtcactgtagcctgtgaaacgagggtgttaaagctgctgtgctagcgcgtcacgacatcttgtgtgtaatagcttaatctctgtaatcattgtgtaattgcttgcttgctacaccatggacggctcaataatctcctgctcttaagctgttgtattcttttcttgtgattttgtacatgcacataaaccccttttcctgtc

SEQ ID NO: 12737 - protein, 138 aa, Panicum virgatum
  misc_feature: Ceres CLONE 1765269
  misc_feature (75)..(136): Pfam Name: PSI_PsaE Pfam Description: Photosystem I reaction centre subunit IV / PsaE
MASTNMASATSRFMLAAGVPAAAGSGGRVGFASPPGRVQGRRLVARAEEEAAPAAEGEGAVATKPKAEKPPPIGPKRGAKVKILRRESYWYNGIGNVVTVDQDPNTRYPVVVRFNKVNYAGVSTNNYALDEIQEVKGK

SEQ ID NO: 12738 - DNA, 856 bp, Panicum virgatum
  misc_feature: Ceres CLONE 1765272
  misc_feature: Encodes the peptide sequence at SEQ ID NO. 12739
ctcaaatcgctccctgcctccggtcgccctccccacccccctgcctgcctaatctctccggccagcccgccgccgttcgtccgctcgcgcgcgcccgcccgcccgccgctcggagagagaagaccggagaccatggcggaccagctcaccgacgaccagatcgccgagttcaaggaggccttcagcctcttcgacaaggacggcgacggttgcatcacaaccaaggagctgggaactgtcatgcgctccttgggtcagaacccaaccgaagctgagctccaggacatgatcaacgaggttgacgctgatggcaacggcaccatcgacttccccgagttcctcaacctcatggcccgcaaaatgaaggacaccgactccgaggaggagctcaaggaggcgttcagggtgttcgacaaggaccagaacggcttcatctccgccgcggagctccgccacgtgatgaccaacctcggcgagaagctgaccgacgaggaggtggacgaaatgatccgcgaggcggatgtcgacggtgacggccagatcaactacgaggagttcgtcaaggtgatgatggccaagtgaggccgtgtttgatggtatactaccccccgcctgaaggaggaaaccgtgcattgcgtattagtaagccatgcggctcatgtttccttcatcttcccctgaagaaaatcgtactagctgtagctgctgaacatttgagtccctctgctgccacccctgcctctgcctgccccagtgtgtcgtcgaacgaacctcttgcttcctgtgtgaatctgtacggctttgcttgttctggaccctgattgcggttgaatccagtttgtagttctatttgttc

SEQ ID NO: 12739 - protein, 149 aa, Panicum virgatum; identical to SEQ ID NO: 12456
  misc_feature: Ceres CLONE 1765272
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Useful for making plants with modulated salt sensitivity

SEQ ID NO: 12740 - DNA, 999 bp, Panicum virgatum
  misc_feature: Ceres CLONE 1765305
  misc_feature: Encodes the peptide sequence at SEQ ID NO. 12741
actagaactgcaactactaggaggagctagcctagcacggccattgaagcgagaaacttgcagctgctcccacttgtgcaaccatgatcaagctgaggtactccaagaggctcttcaagaggagcccctcgtcgaagcaggcggccgcttgcggcggcggcagcaatggcggcgcggccggcgccggcggtggagctggggagattgagtaggaggtgaggccgggggggatgctggtgcagaagagggacgggaagggcggcgaggaggtgatcgtggtcagggtgtccaccggctactcctggcatgatgtgtccatcggagccacctccacttttggggagctgaagctaatgctgtccatggtgactggtctagagcccagggagcagaggctgcttttcaggggcaaggagagggaggacaccgaccacctccacatggtcggggtgagggacaaggacaaggtgcttcttcttgaggaccctgccctcaaggacatgaagctccgggctctcgcagcccaagtcgtgcagagcccgtgccagccttttatccaagtgtagtccgcctggcccggcgttgttctaactgtcactactacttactagatcatgcaccgtactatttagtccatcgtgaaggtaattttaatttctggaaggttttttatatccggaattcgagggatttgttctccaaacccctcttagtgccgctccatggaagggctatggatccctgaaggtgagagtgagagagcctttttaatcatgtagttagttacaagtgccagccatgttggttgtgaacttgtgatgtgatgttaagcctgatgttgggcttgttttatggtccctactactttggtcatttctcattccaacaaatccagcatgggtcatggataggaatgagaaagattgtatgtatcttgtgttcctgttcccaatgaatggatgaaaccaagcgtgtgtcccttttccatgatagaatttc

SEQ ID NO: 12741 - protein, 111 aa, Panicum virgatum
  misc_feature: Ceres CLONE 1765305
  misc_feature (18)..(87): Pfam Name: ubiquitin Pfam Description: Ubiquitin family
MLVQKRDGKGGEEVIVVRVSTGYSWHDVSIGATSTFGELKLMLSMVTGLEPREQRLLFRGKEREDTDHLHMVGVRDKDKVLLLEDPALKDMKLRALAAQVVQSPCQPFIQV

SEQ ID NO: 12742 - DNA, 792 bp, Panicum virgatum
  misc_feature: Ceres CLONE 1765315
  misc_feature: Encodes the peptide sequence at SEQ ID NO. 12743
aaaccttagccgcgcggacgcccaccaccacctgcgacttcccgccgtcgccgcctcgctccgcgcgaccgatctgccgccgccaccatgtcgctgatcgccggtgaggacttccagcacatcctgcgtctgctgaacaccaacgtggatgggaagcagaagatcatgttcgcgctcacctccatcaagggtgtcggccgccgcttctccaacatcgtctgcaagaaggccgacattgacatgaacaagagggctggcgagctgtcgcctgacgagctggagaggctgatgacggtggtggcgaaccccaggcagttcaaggtgccggactggttcctcaacaggaagaaggactacaaggacggcaggttctcgcaggtcgtctccaacgccctcgacatgaagctcaggaacgacctcgagagactcaagaagatcaggaaccaccgcggtctgcgtcactactggggcctccgtgtccgcggccagcacaccaagactactggcaggcgtggaaagaccgttggtgtctccaagaagcgataagctatatctaccaatcttggccttattactgtgttggttcatgtccaaacagtcttgataaagagtttctgtttagacagtacctgaaatgatgttttgccctaggataatcatgcagttatggaaccttaatatattgtatcgtacagtttgttttttgcaacttctaagagcaatttgattttgatgagacagttgcggattgactctttacatttattattgtaatctgagtgatcttttctc

SEQ ID NO: 12743 - protein, 152 aa, Panicum virgatum
  misc_feature: Ceres CLONE 1765315
  misc_feature (14)..(142): Pfam Name: Ribosomal_S13 Pfam Description: Ribosomal protein S13/S18
MSLIAGEDFQHILRLLNTNVDGKQKIMFALTSIKGVGRRFSNIVCKKADIDMNKRAGELSPDELERLMTVVANPRQFKVPDWFLNRKKDYKDGRFSQVVSNALDMKLRNDLERLKKIRNHRGLRHYWGLRVRGQHTKTTGRRGKTVGVSKKR

SEQ ID NO: 12744 - DNA, 579 bp, Panicum virgatum
  misc_feature: Ceres CLONE 1765327
  misc_feature: Encodes the peptide sequence at SEQ ID NO. 12745
acccaatccgccaaaccctaggcgcggcggcgatggcggcggcgggcctgcggaagggaaacgcgcgtctcccgccggaggtgaaccggattctctacgtgcggaacctgcccttcaacatctcgagcgaggagatgtacgacatcttcggcaagtacggcgccatccggcagatccggctgggcaacgccaaggacacgcgcggcaccgcctacgtcgtctacgaggacatctacgacgccaagaacgccgtcgaccacctctccggcttcaacgtcgccaaccgctacctcatcgtgctctactaccagcccgccaagatgtccaagaagtccgacgtcaagaagaaggaggaggagatcaccaggctccaggagaagtatggagtcgggtccaagacccccggccccggctccagcgactgagcgaccaggggcagtgcctctgcggtcgcttgtctggagaagagcaagcagagggaacgaattggtagagctgtgctatgtctcatccagtgttaccaattactgcgttgttatactttgaccatcacagctgaatagatatgtgcttatcacg

SEQ ID NO: 12745 - protein, 130 aa, Panicum virgatum
  misc_feature: Ceres CLONE 1765327
  misc_feature (21)..(89): Pfam Name: RRM_1 Pfam Description: RNA recognition motif. (a.k.a. RRM, RBD, or RNP domain)
MAAAGLRKGNARLPPEVNRILYVRNLPFNISSEEMYDIFGKYGAIRQIRLGNAKDTRGTAYVVYEDIYDAKNAVDHLSGFNVANRYLIVLYYQPAKMSKKSDVKKKEEEITRLQEKYGVGSKTPGPGSSD

SEQ ID NO: 12746 - DNA, 752 bp, Panicum virgatum
  misc_feature: Ceres CLONE 1765328
  misc_feature: Encodes the peptide sequence at SEQ ID NO. 12747
ggatcttccgtctcgcgcgactcgcccacaagcctccggttccgtccgccgtttcgccgtcgtcgttgggaggtagcgagaagagatggcgggccgtggcaaggcgatcggcgcgggcgcggcgaagaaggcgacgtcgaggagctccaaggccgggctccagttccccgtcggcaggatcgccaggttcctcaaggctggcaagtacgccgagcgcgtcggcgccggcgcccccgtctacctcgccgccgtcctcgagtacctcgccgctgaggttcttgagctggccgggaacgctgcgagggacaacaagaagacccgcatcgtgcctcgccacatccagctggctgtccgcaacgacgaggagctgacgaagctgctcggcagcgccaccatcgcgagcggcggcgtcatgccgaacatccaccagcacttgctccccaagaaggccgccccgtccaaggcctccagccacgacgacgacgacaactgaggcatcctgctgccgtcttgttgctggtttggtaggagtagcgttttgttgttttggtgatacctgcgagagcttgatgtgttggggatggggaagtaggataagaaggttgcaataggttcttggctggttggcaatgttctttgaatgggatgggaataccgctaagtttttgggttgtggaactcagggatggaaggcaaatgatgttttaatttatcgttgaagaaatgaaatgttaagaagtgaaacttcaatc

SEQ ID NO: 12747 - protein, 135 aa, Panicum virgatum
  misc_feature: Ceres CLONE 1765328
  misc_feature (19)..(92): Pfam Name: Histone Pfam Description: Core histone H2A/H2B/H3/H4
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGSATIASGGVMPNIHQHLLPKKAAPSKASSHDDDDN

SEQ ID NO: 12748 - DNA, 747 bp, Panicum virgatum
  misc_feature: Ceres CLONE 1765336
  misc_feature: Encodes the peptide sequence at SEQ ID NO. 12749
aggctcaggggggtcggggctcatctcctctgtttctcgagcaaacctttcccttctcttggacagcgacgactcgactgggcgagcggcggcgccgtctgtcacgtcttcgcccagctctttgccggcgacgagcgcatcctccagcttcaagcggaaggcgccgcttcttcaagatgccgaggtccacgagcgatgcaaagcttctgatccagtccctgagcaaggcgtatgctgccacaccaacaaatcttaagattatcgacctgtatgtcatttgtgctgtcgctactgccgtgattcagattgcatacatgggattggttgggtcattccctttcaactccttcctctcaggtgtcctttcatgcataggaactgcagtacttgctgtttgcctccgcattcaagtgaacaaagacaacaaggaatttaaggatcttcccccagaaagggcctttgctgacttcgttctgtgcaacctggtgctccacctggtgatcatgaacttccttggataagcaaccgctgtacaccgagtggttaagattttgtagccccagattgtgttcgctgatcagtgtgtttaaatctttggaactgtcataatgccgagtatccatatgacttgtcacagattacctatgtaaagacagaattcttgagtccagtgttgacaatgttatactgcgagcatttgtgtaattcaaggaagtgaaatggctatatgttacatcattttagctg

SEQ ID NO: 12749 - protein, 114 aa, Panicum virgatum
  misc_feature: Ceres CLONE 1765336
  misc_feature (3)..(114): Pfam Name: DAD Pfam Description: DAD family
  misc_feature: SWISSPROT Homolog: EC 2.4.1.119 Dolichyl-diphosphooligosaccharide--protein glycotransferase
  misc_feature: Useful for making plants with modulated flowering time
MPRSTSDAKLLIQSLSKAYAATPTNLKIIDLYVICAVATAVIQIAYMGLVGSFPFNSFLSGVLSCIGTAVLAVCLRIQVNKDNKEFKDLPPERAFADFVLCNLVLHLVIMNFLG

SEQ ID NO: 12750 - DNA, 834 bp, Panicum virgatum
  misc_feature: Ceres CLONE 1765337
  misc_feature: Encodes the peptide sequence at SEQ ID NO. 12751
aagtatctcactgaccgggcttccccgaggtgatgcgattcgcgactcctccagcggcctagccaagtgcccccaattcacaacgcatcctgccatcctcgtctcctctcccaccctcgaccgcgattaacactagcgacagccgcgctctctcttgatctccgcggggagctccagatctgcaggccggcggctcagcgtccggatcgggaagcgaagatgacggaggcctgggtgcggaacaagccggggatggccagcgtcaaggagatgccgctggtgcaggacggcccgccgccgggcgggttcgcgcccgtgcgctacgcgcgccggatccccacatcgaggcccagcgccaccgtcatcttcctcaccgccttcggcgccttcgcgtacggcatgtaccaggtcggccaggggaacaaggtccgccgtgcgctcaaagaagagaagattgcggcccgtagtgctatactgccgatgctccaagctgaagaggatgaaagatttgtcaaagagtggaagaagtatcttgaggaggaggccaggatcatgaaagatgttccaggatggaaggttggcgagagcgtgtacaactctgggaaatggatgcctccggctactggtgaactccgccctgaggtttggtaagggcctactgccagcgctgataatttcatcatgtcatgaggacatgaataaggcctctaaacctgtgtacctttatttttttcctttaccaaggatcgactccttaaacacctctgtttgttgtggtgtatgaaatttgactggctaataattggacatatcaagccgacttccttgtcttcc

SEQ ID NO: 12751 - protein, 143 aa, Panicum virgatum
  misc_feature: Ceres CLONE 1765337
  misc_feature (16)..(141): Pfam Name: GRIM-19 Pfam Description: GRIM-19 protein
MTEAWVRNKPGMASVKEMPLVQDGPPPGGFAPVRYARRIPTSRPSATVIFLTAFGAFAYGMYQVGQGNKVRRALKEEKIAARSAILPMLQAEEDERFVKEWKKYLEEEARIMKDVPGWKVGESVYNSGKWMPPATGELRPEVW

SEQ ID NO: 12752 - DNA, 822 bp, Panicum virgatum
  misc_feature: Ceres CLONE 1765351
  misc_feature: Encodes the peptide sequence at SEQ ID NO. 12753
gatcccgagactgctcgaccggagaagtgcacacacaagccagccaaggcccccgagctgctgagatggcacaagccatggcgtccatgaccggcctctcgcagggcgtgctgcccagcaggcgcgccgccagcagggccagggcggccgtcgtcagggcatcggccgagggcgaggccgcggcgcaggctggccgccgcgccgtgctcgggctggtggccaccggcatcgtcggcggcgtcttcacccaggcggtgcgcgccgatgaggccgtcaagaccatcaagatcgggcccccgccgccgccctctgggggacttcccgggaccttgaactctgaccaggccagggacttcgacctcgccttgaaggagcggttctacctgcagccgttgccaccggcggaggccgcagccagggccaagtcgtcgacgcaggacatcctcaacctcaagccactcatcgacaagaaggcttggccgtatgtcatgaacgacctccgcctccgggcctcctacctgcgctacgacctcaacaccgtcatcgcctccaagcccagggaggagaagaagagcctcaaggagctcaccggcaagctcttcagcaccatcgacgatcttgaccatgcggcaaagatcaagagcaccccagaggctgagaaatactacgcggcgaccaaatctgccctcgatgatgttttcgccaagctaggctagatggaatataatgggctaatggccatgtaatttcagacttttgtgtttgttcatatggatatggagccggcaatgtgccatttcctgttgatattatatcaacaag

SEQ ID NO: 12753 - protein, 216 aa, Panicum virgatum
  misc_feature: Ceres CLONE 1765351
  misc_feature (12)..(216): Pfam Name: PsbQ Pfam Description: Oxygen evolving enhancer protein 3 (PsbQ)
MAQAMASMTGLSQGVLPSRRAASRARAAVVRASAEGEAAAQAGRRAVLGLVATGIVGGVFTQAVRADEAVKTIKIGPPPPPSGGLPGTLNSDQARDFDLALKERFYLQPLPPAEAAARAKSSTQDILNLKPLIDKKAWPYVMNDLRLRASYLRYDLNTVIASKPREEKKSLKELTGKLFSTIDDLDHAAKIKSTPEAEKYYAATKSALDDVFAKLG

SEQ ID NO: 12754 - DNA, 885 bp, Panicum virgatum
  misc_feature: Ceres CLONE 1765413
  misc_feature: Encodes the peptide sequence at SEQ ID NO. 12755
attccccatccacgcttggcttcccaccctataaagcgctcctcgatccagacctttgccaaaaataacaaggcgcagaggcaaccttgattcgacgtgcgcttcctcctcgctcgcggagatgtctgacgttgaggagtaccgttgcttcatcgggaacctgtcatggtcgacaactgatgagagcctcaaggatgcattcggcaaatttggaaacctcactgaggcaaaggtggttcttgacaaattttctggccgctctcgtggtttcggctttgtaacatttgatgagaagaaagctatggaagatgctattgaaggaatgaatgggctggacttggacgggaggaacattactgtcgataaagctcagccacaagggcttggtagagatcgtaatggtgaccgtgattatgaccgtggatctcgttatgaccgtggccgtgactatggtggtggtggacgtgcaccacgtggcggcggcggcggcggggactgcttcaagtgtggaaaacctggtcattttgctagggagtgcccatctggggatggtgggagaggggatagatatggtggcagagatgacaggtatggcggcggcggcagtcattatggatctgaccgtggtggtggtggtgaccgatactctggccgtagccgagatggtggcagctacgggggcgaccgctacaaccgtgaccggtctggtccctactgatggcctagatcttgagcagtatgtgccatccaggtatgaaatctatctgctattataaaggtttgttatcgtgtgtctggaactttgtgatcctgtagctggagaactatgatgtaccatgagaagatcatgctttgttatagaccgtattactgactggttttgtt

SEQ ID NO: 12755 - protein, 198 aa, Panicum virgatum
  misc_feature: Ceres CLONE 1765413
  misc_feature (9)..(80): Pfam Name: RRM_1 Pfam Description: RNA recognition motif. (a.k.a. RRM, RBD, or RNP domain)
  misc_feature (124)..(141): Pfam Name: zf-CCHC Pfam Description: Zinc knuckle
  misc_feature: SWISSPROT Homolog: EC 5.2.1.8 Peptidylprolyl isomerase
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: Useful for making plants with altered lignin content
  misc_feature: Useful for making plants with modulated biomass
  misc_feature: Useful for making plants with modulated nitrogen use efficiency
  misc_feature: Useful for making plants with modulated flowering time
MSDVEEYRCFIGNLSWSTTDESLKDAFGKFGNLTEAKVVLDKFSGRSRGFGFVTFDEKKAMEDAIEGMNGLDLDGRNITVDKAQPQGLGRDRNGDRDYDRGSRYDRGRDYGGGGRAPRGGGGGGDCFKCGKPGHFARECPSGDGGRGDRYGGRDDRYGGGGSHYGSDRGGGGDRYSGRSRDGGSYGGDRYNRDRSGPY

SEQ ID NO: 12756 - DNA, 948 bp, Panicum virgatum
  misc_feature: Ceres CLONE 1765430
  misc_feature: Encodes the peptide sequence at SEQ ID NO. 12757
tgtgccatttgcagactgagacacgaaggacccggagaggcgaagacagacggaacatagagaacaggaggggaatcgagattcgagagggaatcagcgcctcgtctccgctccaaacttatcggcggtgatgctgcgcgtggcgggcaagaggctcctcggcgccgcgtccggcgtcagaggcggtgaggcggcgcccgcggtggcagctgctgctgctgctggggcggcgaggcgggggtaccacgagcgggtggtggaccactacaacaacccgcgcaacgtgggggccttcgacaaggacgacgcgggcgtcggcacggggatcgtcggcgcgccggcgtgcggggacgtcatgaagctgcagatccgcgtcgacgaggggtccggcaggatcgtcgacgcgcgcttcaagaccttcgggtgcggctccgccatcgcgtcctcctccgtcgctactgagtgggttaagggcaagcaaatggaggaagtagtcacaatcaagaacactgatattgcaaagcacctgtctcttccaccggtgaagctccactgcagcatgctcgctgaggatgcgatcaaagccgccgtgaaggactacgaagcaaagaaggggaagctggccaaggcagacgagtaggaacacgaacaccccacaagagcgtggccacctcgctgactagcgctctggcagagtactttgcagtgaggggcttcatgtgctcgatcggcgtgtatgatcatttctgctagcgaaagaacatgtatataaacaagaaggggatggtgtttgcattggtggtttcatcgaaataagtgaaccttctgtcgtgcaacagcggggtagtgatacatatagtatgtaatgtatgtacctcttgtaacatgtattgtactgcgtgagcttcacatatgtgctaaattagtaattatcttctcagctgcgct

SEQ ID NO: 12757 - protein, 169 aa, Panicum virgatum
  misc_feature: Ceres CLONE 1765430
  misc_feature (37)..(164): Pfam Name: NifU_N Pfam Description: NifU-like N terminal domain
MLRVAGKRLLGAASGVRGGEAAPAVAAAAAAGAARRGYHERVVDHYNNPRNVGAFDKDDAGVGTGIVGAPACGDVMKLQIRVDEGSGRIVDARFKTFGCGSAIASSSVATEWVKGKQMEEVVTIKNTDIAKHLSLPPVKLHCSMLAEDAIKAAVKDYEAKKGKLAKADE

SEQ ID NO: 12758 - DNA, 788 bp, Panicum virgatum
  misc_feature: Ceres CLONE 1765440
  misc_feature: Encodes the peptide sequence at SEQ ID NO. 12759
ccgcagcacaagcgagtcctccaaccatggcgctcgcgctggcctctccaatggcgtccctctccttccgctcggggaggatctccgcgacggctataggcggcgtcgcccgcactggcagggcgactccggtgggcgcctccgcctccccgttcctcaggagctccttcgtctcgtcctcctccacgtcgtccgcctccccctcccccgcctctctctcggcggcggtctcggcgtcgctggccttcacgtcgtcttcctcgttcgccggttcatctttgggaattgagttcagctacaacagaatgagaacacgaagatcacgtggtctgcagattagggctggaaaggctgccctctgcatgaccaagaggtcaaaatctaggaagtcacttgcccgtacacatggtttccgcaggcggatgcggactacttctggaaggaaggtactgaagcgcaggcgtgccaaaggcaggaaggttctctgcacaagaacaaactcacccactgggaagaaaaggatgttctaattccactgcaatatgacgtgcatgcaactgcaagcatgctttctacatccaatcttctgagcctccttctatctgtaacaatcatgtagcattttcggttaatacatctgaatcaccttctccacacaatttcaagttatctttttttgatgccgtggtccttagtccctgttgctttggtggaacgtgtattatgctttctgcttccaagttttatttggattgaatgagattccattaagagtgttgactctgcct

SEQ ID NO: 12759 - protein, 167 aa, Panicum virgatum
  misc_feature: Ceres CLONE 1765440
  misc_feature (114)..(155): Pfam Name: Ribosomal_L34 Pfam Description: Ribosomal protein L34
MALALASPMASLSFRSGRISATAIGGVARTGRATPVGASASPFLRSSFVSSSSTSSASPSPASLSAAVSASLAFTSSSSFAGSSLGIEFSYNRMRTRRSRGLQIRAGKAALCMTKRSKSRKSLARTHGFRRRMRTTSGRKVLKRRRAKGRKVLCTRTNSPTGKKRMF

SEQ ID NO: 12760 - DNA, 719 bp, Panicum virgatum
  misc_feature: Ceres CLONE 1765446
  misc_feature: Encodes the peptide sequence at SEQ ID NO. 12761
acacaacaacctgtgacgtcgcagcctcctcttctcccccaccgaaccgaatcccagccgcagaaaccccccgagctgcagccgcatcgatggcccccaaggcggagaagaagccggcggcgaagaagcccgcggaggaggagcccgcgacggagaaggcggagaaggccccggcggggaagaagcccaaggccgagaagcggctgcccgcgggcaagtccgccggcaaggagggcggcgagggcaagaaggggaggaagaaggggaagaagtcggtggagacctacaagatctacatcttcaaggtgctgaagcaggtgcaccccgacatcggcatctcctccaaggccatgtccatcatgaactccttcatcaacgacatcttcgagaagctcgccggcgaggccgccaagctggcgcgctacaacaagaagcccaccatcacctcccgcgagatccagacctcggtgcgcctcgtcctccccggcgagctcgccaagcacgccgtctccgagggcaccaaggccgtcaccaagttcacctcgtcttagatgctaggctttcccctctgctctttgttggcgtgttgctcctggtagtgatgccagtttgttggatgtggctagtacgggtgatgtagttacgtgctgtggttcctgactatgctctctgtatgaagtggaacggttatctgatggaaaattggtggtgcttgtttg

SEQ ID NO: 12761 - protein, 153 aa, Panicum virgatum; identical to SEQ ID NO: 12378
  misc_feature: Ceres CLONE 1765446
  misc_feature (60)..(130): Pfam Name: Histone Pfam Description: Core histone H2A/H2B/H3/H4
  misc_feature: Useful for biocontainment applications
  misc_feature: Useful for making plants with modulated flowering time

SEQ ID NO: 12762 - DNA, 762 bp, Panicum virgatum
  misc_feature: Ceres CLONE 1765468
  misc_feature: Encodes the peptide sequence at SEQ ID NO. 12763
actcccaaattctcccagcaaatcaaatcctcccccaaatcccgcgacctttctccctcgccgccggctcgccgtcctccgcacccaccgagctccccgatggcccgcacgaagcagacggcgcgcaagtcgacgggcggcaaggccccgaggaagcagctggcgaccaaggcggcgcgcaagtcggccccggcgacgggcggcgtgaagaagccccaccgcttccgccccggcaccgtcgcgctccgcgagatccgcaagtaccagaagagcacggagctgctcatccgcaagctccccttccagcgcctcgtccgggagatcgcgcaggacttcaagaccgacctccgcttccagtcctccgccgtcgccgcgctgcaggaggccgccgaggcctacctcgtcgggctcttcgaggacaccaacctctgcgccatccacgccaagcgcgtcaccatcatgcccaaggacatccagctcgcgcgccgcatcaggggcgagagggcctgagcgggcccactgccttcctcgcccttgtcgatcccttcttctcgtgctgtctgcttgtaggatctgtgcttctcttgggttccttctgatggcatgttagtagtactagtatcgtcgttgtggttgtgttcgtagtgccaggagctgtgttcggtcgctgggtgacctgcttgtttattatcttgcactgatgcagctgctgtaatggtggtctgttaccttaatctaagggaaatgaattgtgcttctctg

SEQ ID NO: 12763 - protein, 136 aa, Panicum virgatum; identical to SEQ ID NO: 10238
  misc_feature: Ceres CLONE 1765468
  misc_feature (58)..(132): Pfam Name: Histone Pfam Description: Core histone H2A/H2B/H3/H4

SEQ ID NO: 12764 - DNA, 975 bp, Panicum virgatum
  misc_feature: Ceres CLONE 1765493
  misc_feature: Encodes the peptide sequence at SEQ ID NO. 12765
atcgcatctccatcgccagataattccgacacacgaatttcttcggttcctcctcgcgctcctccccttccccgagcaaccaccagcagcagcggcgccatggccaccgcctcctccctcttcctgtcctcgtcccccatctccaccgcgccgcgaacccgcaacggccccgcggcggcctgccctccctccgcccggccgtccctgcgcctccggcagaggccgtccccggccatcgcggccgccgtgcaggccgagcaccagtccgccgtggtcgcggcgccgaagccgcccgcgctcccgttccgcgtcggacacgggtttgacctccaccgcctcgaaccgaacctcccgctcatcatcggcggcatcaacatcccccacgaccgtggctgcgaggcccactccgacggggacgtgctgctgcactgcgtggtggacgcgattctcggcgcgctggggctgccagacatcgggcagatcttcccagactcagacccacggtggaagggtgccgattcttccgtgttcatgagggaagctgtgaaattgatgcatgaagcaggctatgagctgggcaaccttgatgctacactgatcttacaaaaaccaaaactcagtccattcaaggagacaatccgatccaacttgtgtgacctacttggggcagatccatctgtcgtcaatctcaaggccaagacgcacgagaaggttgacagtctgggggaaaacaggagcatagctgcccatactgtagttcttctgatgcggaagtagaaaactggaagagtggaagtagtgaattgtatgattgtatcctattacagggattgaattttagtgtgaacaaaaagctgttacgttatacctgtgtaacctgtccttcagtgatctggtcactatggggaatctccatgtcggtgaaacgataaagctgaatgcaatgagaagttttctgtatttagattatgtttc

SEQ ID NO: 12765 - protein, 225 aa, Panicum virgatum
  misc_feature: Ceres CLONE 1765493
  misc_feature (69)..(225): Pfam Name: YgbB Pfam Description: YgbB family
  misc_feature: SWISSPROT Homolog: EC 4.6.1.12 2-C-methyl-D-erythritol 2,4-cyclodiphosphate synthase
MATASSLFLSSSPISTAPRTRNGPAAACPPSARPSLRLRQRPSPAIAAAVQAEHQSAVVAAPKPPALPFRVGHGFDLHRLEPNLPLIIGGINIPHDRGCEAHSDGDVLLHCVVDAILGALGLPDIGQIFPDSDPRWKGADSSVFMREAVKLMHEAGYELGNLDATLILQKPKLSPFKETIRSNLCDLLGADPSVVNLKAKTHEKVDSLGENRSIAAHTVVLLMRK

SEQ ID NO: 12766 - DNA, 595 bp, Panicum virgatum
  misc_feature: Ceres CLONE 1765516
  misc_feature: Encodes the peptide sequence at SEQ ID NO. 12767
acgaatcgacccgtccacctcagcgatccgcggcaacagcaccagagcccatcccaccctccaagggcggcaaggggctgggcaagggcggcgccaagcgccaccgcaaggtgctccgcgacaacatccagggcatcaccaagccggcgatccggaggctggcgaggaggggcggcgtgaagcgcatctccggtctcatctacgaggagacccgcggcgtgctcaagatcttcctcgagaacgtcatccacgacgccgtcacctacacggagcacgcccgccgcaaaaccgtcaccgccatggacgtagtctacgcgctcaagcgccagggccgcaccctctacggattcggcggctgagcgcgccctctccctcgtatgcagctgctggcggtggtgcttgcttgcttgttcgtttgggttacccgtgctgggcgttccgtttggtgatgtagagatactatcagattcgtatctgtgctgtcttttgttcttagtaggtggatgtgaagtacgggtctagaaattccaactgccagttgtatctcagttccgtttcctttgcagcaatgaaatgttaaccccgatctgctacc

SEQ ID NO: 12767 - protein, 118 aa, Panicum virgatum
  misc_feature: Ceres CLONE 1765516
  misc_feature (40)..(109): Pfam Name: Histone Pfam Description: Core histone H2A/H2B/H3/H4
ESTRPPQRSAATAPEPIPPSKGGKGLGKGGAKRHRKVLRDNIQGITKPAIRRLARRGGVKRISGLIYEETRGVLKIFLENVIHDAVTYTEHARRKTVTAMDVVYALKRQGRTLYGFGG

SEQ ID NO: 12768 - DNA, 898 bp, Panicum virgatum
  misc_feature: Ceres CLONE 1765541
  misc_feature: Encodes the peptide sequence at SEQ ID NO. 12769
atttccctagcccctgcgccagcacacacacccacccggcagggagagggagcccctcgacggcggagaagatggtgtcgctcaagctgcagaagcgcctcgcctccagcgtgctcaagtgcggcaagggcaaggtctggctcgaccccaatgaagtcagcgagatctccatggccaactcccgccagaatatccgcaaattggttaaggatggttttatcatcaggaagcctcagaagatccactccaggtcccgtgcaaggagggcgcatgaggccaagcagaagggacgtcattctggatatggtaagcgcaggggtacgagggaggctaggctccccaccaagattctttggatgaggaggatgcgtgttctgaggcgcctgctgtgcaagtaccgtgaagccaagaagatcgacaagcacatgtaccatgacatgtacatgaaggtcaagggtaacagtttcaagaacaagagggtgctcatggagagtatccacaagtccaaggctgagaaggctagagagaagacactctctgatcagtttgaggccaagcgcgccaagagcaaggcaagccgtgagaggaagattgccaggagggaggagaggttggcccagggcccgagggaaccagcagctgcagcggccccaaagaaggcaaagaagtgaaggggttgatctgaagctttagctttctggtaccaggagtagcctaattttggagcgcctctaaactgttttgctgttattatatatccaagctgttgtgccttgatatcgctgaatatcatcttgtttatgttgggttggataatgtagtggacttgtttatgctgagttttctttgcgacagatcaaagaaaatcccgttatgttttatggaacttacacttgat

SEQ ID NO: 12769 - protein, 199 aa, Panicum virgatum
  misc_feature: Ceres CLONE 1765541
  misc_feature (2)..(149): Pfam Name: Ribosomal_L19e Pfam Description: Ribosomal protein L19e
MVSLKLQKRLASSVLKCGKGKVWLDPNEVSEISMANSRQNIRKLVKDGFIIRKPQKIHSRSRARRAHEAKQKGRHSGYGKRRGTREARLPTKILWMRRMRVLRRLLCKYREAKKIDKHMYHDMYMKVKGNSFKNKRVLMESIHKSKAEKAREKTLSDQFEAKRAKSKASRERKIARREERLAQGPREPAAAAAPKKAKK

SEQ ID NO: 12770 - DNA, 978 bp, Panicum virgatum
  misc_feature: Ceres CLONE 1765547
  misc_feature: Encodes the peptide sequence at SEQ ID NO. 12771
gagacgagatccattccctccgccgctgcgcctcagctgagagccctcgaaccctagcccgcgagcgcgagcccagccatggcgcggtccctcgcgctcgtcgccctcctcctcctcggccttgccgccgccgccgcctccgcggccgacgcgcccttcgtcgtcgcgcacaagaaggtgtcgctctcccgccccaagcccggcgtcgagcgcgtcgccgtctccctcgacctctacaaccagggatccgcgactgcctatgatgtgaccattaatgatgactcttggccaacagaagcatttgagcttgtcactggagagaaatcgaagacattggaaagacttgaccctggtgccacagcatcacacacatttgtcctggaaaccaaaacacagggcaggttccagggttcgccagctgttattacataccgtgttcccaccaagaccgctcttcaggaggcctactcaacccccatcttcccactcgatattctcgctgagagacctccagagaagaagtttgaatgggctaagaggcttgtggcgaaatatgggtcactggtttctgttgtctcgttcgttggtctgtttatctacctggtggcaagcccgtccaagagcagctcaaaagcaagcaagaagagacgttgatctactcgtaggtcagtgtagcttgctgttttgcgtggaggaactcttgatcgtttgagctgaacgaaagctttgaagtttagatttactcacccccaccatgagttgtaacgaaatgcacatcggttagcaaagtggacctgtaattttggttggttacttggttttactttcagtttcattgtcagtgaattgacagaggacctgtaattaggaaagttaattttgcttggaagaacattttgatatgattgccagtgcccgcgttttgagagcaaagctgttctcgggcagaagcttggctgatgaaggccatgtggagtt

SEQ ID NO: 12771 - protein, 191 aa, Panicum virgatum
  misc_feature: Ceres CLONE 1765547
  misc_feature (10)..(189): Pfam Name: TRAP_beta Pfam Description: Translocon-associated protein beta (TRAPB)
MARSLALVALLLLGLAAAAASAADAPFVVAHKKVSLSRPKPGVERVAVSLDLYNQGSATAYDVTINDDSWPTEAFELVTGEKSKTLERLDPGATASHTFVLETKTQGRFQGSPAVITYRVPTKTALQEAYSTPIFPLDILAERPPEKKFEWAKRLVAKYGSLVSVVSFVGLFIYLVASPSKSSSKASKKRR

SEQ ID NO: 12772 - DNA, 761 bp, Panicum virgatum
  misc_feature: Ceres CLONE 1765548
  misc_feature: Encodes the peptide sequence at SEQ ID NO. 12773
agcggagccgggggaaaaaaatctcgcatttccttcgcgtcgcgtgaggtagtcgggtggaagcgaaagggtcacagttcgatttggtcctgttcgctgcagaggagatggccgggaagggaggcaaggggctgctcgcggcgaagacgacggcggccaagacggcggagaaggacaaggggaagaaggcccccgtctcccgctcctcccgcgccggcctgcagttccctgttggtcgtatccaccgccaacttaagcagaggactcaggcaaatggtcgtgttggtgccactgcagctatctactccgctgccatcctggagtacttgaccgctgaggttctggagctggctgggaatgctagcaaggatctgaaggttaagcgtatcaccccccgccacctccagctggccatccgtggagatgaggagctcgacaccctcatcaagggcaccattgcaggtggaggcgtcatcccgcacatccacaagtccttgatcaacaagtcctccaaggagtgagtgaggtgctagagatgatgtgcatcttagtttaaactggacttttgtgtgcccttgtgttgtaagtcctggtttgtcaagtagttttagtggagctgtctggttgaagtgatccttctgtgtattgctctcctggtgctgcttttgttatttgaacatcgtgtctgtgttgagtcgttaacttaagtggtgcgaacctggatgcttatttagttatttgcgactggtttgtttcttctc

SEQ ID NO: 12773 - protein, 137 aa, Panicum virgatum
  misc_feature: Ceres CLONE 1765548
  misc_feature (32)..(106): Pfam Name: Histone Pfam Description: Core histone H2A/H2B/H3/H4
  misc_feature: SWISSPROT Homolog: EC 2.7.7.7 DNA-directed DNA polymerase
MAGKGGKGLLAAKTTAAKTAEKDKGKKAPVSRSSRAGLQFPVGRIHRQLKQRTQANGRVGATAAIYSAAILEYLTAEVLELAGNASKDLKVKRITPRHLQLAIRGDEELDTLIKGTIAGGGVIPHIHKSLINKSSKE

SEQ ID NO: 12774 - DNA, 763 bp, Panicum virgatum
  misc_feature: Ceres CLONE 1765575
  misc_feature: Encodes the peptide sequence at SEQ ID NO. 12775
acacaaaaactggagcacgagcagctccggtgaggattcattcgttcagcagcaggggaggaggaggaagaagaagagagcaagcggctccgttcccaaccatatcccatggcgcagttcgccgtcctccgcgcgtctccggtggccgccgccaccgcggcgccgtccttctcctcctgcatgtccggacgtgcagcatgttcactgcgcgtcacctccagcaagaggcgcgtcttctccaggaccggcagggcgctgtccatccggtgcgagcagagcgcgaagcagggcggcggcggcgccgacgtgtggctgggccgcgccgccatggtcggcttcgcctcggcgatctccgtcgaggtggccaccggcaaaggcttcctccagaacttcggcgtggcgacgccggcgccgacgctggcgctggtcgtgtcggggctcgtcgtcggcctcgccgtcttcttcctgctccagtccggctcgcgagactgaacgccggtgaacgagcagtcgaacatctgcagggttcagtgctgaaggttcgtcgtcggaggctgctctgcaaacgcatccagtttgttcctcgatcgtcacatttttccttgtaccatggtctatgtaatgtagtaactgacaatcatctacagttatttcaaaaaaaaaaaacaatcatctacagaatgctgctgaaaaaagacaatcatctacagaatgagcctcttaagttttggtgaaaaaaaaaacgattcgtgtgttacgttgg

SEQ ID NO: 12775 - protein, 127 aa, Panicum virgatum
  misc_feature: Ceres CLONE 1765575
  misc_feature: SWISSPROT Homolog: EC 4.99.1.1 Ferrochelatase
MAQFAVLRASPVAAATAAPSFSSCMSGRAACSLRVTSSKRRVFSRTGRALSIRCEQSAKQGGGGADVWLGRAAMVGFASAISVEVATGKGFLQNFGVATPAPTLALVVSGLVVGLAVFFLLQSGSRD

SEQ ID NO: 12776 - DNA, 566 bp, Panicum virgatum
  misc_feature: Ceres CLONE 1765587
  misc_feature: Encodes the peptide sequence at SEQ ID NO. 12777
accaacgaatccccaaatcaccaccgagctctctcgatttcaatctcaccaccacctccgagctaggagccatgtcgggccgcggcaagggaggcaaggggctgggcaagggcggcgcgaagcggcaccgcaaggtcctccgcgacaacatccagggcatcaccaagccggcgatccggaggctggcgcgcaggggcggggtgaagcgcatctccggcctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctatacggcttcggcggctgagatccgccttgggtcccaggcgggtcgatggtgttagggtcagcaatggtgtttggcgttcgttccatctgatgtgatgtctggaggtgtctccgtgtctgttttgtgcaaagtagtaatgtgtctctgattggaaatggagtccgaagcttatgaatgaaatcgatctgtgtttacttttct

SEQ ID NO: 12777 - protein, 103 aa, Panicum virgatum; identical to SEQ ID NO: 12044
  misc_feature: Ceres CLONE 1765587
  misc_feature (25)..(94): Pfam Name: Histone Pfam Description: Core histone H2A/H2B/H3/H4

SEQ ID NO: 12778 - DNA, 734 bp, Panicum virgatum
  misc_feature: Ceres CLONE 1765596
  misc_feature: Encodes the peptide sequence at SEQ ID NO. 12779
atcccaatcccccgagaccgctccatttttggaagccccggagagcggagacgcccagcgcccacgcggcctcgaggtcccacacgcccaaaagatggcgcctttgacatctccagatatctgcaacttcatggccatctcacagaacaacacgcttctgctgaaccagagcacaaaacggcccccgcagctgagcttccccaggagcacggcgacactgccgggcttcagagcgaggcaagacgtccgcgtcgccgccgtctacaaggtgaagctcatcatgcccggggggaaggagaccgtgatcaatgtgccgaaaaacacctacatcctggacgcggccgaggaagccgggctcgacctgccctactcctgccgcgccggcgcctgctccgcgtgcgccggcaagatcctgaagggctccgtcgaccaaccggaccagtcgttcctcgacgacgaggagatcgacgccgggtacttgctcacctgcgtcgcgttcccgacctccgactgcgtcatcaagacgaaccaggagaaggacctgattgatcagtagcccggtgtggcggtgtcactcccacactatgaatcaccatacttccctaatgctgcattacccgtatccgatactctgatatatattcgatacgccgatatggaattaaaaataaataaataaattcttgatatgcgtccgatactcgctcatacgcatatccggaccctttgtggct

SEQ ID NO: 12779 - protein, 153 aa, Panicum virgatum
  misc_feature: Ceres CLONE 1765596
  misc_feature (62)..(138): Pfam Name: Fer2 Pfam Description: 2Fe-2S iron-sulfur cluster binding domain
MAPLTSPDICNFMAISQNNTLLLNQSTKRPPQLSFPRSTATLPGFRARQDVRVAAVYKVKLIMPGGKETVINVPKNTYILDAAEEAGLDLPYSCRAGACSACAGKILKGSVDQPDQSFLDDEEIDAGYLLTCVAFPTSDCVIKTNQEKDLIDQ

SEQ ID NO: 12780 - DNA, 805 bp, Panicum virgatum
  misc_feature: Ceres CLONE 1765601
  misc_feature: Encodes the peptide sequence at SEQ ID NO. 12781
attcccccacacagcaccactgcaacacacacagcatttgcttaattagctaataagcacgaccctatcggtactaatggcggctttgatgatgaagaacaagaagcagatgccggcggtggtggcgttggccgttgtggtggcggcggcggcgctggtggcgtcggcgtcggcggccatcacgtgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagctcggaccggcaggcggcatgccggtgcctcaagagcctggccagcaccgtcaagtcggtgaacatgggcaccgtcgccaccatccccggcaagtgcggcgtctccgtgccattccccatcagcatgtccactgactgcaacaaggtcaactaataaattgtgcatcaatataataatcctaccatctgatgaggaagctcagctcgatccgctcagaagctagctgctagctagcgagctttcaggagaataaaataaagttgaggcatcatcagcaggcagcagcacatcatctatatatattattgttgtactcgatctgtgtgtacgtgcgcgtacacatacatgcatgcttatacgatcgatgtatatatatgtgctgcttctctcacaagtacgtgtgcttatatatatagagaaaattcgattcatgccaccacaactccgtgaaattgggtttcatgttcaaaatcatgccactcaatggcatggatttcaaca

SEQ ID NO: 12781 - protein, 126 aa, Panicum virgatum
  misc_feature: Ceres CLONE 1765601
  misc_feature (37)..(122): Pfam Name: Tryp_alpha_amyl Pfam Description: Protease inhibitor/seed storage/LTP family
MAALMMKNKKQMPAVVALAVVVAAAALVASASAAITCGQVGSALAPCIPYATGKASALPSSCCGGVRSLNSAARTSSDRQAACRCLKSLASTVKSVNMGTVATIPGKCGVSVPFPISMSTDCNKVN

SEQ ID NO: 12782 - DNA, 943 bp, Panicum virgatum
  misc_feature: Ceres CLONE 1765613
  misc_feature: Encodes the peptide sequence at SEQ ID NO. 12783
ctttctcccctccgcgcgacggctccccgcctctcctctcctcctgcctcctgcctccgccgcgaccgtcgaacgccgtaccagtaccgtgcaggaacagtcggtagagaggaggaggagcgtcgggcgagatggggatgcgggataagaagcggaaccagaagcgggtcctcgcgcggcgcaccgcggccccccgctccggcgagggcaaggacttcctgccgttggaagacgggtccgggaagaggacccggaggaagctgcagcagcccgaggagccggagaacaccgccactgttgtctacatcgggcacatcccccacggcttctacgaggaccagatgaaagggttctttaagcagtttggggatattaagcggcttaggattgctcgaaaccgcaagacaggaaagtccaagcattacggattcattgagtttgagagccctattgtggcgaaggttgtagctgatgagatgaataactatctcttgtttgagcacactttgcgagtttcacttgtcccaccagagaaagttcatccaaaactatggaaaggggtgcggcggggatttataccaattgatcgggtaacaatcgaacggaagaggcacaacaaggacaaatcagtagaagaacacaaaaagatggttgaagaaattgtaaaacgagatgaaaagagacgcaaaagaatccaggctgctggaattgactacgagtgtccagcccttatagggatcagtcagccttcagccaagaagatcaagtttgatgagaactagtatttacatgagtcgccaaaggatcctctcatgttagttaagatggctggcttgtatttgcgttaagggggtggaggctgggaacaatttcccctgttttgttacctaccagtattcagtgctgtatgattggcccagatgatgaagtatgaagttgccag

SEQ ID NO: 12783 - protein, 216 aa, Panicum virgatum
  misc_feature: Ceres CLONE 1765613
  misc_feature (57)..(128): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGMRDKKRNQKRVLARRTAAPRSGEGKDFLPLEDGSGKRTRRKLQQPEEPENTATVVYIGHIPHGFYEDQMKGFFKQFGDIKRLRIARNRKTGKSKHYGFIEFESPIVAKVVADEMNNYLLFEHTLRVSLVPPEKVHPKLWKGVRRGFIPIDRVTIERKRHNKDKSVEEHKKMVEEIVKRDEKRRKRIQAAGIDYECPALIGISQPSAKKIKFDEN

SEQ ID NO: 12784 - DNA, 829 bp, Panicum virgatum
  misc_feature: Ceres CLONE 1765619
  misc_feature: Encodes the peptide sequence at SEQ ID NO. 12785
gcgtgcgctgcggccgggttggatctgagacgagcattccaacacagtatcatcatccccgcctcctccctccgccggatcggatcggatccgcccgaccaccccgcaccgcagccgccgcagatcagataagatggccgcagttgacaccttcctcttcacctcggagtctgtgaatgagggacaccctgacaagctctgcgaccaggtctcagatgccgttcttgacgcttgccttgctgaggaccctgacagcaaggttgcttgcgagacctgcaccaagactaacatggtcatggtttttggtgagatcaccacgaaggccaatgttgactacgagaagattgtcagggagacctgccgcaacatcggtttcgtgtctgcaaatgttgggcttgatgctgacaactgcaaagtgctcgtgaacattgagcaacagtcccctgatattgctcagggtgtgcatggccacttcacaaagcgccctgaggagattggagctggtgaccagggacacatgtttgggtatgcaactgatgagaccccagagctgatgcccctcagccatgtccttgccaccaagcttggtgctcgtctcactgaggtgcgcaagaacgggacctgcccctggctcaggcctgatgggaagacccaggtgactgttgaataccgcaacgagggtggtgccatggtccccatccgcgtccacactgtcctcatctctacccagcacgacgagacagtcaccaacgatgagattgctgctgacctcaaggagcatgtcatcaagcctgtcatccctgagcaataccttgatgagaagaccatc

SEQ ID NO: 12785 - protein, 231 aa, Panicum virgatum
  misc_feature: Ceres CLONE 1765619
  misc_feature (119)..(231): Pfam Name: S-AdoMet_synt_M Pfam Description: S-adenosylmethionine synthetase, central domain
  misc_feature (5)..(104): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
MAAVDTFLFTSESVNEGHPDKLCDQVSDAVLDACLAEDPDSKVACETCTKTNMVMVFGEITTKANVDYEKIVRETCRNIGFVSANVGLDADNCKVLVNIEQQSPDIAQGVHGHFTKRPEEIGAGDQGHMFGYATDETPELMPLSHVLATKLGARLTEVRKNGTCPWLRPDGKTQVTVEYRNEGGAMVPIRVHTVLISTQHDETVTNDEIAADLKEHVIKPVIPEQYLDEKT

SEQ ID NO: 12786 - DNA, 746 bp, Panicum virgatum
  misc_feature: Ceres CLONE 1765681
  misc_feature: Encodes the peptide sequence at SEQ ID NO. 12787
gataacaatgtttcccaaaaaaaaaaaatccattgcactacaacacctatgcgttcttcatcgatttggcacagccatcatctagctaggagctcacaattaagttcaaccccgggcagctatatcggcggcgatcaccggtggaagggcggcgctcgcagtggccgcgctcctctgcgccatggcggcagtggccgctgcgcaacaggcctccaacgtgcgcgcgacgtaccacctgtacaacccggcgcaaaacggctgggacctcaaccgcgtcagcgcctactgcgccacgtgggacgccaacaagccgctgtcgtggcggcaaaagtacggctggaccgccttctgcgggccctcgggccctaggggccaggcctcctgcggcaagtgcatcaaggtgacgaaccgtgcgacgggcgcatcgaccgtggcgaggatcgtggaccagtgcagcaatggcggcctggacctggacttcgagacggtgttcaagaagattgacaccaatgggcaaggctaccagatgggccacctcaacgtcgactaccagttcgtctcctgctgagtgagctttgcgcacgcacgatcgaccggggaggaacctggaggatgtaataataattaagcgcctcgcctagatgtttggtgtgatggaataaaagggaacagagacacgaatgatggtagctagtaatacagaataaacgaaacagaattggactaaataaagcgagatttcgatg

SEQ ID NO: 12787 - protein, 128 aa, Panicum virgatum
  misc_feature: Ceres CLONE 1765681
  misc_feature (9)..(128): Pfam Name: Barwin Pfam Description: Barwin family
MAAVAAAQQASNVRATYHLYNPAQNGWDLNRVSAYCATWDANKPLSWRQKYGWTAFCGPSGPRGQASCGKCIKVTNRATGASTVARIVDQCSNGGLDLDFETVFKKIDTNGQGYQMGHLNVDYQFVSC

SEQ ID NO: 12788 - DNA, 1161 bp, Panicum virgatum
  misc_feature: Ceres CLONE 1765725
  misc_feature: Encodes the peptide sequence at SEQ ID NO. 12789
gtcccctcacctccgctcccctactcccggtcctcctcctcgagatctccaaggccacgagcgcttccgcgcagctccgcctccgccgctcgcgattttggccgccgccgggggagatggcaggcctgggaaaggcgatgtacgcggtggggttctggatccgggagaccggccaggcgctcgaccgcctcggctgccgcctgcagggcaaatacttcttccacgagcagatttcaaggcatcgcacactcatgaacatctttgacaaaacccctcatgttcatagagatgcatttgttgctccaagtgcatcgcttattggtgatgttcaagttggaccaggagcttccatttggtatgggtgcgtcctaagaggggatgcaaacaacatccagattggatctgggaccaatattcaagacaattctcttgtgcatgtggcgaagtcgaatctaagtgggaaagtctttccgacaattatcggtgaaaaagtcacagtaggtcatagcgctgtcttacaaggatgcaccatcgaggatgaagcttttgttggcatgggggcaaccctattggatggtgttgttgtggaaaagcatggaatggttgctgctggagccctcgtaagacagaatactaggatcccttctggagaggtatggggaggaaacccagccaaatttctgaggaagctcaccgctgatgagatagcttttattgctgaatcggctgccaactattgtagtctgtcccaggcgcatgctgttgagaatgccaaacctcttgagaaggttgagttcgagaaggtgttgcgcaagaagtttgctaaccaggatgaagaatatgattccactatcggtgtcactcaagaggccccaccggagctgacgccttccacaccagcccaataaacttcctttttttttgtttctgttttctctttgctgccatcatcttcttctattggacagtgctggattgttgattgggacactgttccacgagtctggcggtttatgtttacttttcctccccaataatcttgggtcgagcaatgttataaagctggccatgcacttcttcctgtttctgtatccaagtatgtttaagatgtgctccctggaaagacagtcccaactaaatagacagacatgcattgtttcg

SEQ ID NO: 12789 - protein, 263 aa, Panicum virgatum
  misc_feature: Ceres CLONE 1765725
  misc_feature: SWISSPROT Homolog: EC 4.2.1.1 Carbonate dehydratase
MAGLGKAMYAVGFWIRETGQALDRLGCRLQGKYFFHEQISRHRTLMNIFDKTPHVHRDAFVAPSASLIGDVQVGPGASIWYGCVLRGDANNIQIGSGTNIQDNSLVHVAKSNLSGKVFPTIIGEKVTVGHSAVLQGCTIEDEAFVGMGATLLDGVVVEKHGMVAAGALVRQNTRIPSGEVWGGNPAKFLRKLTADEIAFIAESAANYCSLSQAHAVENAKPLEKVEFEKVLRKKFANQDEEYDSTIGVTQEAPPELTPSTPAQ

SEQ ID NO: 12790 - DNA, 820 bp, Panicum virgatum
  misc_feature: Ceres CLONE 1765727
  misc_feature: Encodes the peptide sequence at SEQ ID NO. 12791
acggccccaaagccacaaagccgagcccttctgctcctcgagcagccgaacatagcagtctccagagcaccccccatggcgacggcagctgcggcggccccggccgttcagactgtggtgctgagggtgtccatccactgccatggctgcaagaagaaggtccggaaggtgctcaggagcgtcgaaggtgtgcagaacgtgacggtggacgccgcgcagcacaaggtgacggtgacgggcaccgtggacgccaacacgctcgtccagaagctgcacaagtccggcaagaagggggtgccgtggcagtactgccacccgcccgttttttgacggaggccgccgcgcctgctccggcgccggaggcgctgtcggctccgccggccggcgacggcggcaaggatgatgctgcgaaagcggcggacaacaagaagccggacgaggcgatgaaggagccgcaggtcgagagctccgagaagatgcagcctgagcaggagcccgcgggcgcggagaagaaggcggaggcacagctgaaggcggagaagaaagtggaggagaagaaggacggcggcgacagcgaggcagctgagaccaaggccaagggcgcagagccagcaaaggaagaggcgaaggaagccgccgccgctgttgccaagaacgaggacgaggcaaagaagagcgacaagcccaaggacgccgccggcccccaagtacgcgtacgaggaggcggcaccgcaaccgcaatagagagagacctctctgtggttgttggtagagtagcctgtattactctctttccctcagaggtcaaacctctctctct

SEQ ID NO: 12791 - protein, 84 aa, Panicum virgatum
  misc_feature: Ceres CLONE 1765727
  misc_feature (15)..(75): Pfam Name: HMA Pfam Description: Heavy-metal-associated domain
MATAAAAAPAVQTVVLRVSIHCHGCKKKVRKVLRSVEGVQNVTVDAAQHKVTVTGTVDANTLVQKLHKSGKKGVPWQYCHPPVF

SEQ ID NO: 12792 - DNA, 681 bp, Panicum virgatum
  misc_feature: Ceres CLONE 1765743
  misc_feature: Encodes the peptide sequence at SEQ ID NO. 12793
acacggtacacctcagtgacctcaccctctctcactctctctccatccagcgcgagagggggcagcaggtcggcagcagagcgagagcgcgcgtgccagcccatggcgagcaccaacatggcgtcggccacctcgcggttcatgctggccgcgggcgtgcccgcggcggcgggcagcggcggccgcgtcggcttcgcgtcgccgcccggcagggtgcagggcaggaggctcgtggcgcgcgccgaggaggaggccgcgcccgcggcggaaggggagggcgccgtggccaccaagcccaaggccgacaagccgccgccgatcgggcccaagaggggcgccaaggtgaagatcctgaggagggagtcctactggtacaacgggattggcaacgtcgtcacagttgatcaggaccccaacacccgctacccggtggtggtgcggttcaacaaggtgaactacgccggcgtgtccaccaacaactacgccttggacgagatccaggaggtgaaatgaaaatgagccaggctgcctcaagggccgccgtgcccccgtgttgtcactgtagcctgtgaaacgagggtgttaaagctgctgtgctagcgcgtcacgacatcttgtgtgtaatagctaaatctctgtaatcattgtgtaattgcttgcttgctacaccatggacggctc

SEQ ID NO: 12793 - protein, 136 aa, Panicum virgatum
  misc_feature: Ceres CLONE 1765743
  misc_feature (75)..(136): Pfam Name: PSI_PsaE Pfam Description: Photosystem I reaction centre subunit IV / PsaE
MASTNMASATSRFMLAAGVPAAAGSGGRVGFASPPGRVQGRRLVARAEEEAAPAAEGEGAVATKPKADKPPPIGPKRGAKVKILRRESYWYNGIGNVVTVDQDPNTRYPVVVRFNKVNYAGVSTNNYALDEIQEVK

SEQ ID NO: 12794 - DNA, 618 bp, Panicum virgatum
  misc_feature: Ceres CLONE 1765747
  misc_feature: Encodes the peptide sequence at SEQ ID NO. 12795
gaggcagcagctcccccgcaaaaacccttgctttacctccgccccgtcgtcccccaccaagcgcctccaagatgaagcttgtcaggttcctgatgaagctgaacaacgagacggtgaccatcgagctcaagaacggcaccgtcgtccacggaaccatcatcggcgttgatatcagcatgaatactcatctgaagactgtgaagctcacactgaaagggaaaaatcctgttacccttgatcacctcagtgtgagaggaaacaacatccgctattatatccttcctgacagcttaaacttggagactttgctggttgaggaaacaccaagggtcaaacctaagaagccaacttcagggaagcctttgggacgtgggcgtggccgtggtcgtgggcgcggtcggggtcagggacgttgagcttgctgcccatttggaaattgcattgtggacttctttgcaatgtaatctgctttcatatcagtatgtacggagtatcacttttgttaaggcaatggtgttggtgccgtctgttcttgctgtggattgagttgatggttagatgttacacgccatacgctcttcccctgaacttctttgcaatgtaatctgctttcatatc

SEQ ID NO: 12795 - protein, 114 aa, Panicum virgatum
  misc_feature: Ceres CLONE 1765747
  misc_feature (5)..(70): Pfam Name: LSM Pfam Description: LSM domain
MKLVRFLMKLNNETVTIELKNGTVVHGTIIGVDISMNTHLKTVKLTLKGKNPVTLDHLSVRGNNIRYYILPDSLNLETLLVEETPRVKPKKPTSGKPLGRGRGRGRGRGRGQGR

SEQ ID NO: 12796 - DNA, 785 bp, Panicum virgatum
  misc_feature: Ceres CLONE 1765754
  misc_feature: Encodes the peptide sequence at SEQ ID NO. 12797
tcggcccaactcgcgggcggcggtcggagccccccatccatccgaaccccgtcgtaccatacaaaccctagctagctagctagctagcccagccgcaccgcagcgcccccagcaccagcaggatggcgacttcgacggcgaggacggtgaaggatgtcaacccgcacgagttcgtcaaggcctactccgcgcacctcaagcgctccggcaagatggagcttcctgagtgggttgacattgtgaagactgcgaggttcaaggagctccctccttatgaccttgactggtactacaccagggctgcctcgattgcaaggaagatctacctgaggcaaggcattggtgtgggtggattccagaaaatctacggtggccgccagaggaatggttcctgtccgccgcacttctgcaagagcagcggtgccatttcacgcaacatcctgcagcagttgcagaaaatgggcatcattgatgttgatcccaagggtggacggctcattacttcccagggaaggcgtgatctggaccaagtggctgggagggttgctgttgaaacttgagtagtatcatcttctgtttgaatggtgtcatgtttgatggttgagatggctactatatttgcagttttgaattaggacttgtactaccttttttgttctgagaatttaatgttaattcatcgagctatggagcagcactatatctttgctgaggatctaatgcaatatcagaactcctgaaccagagaagtgtttgagctgatatacataatatgttttgcttct

SEQ ID NO: 12797 - protein, 145 aa, Panicum virgatum
  misc_feature: Ceres CLONE 1765754
  misc_feature (7)..(145): Pfam Name: Ribosomal_S19e Pfam Description: Ribosomal protein S19e
MATSTARTVKDVNPHEFVKAYSAHLKRSGKMELPEWVDIVKTARFKELPPYDLDWYYTRAASIARKIYLRQGIGVGGFQKIYGGRQRNGSCPPHFCKSSGAISRNILQQLQKMGIIDVDPKGGRLITSQGRRDLDQVAGRVAVET

SEQ ID NO: 12798 - DNA, 764 bp, Panicum virgatum
  misc_feature: Ceres CLONE 1765766
  misc_feature: Encodes the peptide sequence at SEQ ID NO. 12799
agtcattccttagtcattccccgagcgtccgagaccccgacacccgcgcctctgacgcctccctcccagcctccctccacctctgacgcctccctccctccaccctctcctccaggcaacctcagcgcctcagccgcttgcgctcgcccgctccgggcctccggcgctcccttccctccctgagctccctgcctccctccatcctcccttcatctccgcgcatccgcgggccggggctccgccccctccagccggcggagctgcagatccggccgacagagctgcagatctgggcatccggccggctcttcggccgatctggctcgggttagtgcggccggcgcgacggaagccagcgggcacggcggcggcaagcgaggcgagccagcgggcgcggttgtggggcaggcgcagaagcgcagcatggcgaagctcaagccaaaggcgttgctggcacaaagcaaagtgaagaagatccctagccaaatcagtgtgatcacgatcttcacctacttggtcctcggtgtagtagtcgtgtcctctgtttatgctgtttacaaatactgggtaggcaaaggaccagcagtgacagcagcaggcgtggaggggaactaaacccccaaactatgtaactgattttgttgttgtatcatccagttggataattttggttgctgcagcccagttaacggaatatggatagattgtatcttgctacagttttactgtaaaccttgggtacattatattgatatatgtatgct

SEQ ID NO: 12799 - protein, 63 aa, Panicum virgatum
  misc_feature: Ceres CLONE 1765766
  misc_feature: SWISSPROT Homolog: EC 5.2.1.8 Peptidylprolyl isomerase
MAKLKPKALLAQSKVKKIPSQISVITIFTYLVLGVVVVSSVYAVYKYWVGKGPAVTAAGVEGN

SEQ ID NO: 12800 - DNA, 662 bp, Panicum virgatum
  misc_feature: Ceres CLONE 1765767
  misc_feature: Encodes the peptide sequence at SEQ ID NO. 12801
  misc_feature (111)..(111): n is a, c, t, g, unknown, or other
aagtgccctccgatccatccatttacctccacggcccccgagaccaccacagacccgcgcccgccgcccgccaacacaaccgaccacgccacacgcggcgcacgcagcggncgccggagaccacagagacaagggggaaggccgccgcggcccacgcaggcagagaggacaagggcaccaccccccaggcccaagagggagacggcccaaccaccgggaccggaagcagcgcggggcccaagccggggccccaggggcgccacgggcaggcgcagggggacaccaccaagggccgcacgcccacggggccacacaacaacctttttggcaaggagcatggcgcaccagaagatgaaactcgccatgccggtgatcttgggaatgtgacagctggtgaagatggtgttgctaatgtcgatattactgactgccagattcccctcactgggccacactcaatcattggccgagctgtagttgtccatgccgatcctgatgaccttggcaagggtggacatgagcttagcaagagcacgggaaatgctggtggccgtgttgcctgtggtatcattgggctccagggctaaatgctgtcttcgttggcgaacattcacatctgagcacctccggtcttgctgcttcatttcccttatattggatac

SEQ ID NO: 12801 - protein, 194 aa, Panicum virgatum
  misc_feature: Ceres CLONE 1765767
  misc_feature (45)..(194): Pfam Name: Sod_Cu Pfam Description: Copper/zinc superoxide dismutase (SODC)
  misc_feature: SWISSPROT Homolog: EC 1.15.1.1 Superoxide dismutase
  misc_feature (37)..(37): Xaa is any aa, unknown, or other
VPSDPSIYLHGPRDHHRPAPAARQHNRPRHTRRTQRXPETTETRGKAAAAHAGREDKGTTPQAQEGDGPTTGTGSSAGPKPGPQGRHGQAQGDTTKGRTPTGPHNNLFGKEHGAPEDETRHAGDLGNVTAGEDGVANVDITDCQIPLTGPHSIIGRAVVVHADPDDLGKGGHELSKSTGNAGGRVACGIIGLQG

SEQ ID NO: 12802 - DNA, 755 bp, Panicum virgatum
  misc_feature: Ceres CLONE 1765784
  misc_feature: Encodes the peptide sequence at SEQ ID NO. 12803
atctcccgtctcgcgcctcgcccacatgtccctccggttccgcccccccgcctcgccgtcgtcgtcggctggttgcgagaagagatggcgggccgtggcaaggcgatcggcgcgggcgcggcgaagaaggcgacgtcgaggagctccaaggccgggctccagttccccgtcggcaggatcgccaggttcctcaaggccggcaagtacgccgagcgcgtcggcgccggcgcccccgtctacctcgccgccgtcctcgagtacctcgccgccgaggttcttgagctggccgggaacgctgcgcgggacaacaagaagacccgcatcgtgccccgccacatccagctggcggtccgcaacgacgaggagctgacgaaactgctcggcggcgccaccatcgcgagcggcggcgtgatgcccaacatccaccagcacctgcttcccaagaagtccgcctcgtccaaagcgtccggccacgacgacgacgacaactgaggcgccgggccgccatcgtgttgctggtttggtaggagtagccttttgttgttttggtgatacctgtgagagcttagatgcggtttgggatggggaagtagaagaaggttgcaataggttcttggctgggtggtaatgttctttcaatgggatgtgaataccactaagtttttgggttgtgaaactcgggggtgtaagccagatgatgttttgatttatgaatgaagaaatcaaatgggagaaagtgaaactccagtattgcg

SEQ ID NO: 12803 - protein, 135 aa, Panicum virgatum
  misc_feature: Ceres CLONE 1765784
  misc_feature (19)..(92): Pfam Name: Histone Pfam Description: Core histone H2A/H2B/H3/H4
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKSASSKASGHDDDDN

SEQ ID NO: 12804 - DNA, 813 bp, Panicum virgatum
  misc_feature: Ceres CLONE 1765805
  misc_feature: Encodes the peptide sequence at SEQ ID NO. 12805
atagttccattccattccatcccatcccaaatccaagcagaaccgaagctccggacagtttgagattcaatcgaggatggtggcgccggtggtgatcgcgtcggcggggctcggcatgctggcgggcctggcgatggcgaaccggtcgctgggggacgggctcccggcggcgtccaggtgggacgcgcgcccgcgctgcgccacgtgcggcggctccggccgggtcgagtgcctgtgcaaccgctggtccgacggcgactccggctgccggacctgcgccggctcgggcaggatgccctgccgcagctgcggcgggtccggcacgggaaggccgctccccgcgcggctcaccgtccagcaccagaagccgccgccgccggccggctacaactgacggtcggtcgatcgattgattaggtatatgtccatatccatggatcgatgattatagctcgttctttgcgctcgaggcgcaagcgaaaaactccgctagctagtatggaaatatacgtccattcgatcgtgtggatgagatgttgtatgtatatgtctctctgcttcatcaagacttgtagtaattgagcatacttgtgttgatgttgttagtaatttgcaaattgcgcaacacaagggaaggaagaaagaaaaaagagggggaaaaagtttggagatctacccgagaacgaacatgcatgattgagagtagacagagggcacaagagatgaagaacagttttgctggcaaagttgtagttatggtggtggatgtaatatatgcttggattattcgttaatatatatatatatatatat

SEQ ID NO: 12805 - protein, 105 aa, Panicum virgatum
  misc_feature: Ceres CLONE 1765805
  misc_feature: Useful for making plants with modulated nitrogen use efficiency
MVAPVVIASAGLGMLAGLAMANRSLGDGLPAASRWDARPRCATCGGSGRVECLCNRWSDGDSGCRTCAGSGRMPCRSCGGSGTGRPLPARLTVQHQKPPPPAGYN

SEQ ID NO: 12806 - DNA, 753 bp, Panicum virgatum
  misc_feature: Ceres CLONE 1765809
  misc_feature: Encodes the peptide sequence at SEQ ID NO. 12807
gaagtttcggcggcggcggcgtgctcgtgatctcaacaccaagcgctcgcttccggtcacccgtcgctccacgcagccatgtcgaggaggaagaccagggagcccaaggaggagaatgtcacccttggccccactgtccgtgagggagagtatgtctttggtgttgctcacgtctttgcatccttcaacgacaccttcattcatgttactgatttgtctgggagggaaactctggttcggatcactggtggcatgaaggtcaaggctgatcgtgatgaatcgtcaccttatgctgctatgcttgcagctcaagacgttgcagctcgttgcaaggagcttggtatcactgcgctgcacattaagcttcgtgccactggaggcaacaaaaccaagactcctgggcctggtgctcagtctgctcttagggctcttgctcgttctggcatgaaaattgggcgcattgaggatgttaccccagttcccactgacagcactcgcagaaagggtggtaggaggggaaggaggctgtaggcgtcttctcctggctatttgccatatcatggcgcaggccatgaagaaactagtcctctctgggtagtgttgctgttcctatgcttgtcaagaggagctttaattttgctgtatgttgaggatcatttaccgttagtcgaacctgtgatgttgcatggatgatgttttggttgaggaattgacttgtcatatttatgctaaaaaaacatgtgttttcactct

SEQ ID NO: 12807 - protein, 150 aa, Panicum virgatum
  misc_feature: Ceres CLONE 1765809
  misc_feature (28)..(146): Pfam Name: Ribosomal_S11 Pfam Description: Ribosomal protein S11
  misc_feature: Useful for making plants with modulated biomass
MSRRKTREPKEENVTLGPTVREGEYVFGVAHVFASFNDTFIHVTDLSGRETLVRITGGMKVKADRDESSPYAAMLAAQDVAARCKELGITALHIKLRATGGNKTKTPGPGAQSALRALARSGMKIGRIEDVTPVPTDSTRRKGGRRGRRL

SEQ ID NO: 12808 - DNA, 611 bp, Panicum virgatum
  misc_feature: Ceres CLONE 1765811
  misc_feature: Encodes the peptide sequence at SEQ ID NO. 12809
attcagctgagcgagcccgatcagccttcaaacaacaaagccccccaattatcctttcatcagatcatcttccttcttccaaaatgtcttgcagctgcggatcaagctgcaactgcggctccaactgcaagtgcggcaagatgtaccctgaccttgaggagaagagcagcggcggcgctcaggccaccatcgtcctcggcgtggccccggagaagaaggccggccagttcgaggcggcggcggagtccggcgagaccgcccacgcctgcaagtgcggtaacagctgcagctgcgacccctgcaactgctgatttcgatggtttttgtcagaacacacctgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtgtctgtatgtgttgatcattgcaaagaaaccatgcaggcatacatctctgcatgtgtctctgtaatgatcggtccagagtgatgaatatataaaactggtttgcttt

SEQ ID NO: 12809 - protein, 75 aa, Panicum virgatum
  misc_feature: Ceres CLONE 1765811
  misc_feature (1)..(75): Pfam Name: Metallothio_2 Pfam Description: Metallothionein
MSCSCGSSCNCGSNCKCGKMYPDLEEKSSGGAQATIVLGVAPEKKAGQFEAAAESGETAHACKCGNSCSCDPCNC

SEQ ID NO: 12810 - DNA, 644 bp, Panicum virgatum
  misc_feature: Ceres CLONE 1765815
  misc_feature: Encodes the peptide sequence at SEQ ID NO. 12811
ctcctggagctcctcacgggccgccgctccatggagcacgtccgcggccggagcgcgcacgccgagcagcaggtcaagctcgtcgactggacccgcccttacctcagcggcggcagccgccggctgcgctgcatcatggaccagcgcctggcggggcactactccgtcaagggcgcgcgcgccgtggcgcagctcgcggtgcagtgcacggcgccgcagccgcgggaccggccgcgcatggcagccgtcgtggaggcgctcgagcggctgcaggggctcaaggacatggccgtcagcgtcgggctctggcccgccggcgcgcccgtcgccgggaggaacgccatctccgccaagatccgcgccgaggtcaagagcgccggcgtcaacgccggctcgcgccggaggagcgcctcctccaagctgccatgatcgaattcgaatcgccatcgcgtacttgcattgtatgatcgcgcgcgcgcgggtatatagaaagattttacagttggtttagtatatatataggcgctgtatgagcaaattgagcatgagatgtggtcactggtcaggcaggcgcagaggcagatgagatcacgccctgtatcctcctccatggctgtaccatccatactgcttttggattcatc

SEQ ID NO: 12811 - protein, 142 aa, Panicum virgatum
  misc_feature: Ceres CLONE 1765815
  misc_feature: SWISSPROT Homolog: EC 2.7.11.1 Non-specific serine/threonine protein kinase
LLELLTGRRSMEHVRGRSAHAEQQVKLVDWTRPYLSGGSRRLRCIMDQRLAGHYSVKGARAVAQLAVQCTAPQPRDRPRMAAVVEALERLQGLKDMAVSVGLWPAGAPVAGRNAISAKIRAEVKSAGVNAGSRRRSASSKLP

SEQ ID NO: 12812 - DNA, 649 bp, Panicum virgatum
  misc_feature: Ceres CLONE 1765865
  misc_feature: Encodes the peptide sequence at SEQ ID NO. 12813
acctcgtctatcccatctaaaccaaccgccgccccgccccgcccacccaaacccctccgcccccgccgccgcgatgagctactacggccagcagcagccgcccgtcggcgtgcctcccccgcaagggtaccccgggaaggacgcgtacccaccggccggctacccgcccgcggggtacccgccgccggcgcaggggtaccctcccgcggggtaccctccgcagcaggggtacccgcagcagggctacccgccgccgtacgcgcagccgccgccgccgcagcgcccgcagagcagcggagggccctccttcatggagggatgcttggccgccctttgctgctgctgcctgttggaagcctgcttctgagttctaaggatacagcaacatgctcagcaattctgttgcgcgcactttcatataatcgggattgggttgtgaagctgcttcctagctacggagaatacagctactcttatgcaaatcacatctctccgtcctcttatcgatctgtttcttcgttgagatgattgggtgtacttagtggtcccatgaagtttatgtcaccagtggaatccttggtctagctagcattgtgagatattttcctctctgtagccattgcattttggtccgcggcagcattgtctt

SEQ ID NO: 12813 - protein, 97 aa, Panicum virgatum
  misc_feature: Ceres CLONE 1765865
  misc_feature: Useful for making plants with altered cell wall content and/or composition
  misc_feature: Useful for making plants with altered carbohydrate content
MSYYGQQQPPVGVPPPQGYPGKDAYPPAGYPPAGYPPPAQGYPPAGYPPQQGYPQQGYPPPYAQPPPPQRPQSSGGPSFMEGCLAALCCCCLLEACF

SEQ ID NO: 12814 - DNA, 852 bp, Panicum virgatum
  misc_feature: Ceres CLONE 1765870
  misc_feature: Encodes the peptide sequence at SEQ ID NO. 12815
atcttccctgcttcactccatcgccactccaagagctcccaatcgtcacgccatggccagcatggtcaccaccatggctgccatagcagctttctcggccccaagaagcctccagcaggccccggccccgttgcagctccgcccgaacgccgtgtcgttcgtcgcacacccggttcgcgcgcaccgccggctggtggccgtggcggccagctcgccggccacgccgccggacctcgccaacaaggtgtccgagagcatcaagcaggcgcaggagacgtgcgcggacgacccggtgagcggcgagtgcgtggcggcgtgggacgaggtggaggagctcagcgcggccgccagccacgcgcgggaccggcagaagggcgccgacccgctcgaggaattctgcaaggacaaccccgagaccgacgagtgccgcatgtatgaggactgagccgcgcgaggctgctcgtcgtgccatccgccgtcgccgtcagcctgtcacctgatctagctggcttagctagagtggcatgacggcaacatgcgtgaatgtatgatggatctgctccttcgtctccttgggcgtttgagtttggtttcttagtttcatctggcttggtttgcaataaagcgaggtttgtctattggtttgttatttacaagaaatatttaggagctcctactgtaatcccaaggcaaagatgtaacaatcattaggaatatgtttgttggtgtgcttctggaacatgattttactaggagtatatctgtatatgtgatacgctgtgaaatatcgcagatgtaacatcttgtttatgccacgaatttaagagtctttgtccaattaattagtacacg

SEQ ID NO: 12815 - protein, 130 aa, Panicum virgatum
  misc_feature: Ceres CLONE 1765870
  misc_feature (61)..(130): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)
MASMVTTMAAIAAFSAPRSLQQAPAPLQLRPNAVSFVAHPVRAHRRLVAVAASSPATPPDLANKVSESIKQAQETCADDPVSGECVAAWDEVEELSAAASHARDRQKGADPLEEFCKDNPETDECRMYED

SEQ ID NO: 12816 - DNA, 789 bp, Panicum virgatum
  misc_feature: Ceres CLONE 1765880
  misc_feature: Encodes the peptide sequence at SEQ ID NO. 12817
gactcgggcagacaaatcctatcctctttcacctagtcaccacagtctctccgcgcgccgcgtgagccgccaacgatggccctggagacgtgcttcagagcgtgggcgctgcacgccgcccccgccggcggcaaggacaggctcgccgtcggcagcagcttcgcgccgtccaagcgggccgccgccgcgccgctgtccgtcggccgcgtcgccacgcggcggccgcggcacgtctgccagtccaagaacgccgtcgacgaagtgctggtggcggacgagaagaactgggacgggatggtgatggcgtgcgagacgccggtgtttttggagttctgggcgccgtggtgcgggccgtgccggatgatcgcgccggtgatcgacgagctggccaaggactacgccggccagatcaagtgctgcaaggtgaacacggacgactgccccaacgtggcctccacctacggcatccgcagcatccccaccgtgctcatcttcaagggcggcgagaagaaggagagcgtcatcggcgccgtgcccaagaccacgctcaccaccatcgtcgacaagtacatcggcagctcgtgagccagacaactataaatacatacgtgtccgtgctcgcgcgtacacaccatgtatgtgtatctcttgtttcgtagcaaggatgatgatgcgataactcaggcagccgtctgctcctgctccgttatactatgtccaatccaactccattaattagtttcgatcggtgcatgattttcacagtgaatattataaatcaagtcatgc

SEQ ID NO: 12817 - protein, 169 aa, Panicum virgatum
  misc_feature: Ceres CLONE 1765880
  misc_feature (62)..(165): Pfam Name: Thioredoxin Pfam Description: Thioredoxin
  misc_feature: SWISSPROT Homolog: EC 1.8.1.8 Protein-disulfide reductase
MALETCFRAWALHAAPAGGKDRLAVGSSFAPSKRAAAAPLSVGRVATRRPRHVCQSKNAVDEVLVADEKNWDGMVMACETPVFLEFWAPWCGPCRMIAPVIDELAKDYAGQIKCCKVNTDDCPNVASTYGIRSIPTVLIFKGGEKKESVIGAVPKTTLTTIVDKYIGSS

SEQ ID NO: 12818 - DNA, 560 bp, Panicum virgatum
  misc_feature: Ceres CLONE 1765902
  misc_feature: Encodes the peptide sequence at SEQ ID NO. 12819
  misc_feature (240)..(240): n is a, c, t, g, unknown, or other
cgccgacggcgcccccacggccaaccccgcggaccccaaccgcggagccgcccgcggcgaccgccagacaaacaacggcgacaccgaggggggccgccccccgcacgacgcgccgaagaccgacgagcacagccccaaacgggcgcggcgcggcggcaacaacacaaaccacagccgcagggacgacaagggaacaggggcacaagcggcagccgcggggggaggcagaaccgccccaangaaggcggagcagaaaagagaagcagagaaattttttgtcggagaatttagtagtgtcaagcatgtgaggggaatactatccatgggaaggcactcggatccagatagcggcggctcatccttttctttccttcttggcgatgctccacaccttgatgggcagtatgctgtatttgggagggtcactaaaggtgatgatacattgagaaagctagagaggcttccaacccgcagagaaggcatttttgtgatgccaatcgagcgaatcgacatcctatcaacatactattatgatattgatatagagagctgtgaagcgg

SEQ ID NO: 12819 - protein, 186 aa, Panicum virgatum
  misc_feature: Ceres CLONE 1765902
  misc_feature (27)..(177): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
  misc_feature (80)..(80): Xaa is any aa, unknown, or other
ADGAPTANPADPNRGAARGDRQTNNGDTEGGRPPHDAPKTDEHSPKRARRGGNNTNHSRRDDKGTGAQAAAAGGGRTAPXKAEQKREAEKFFVGEFSSVKHVRGILSMGRHSDPDSGGSSFSFLLGDAPHLDGQYAVFGRVTKGDDTLRKLERLPTRREGIFVMPIERIDILSTYYYDIDIESCEA

SEQ ID NO: 12820 - DNA, 808 bp, Panicum virgatum
  misc_feature: Ceres CLONE 1765908
  misc_feature: Encodes the peptide sequence at SEQ ID NO. 12821
gttcgggaactcgaagaaggcgttctcgttatcctctgcggtttggggtgggcgagtggagcgagggaggacggcgaggatggctgggatggcggcgctgcagggcgccatggcggcgctctccgtctccgcgcccggcgcggcgagcaccagcagcttctggggcaatcggctcgccacctgctccgcgccgcagcctgggataaggtttatggtcaagacatgcccaattgagatgagacttaagagatgggagcgaaagaagtgcaaaccgaacagccttcccatgctgcacaagatgcatgttaggattggggacaccgtacaagtcatcgcaggccgtgagaaaggtaaggttggagaagtcacacgcctcttcaagcacaacagcactgtgatcgtgaaggacctgaacttgaagtcgaagcacaagaaaggcacggaagatgagccgggtgaaatcgtcatgatcgagggccccatccatagctcgaatgtgatgctctactcgaaggagaagagtgtggcaagcagggtcggccacaagttcctcgaggacgggaccaaggtccggtacctgatcaagaccggggaagtcatcgacagcgtcgagaagtgggtgaaggtgttcaaggaaggagattccgagtaacgatgttgttattaggatggaaagcctgcacacatgctctgaaccctctggctgtttccttgttgcatgccgaaatgagtctgtttattcttctgcgtagctccaggttgtttttccctgtaaattttacaattatttatatgaccaaattttggc

SEQ ID NO: 12821 - protein, 190 aa, Panicum virgatum
  misc_feature: Ceres CLONE 1765908
  misc_feature (78)..(109): Pfam Name: KOW Pfam Description: KOW motif
MAGMAALQGAMAALSVSAPGAASTSSFWGNRLATCSAPQPGIRFMVKTCPIEMRLKRWERKKCKPNSLPMLHKMHVRIGDTVQVIAGREKGKVGEVTRLFKHNSTVIVKDLNLKSKHKKGTEDEPGEIVMIEGPIHSSNVMLYSKEKSVASRVGHKFLEDGTKVRYLIKTGEVIDSVEKWVKVFKEGDSE

SEQ ID NO: 12822 - DNA, 607 bp, Panicum virgatum
  misc_feature: Ceres CLONE 1765951
  misc_feature: Encodes the peptide sequence at SEQ ID NO. 12823
caacgaacagaatcgacatcttggatctagcccttctgaggcctggacgcatagacaggaagattgaatttccgaatcccaatgaggattcacgtttcgatatcttgaagattcattcaagaaaaatgaacttgatgcgtggtattgatctgaaaaagattgcagaaaagatgaatggagcctcaggagctgagctgaaggcggtctgcacagaagctggaatgtttgcccttcgcgagagaagggtacacgttacacaggaggactttgagatggcggtggccaaggttatgaagaaagacacggagaagaacatgtccctgttcaagctctggaagtgaggttcatgccaaagatgccccgcaaccttcacagcctcaccaaagctcgtgccttcaaatcctgagctttttccgccttgccatatagcagtggaatggtgtaactgcatgctccggaccttcgccatgtgtcttttttttttaataactttatgccgtgcatgcctatgtttaaagttttctgataacagatgtagtatgttgttgcaaagttaaaatttatggattggctagatacgggataattcattgctagctcgcgatgt

SEQ ID NO: 12823 - protein, 112 aa, Panicum virgatum
  misc_feature: Ceres CLONE 1765951
  misc_feature: SWISSPROT Homolog: EC 3.6.4.3 Microtubule-severing ATPase
TNRIDILDLALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLFKLWK

SEQ ID NO: 12824 - DNA, 834 bp, Panicum virgatum
  misc_feature: Ceres CLONE 1765953
  misc_feature: Encodes the peptide sequence at SEQ ID NO. 12825
tgcgaccattcttcattctgctgcttgccacctcttcacaaagcaggccttcttcttctgtagctctaagcctcttgcaagctcagctgctgcttgtgacaagatccccatccgcttgagttcagcatcgatggcggcggaggaggcaaagaaggtggaggtggaggcgaccaaggacatcgccgaggagaaggcgattgtgccgctgccgactccaccggctgcgcccaaggtcgacaagccagccgacgactccaaggccatcgttgttgtcaaggacgctgctgagaaacctgcagctacaggaggttcaactgaaagagatgcttatctggcgaaaattgtatccgagaagagattgactctgatcactgcatgggaggagagtgagaaggcgagagctgagaacagggctgccaagaagcttgcctacatcacatcttgggagaaggcgaagaaagcagagatggaggccgagcttaaaaagatggaggagcaactggagaagaagaaggcggcgtacgaagagaagctgaagaacaagctggcgatgctccacaagacggcggaggagaagagggcgctgacggaggcgaagcgcggcgaggagatgatcatggcggaggagctggccgccaagtaccgcgccaagggtgaggctcccaccaagctcttcggcctcttgaaagcataacaaacgtcatctcgatcttctatgccgatccaagacatgcatacatacatacgttgggatggattattattgttacctatatatatatatatatatatatatatatatatatatatatatatatatatatatatatatat

SEQ ID NO: 12825 - protein, 187 aa, Panicum virgatum
  misc_feature: Ceres CLONE 1765953
  misc_feature (73)..(182): Pfam Name: Remorin_C Pfam Description: Remorin, C-terminal region
  misc_feature (15)..(71): Pfam Name: Remorin_N Pfam Description: Remorin, N-terminal region
  misc_feature: The sequence is a functional homolog of SEQ ID NO 1773 in the 11/479,226 US patent application
  misc_feature: The sequence is a functional homolog of SEQ ID NO 20 in the 10/286,264 US patent application
  misc_feature: The sequence is a functional homolog of SEQ ID NO 876 in the 10/412,699 US patent application
  misc_feature: The sequence is a functional homolog of SEQ ID NO 438 in the 10/666,642 US patent application
  misc_feature: The sequence is a functional homolog of SEQ ID NO 496 in the 11/435,388 US patent application
  misc_feature: The sequence is a functional homolog of SEQ ID NO 1492 in the 11/479,226 US patent application
  misc_feature: The sequence is a functional homolog of SEQ ID NO 644 in the 11/435,388 US patent application
  misc_feature: The sequence is a functional homolog of SEQ ID NO 716 in the 10/412,699 US patent application
MAAEEAKKVEVEATKDIAEEKAIVPLPTPPAAPKVDKPADDSKAIVVVKDAAEKPAATGGSTERDAYLAKIVSEKRLTLITAWEESEKARAENRAAKKLAYITSWEKAKKAEMEAELKKMEEQLEKKKAAYEEKLKNKLAMLHKTAEEKRALTEAKRGEEMIMAEELAAKYRAKGEAPTKLFGLLKA

SEQ ID NO: 12826 - DNA, 544 bp, Panicum virgatum
  misc_feature: Ceres CLONE 1765956
  misc_feature: Encodes the peptide sequence at SEQ ID NO. 12827
agcagccatcgcctcttgcctcctccgcagctagctagcccagctcgtcgcagctccggcaagcctctggtacaacgcgagcggagccacgccggatcggagccgagcgagacgatggccggcgcgacggcggcggtgacggtggaggaggtgaggaaggcgcagcgcgcgtcgggtccggccaccgtgctggctatcgggacggcgacgccggcccactgcgtgcaccaggccgactacccggactactacttccgggtcaccaagagcgaccacctcaccgacctcaaggagaagttcaagcggatgtgtgagtacttttttgaattattattttttaaatagtagatgtgtgtgtgagtgactcaatcacgtgtatgtatgtagctagctagctcctgcactagcagctagctaccacttccatatgcagcacatgctgctggtgatgacctggtgtgtgtgcgtgcgcatcgtgatctcatccatagattgtagaagtgattgcagcacatgcagcagagaggcagaagtgattctgacc

SEQ ID NO: 12827 - protein, 76 aa, Panicum virgatum
  misc_feature: Ceres CLONE 1765956
  misc_feature: SWISSPROT Homolog: EC 2.3.1.74 Naringenin-chalcone synthase
  misc_feature: The sequence is a functional homolog of SEQ ID NO 2 in US patent 7202397
MAGATAAVTVEEVRKAQRASGPATVLAIGTATPAHCVHQADYPDYYFRVTKSDHLTDLKEKFKRMCEYFFELLFFK

SEQ ID NO: 12828 - DNA, 798 bp, Panicum virgatum
  misc_feature: Ceres CLONE 1765974
  misc_feature: Encodes the peptide sequence at SEQ ID NO. 12829
acacaaagaaaactagtcagattctttcttttccgaggctccaactctctctcgtgctcgatcgcctcctcctcctcccatggcctcggcgaacgacggcgaccgcgcggcggcgggcatcctgcggctgctgctggggttggcgggcgcgccctccacggcattgccgcgcggcggcggcggccctggcctggttgtggtgcagcacttcatcgtggacggcgacggggacctgttctcgggcggggtcggcgggggcgtgccgccggcgtcgaaggccgccatcgccgcctgaaggaggtgaaggccggggaggtcgaggacggggacccgctgggagactgcgcgatctgcctggacggcgtggaggacgccgcgaaggagatgccgtgcgggcaccgcttccacggggagtgcctggagcgctggctaggcgtgcacggcaactgccccacctgccgacacgagctgccgccggcgaaggacgaggacggcgcggcggcggagggcggcgaggagaggcgcaggccgaggacagcggtcgtggtgagctacatggtactcggagaccagcgggaggaggagcaggcgcagcagcagccggagagacaggagccgtggaccattaggatagaggacgtggattaggattaggaggtaggtttaggcctctaaatctttcccaattggtttacggattggttttggggtgtctgttttgtacctactggtggagggagatgggaaaattgtgaatatttcgttgtcaaagacgatgtacacggaaggtttaatttc

SEQ ID NO: 12829 - protein, 215 aa, Panicum virgatum
  misc_feature: Ceres CLONE 1765974
  misc_feature (115)..(153): Pfam Name: zf-C3HC4 Pfam Description: Zinc finger, C3HC4 type (RING finger)
  misc_feature: SWISSPROT Homolog: EC 6.3.2.19 Ubiquitin--protein ligase
TQRKLVRFFLFRGSNSLSCSIASSSSHGLGERRRPRGGGHPAAAAGVGGRALHGIAARRRRPWPGCGAALHRGRRRGPVLGRGRRGRAAGVEGRHRRLKEVKAGEVEDGDPLGDCAICLDGVEDAAKEMPCGHRFHGECLERWLGVHGNCPTCRHELPPAKDEDGAAAEGGEERRRPRTAVVVSYMVLGDQREEEQAQQQPERQEPWTIRIEDVD

SEQ ID NO: 12830 - DNA, 982 bp, Panicum virgatum
  misc_feature: Ceres CLONE 1765977
  misc_feature: Encodes the peptide sequence at SEQ ID NO. 12831
ctctactcgccctctcgcgccgccgccgcacttcccgtctggtatcgtctgcgcagcaagccctagcagcaggtggatcggttgtcgacggatagcagccatgagtaagttgcaaactgaggtcctcaaggatgccatctcccaggtcgtgtctgaggcaagggagaagaacaggaagttcacagagaccatcgagctccagattggactgaagaactacgatccgcaaaaggacaagcgtttcagtggctccgtcaagctgccccacatccctcgccccaagatgaaagtctgcatgcttggtgatgcccagcacgtggaggaggctgagaagatcggtcttgattacatggatgttgaagctcttaagaagatgaacaagaacaagaagcttgtcaagaagcttgctaagaagtaccatgctttcttagcttctgaggctattatcaagcagattccccggctccttggtcctggtctcaacaaggcaggcaagttcccaactttggttactcaccaggaatctctggaatcaaaggtgaatgagacgaaagctacagtcaagttccagctcaagaaggttctttgcatgggtgtggctgtgggcaacctgtcgatggaggagaagcagatccagcaaaacatccagatgagcgtcaacttcctggtttcgttgcttaagaagaattggcagaacgtgaggtgcctgtacatcaagagcaccatggggaagccaaatagggtgttctaagttgctgcatccatgcctgtttaaaaccgacaccgtagtctgtagtggagtttgctatgggattttttgtttatgcagtaatctatcgtaccgttttgcaaattttgtgcctgaagtaagagtggatttatgatgcactagtgtttttcaccgtgcccttgagctgacgggacaatgtgcatcaagctacgctgctgctgttggcatagttcttgggaatgcctctttgat

SEQ ID NO: 12831 - protein, 216 aa, Panicum virgatum
  misc_feature: Ceres CLONE 1765977
  misc_feature (8)..(212): Pfam Name: Ribosomal_L1 Pfam Description: Ribosomal protein L1p/L10e family
MSKLQTEVLKDAISQVVSEAREKNRKFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPNRVF

SEQ ID NO: 12832 - DNA, 769 bp, Panicum virgatum
  misc_feature: Ceres CLONE 1765983
  misc_feature: Encodes the peptide sequence at SEQ ID NO. 12833
gctcagacctactgctactaccctccctgcagacaccctccctgtcgctctcacgcgcttcgtgctcgccgcctcccccacttccgcatcgcgccccccatggcctccatcgccggatccgccctctccttcgccgggcccgtcaaggccgtcaacactagctcgctctctttctctgctgcgaggaagggcaatgcattcctccgcctgcagccagtgcagaagagattcgctgtttgctatgctgccaaaaaggatacagtggacaaggtttgtgaaattgtgaagaagcagcttgctgttccagagggcactgatgtttgttgtgcctcgaagttctctgatcttggtacagattcacttgatacggttgagattgtgatgggccttgaggaggagtttcagatcagcgtcgaggaatcaagcgctcagtcaattgcgacagttgaggatgctgctgagctcatcgacaagcttgttgctaagaaatcgtcctaaagtcacaaggcgtgatggatctaccttgttcgtgtcctgcccactcaccccatatctaggtttctatgctctgtaggcttggcgattttctcagcattgttgtccactgtgtctgtaataataccgaaatgattttctcagcattgttgtccactgtgtctgtaataataccaaaatgagtttaagctgttgaaccttatggtggtgcgtattctgtcagttcattgttgtatgagtgattcttcctggaagaaatgaatgattcttcctg

SEQ ID NO: 12833 - protein, 132 aa, Panicum virgatum
  misc_feature: Ceres CLONE 1765983
  misc_feature (56)..(123): Pfam Name: PP-binding Pfam Description: Phosphopantetheine attachment site
MASIAGSALSFAGPVKAVNTSSLSFSAARKGNAFLRLQPVQKRFAVCYAAKKDTVDKVCEIVKKQLAVPEGTDVCCASKFSDLGTDSLDTVEIVMGLEEEFQISVEESSAQSIATVEDAAELIDKLVAKKSS

SEQ ID NO: 12834 - DNA, 682 bp, Panicum virgatum
  misc_feature: Ceres CLONE 1765992
  misc_feature: Encodes the peptide sequence at SEQ ID NO. 12835
gccttctccttcccgcaaggccgcaactactctcgacttccccacaaaactgaacaagctcgggctcctcttctcgcgtctccctcctgcaatctctctccaccagctccacgccgcgctgctaatcctgttcctacttcgccggctaagatggacggcagcagcctcaagtccgcgcagctcctggaccagatgcgcctgcacatggccaccgacgccggcaaggagctcaccaagaaggtcggcctcgtctaccagctcaacatcgcccccaagaagctaggcgttgacgaggagatcttcgtggtcgacctcaagaagggcgaggtcaccaaagggccgtaccaggggaagccggatgctaccttctccttcactgacaaagatttccttggaatcgccactggcaagaccaacccgcagattgctttcatccaaggggcgattaaaatcaaggggagcattagcgcggcgcagaagttcacccctgacatcttccccaagccagcgaagctgtagaaggttagaatgcattatttgggtgcggatggataataaagtttccaagcttcaaccactatgtacctgataggatgaggggaatacatgaaaacacgatgatctgtctttatcaatggaatacggataatgccttggttaatatatcacttaaattgagctc

SEQ ID NO: 12835 - protein, 122 aa, Panicum virgatum
  misc_feature: Ceres CLONE 1765992
  misc_feature (12)..(117): Pfam Name: SCP2 Pfam Description: SCP-2 sterol transfer family
  misc_feature: SWISSPROT Homolog: EC 2.3.1.176 Propanoyl-CoA C-acyltransferase
MDGSSLKSAQLLDQMRLHMATDAGKELTKKVGLVYQLNIAPKKLGVDEEIFVVDLKKGEVTKGPYQGKPDATFSFTDKDFLGIATGKTNPQIAFIQGAIKIKGSISAAQKFTPDIFPKPAKL

SEQ ID NO: 12836 - DNA, 577 bp, Panicum virgatum
  misc_feature: Ceres CLONE 1766011
  misc_feature: Encodes the peptide sequence at SEQ ID NO. 12837
gctgcagcgccggtttggttcggtttgcttggggtcggagcagggggtcgccgtcggcttgctttaatacgcgggggagcgggcgcctccccagcgtctgccgagagagttcgggaggaggaagacgaggcaagaagaagagggtgaggagggtcatcggagatgtcggactgggggccggtggtggtggcggtggtgctgttcgtgctgctctcgccggggctgctgctgcagctgccggccaagggcggccgcctcgtcgagttcggcaacttccagaccagcggtgcctccatcttcgtccacgccatcatcttcttcgccctcaccgccgtcttcctcatcgccatcggggtccacatcaccaccgactagccggccggccggccttagctgccgagcacctcgtacgatacggcagcctgtatgtgcatcagtatttgcagattgtaaatttgtaactgtactgtacccctcggctagcagttaaagcgtttatatatgcagggatttgtaatcttcttatcagacggattttaaaactattgtacactagccactgaatttctttctgatc

SEQ ID NO: 12837 - protein, 70 aa, Panicum virgatum
  misc_feature: Ceres CLONE 1766011
  misc_feature: Useful for making plants with altered cell wall content and/or composition
MSDWGPVVVAVVLFVLLSPGLLLQLPAKGGRLVEFGNFQTSGASIFVHAIIFFALTAVFLIAIGVHITTD

SEQ ID NO: 12838 - DNA, 719 bp, Panicum virgatum
  misc_feature: Ceres CLONE 1766041
  misc_feature: Encodes the peptide sequence at SEQ ID NO. 12839
aaccctctccacgcaagcacccatctcttcctgcgccgcctccctccgccctcctgcgccgccgccgccgccgccactgccacctccgcagccatggcagactcgaaggccgccgcggcggtgaccctccgcacgcgaaagttcatgaccaaccgcctcctctcccgcaagcagttcgtgctcgaggttatccaccccggccgccccaacgtctccaaggcggagctgaaggagcggctggcgaaggtgtacgaggtcaaggaccccaactgcatcttcgtcttcaagttccgcacccacttcggaggcggcaagtccaccggcttcggtctcatctacgacaacctcgaggccgccaagaagttcgagcccaagtatcgcctcatcaggaatggtcttgctaccaaagtagagaaatctcgtaagcagatgaaggagcggaagaacagggcaaagaagatccgtggtgtgaagaagacaaaggctggcgatgccaagaagaagtaaggctggaaacttgccttgccgtcttgatcttgtctgcctcgggcttgttgaggacggtgtccttttggcaatgctgaatgtttaattagacctagaaaggattttgccagaattatgttgaggctctcgtagtactttgtggtcagttttgaggaacattgtcaggcactagcatatatacttgatcgtcattgcttattctgctatccttc

SEQ ID NO: 12839 - protein, 137 aa, Panicum virgatum
  misc_feature: Ceres CLONE 1766041
  misc_feature (28)..(111): Pfam Name: Ribosomal_S24e Pfam Description: Ribosomal protein S24e
MADSKAAAAVTLRTRKFMTNRLLSRKQFVLEVIHPGRPNVSKAELKERLAKVYEVKDPNCIFVFKFRTHFGGGKSTGFGLIYDNLEAAKKFEPKYRLIRNGLATKVEKSRKQMKERKNRAKKIRGVKKTKAGDAKKK

SEQ ID NO: 12840 - DNA, 734 bp, Panicum virgatum
  misc_feature: Ceres CLONE 1766067
  misc_feature: Encodes the peptide sequence at SEQ ID NO. 12841
atcgtctctcgcggcgcagtcaccaccaccgaacccggcggcgcacgcggaggagcccagcgagaggcggaggaagaaggcgatggcgcgcggcgtggcggcgggggcgaagggcggcgcggccggcgggaagaagaagggctccgtcaccttcacgatcgactgcaccaagcccgtggaggacaagatcatggagatcgccacgctcgagaagttcctgcaggagcgcatcaaggtcgccggcggcaaggccggcaacctcggcgagggcgtcaccgtctcccgcgacaagaccaaggtcaccgtcacctccgaggggcctttctccaagaggtacctcaagtacttgaccaagaagtacctgaagaagcacaacgtgcgtgactggctcctggtcatcgcctcgaacaaggaccgcagcgtctatgagctacggtacttcaacattgccgagaatgagggtgaggaggaggattaggcgcactaccctatctacgtcttgtgaacttttggacgtgttggaacagtcttgctgtagcctttcaagggatgagttttgatgtttaaattggtgtcctgatgtgttttaagagtggcgaatttccatgcgatgcttagataatctgtgtccaaaaatgttggttcctgtgaaacatatcatcagcgatttatcgataggttgtcgctatgattgtctatcgaactgctatatcagtatggaaactcccattgtc

SEQ ID NO: 12841 - protein, 131 aa, Panicum virgatum
  misc_feature: Ceres CLONE 1766067
  misc_feature (17)..(131): Pfam Name: Ribosomal_L22e Pfam Description: Ribosomal L22e protein family
MARGVAAGAKGGAAGGKKKGSVTFTIDCTKPVEDKIMEIATLEKFLQERIKVAGGKAGNLGEGVTVSRDKTKVTVTSEGPFSKRYLKYLTKKYLKKHNVRDWLLVIASNKDRSVYELRYFNIAENEGEEED

SEQ ID NO: 12842 - DNA, 625 bp, Panicum virgatum
  misc_feature: Ceres CLONE 1766080
  misc_feature: Encodes the peptide sequence at SEQ ID NO. 12843
agaggcgcaggcacgtctcggagccctaggctttttctgaggagaagcagagcggaggggggagagagagagagagagagaggcgtctgcgtgcgtggtcggtgtcggtgcgtggcgtggtggccgtgcggtcccctcttcctctcttcctctcggcgccggcggacgtgtcggggggaggaatggccgcgccgagggctccgctcggggcggtcgcgatggccgcgctcgtcgtcgccatcttcatgccggccgcggcggcgcaggggccggcgccggctcccaccagcgacggcacatcaatcgacctgggaatcgcgtacatcttgatgctggtggccctggtgctcacctacctgatccacccgctggacgcgtcctctccctacaagctcttctaatccctgttcgttttgtttgttcgtcgatgatgttatgggtctgataggatttttagccatgcaagacgtttaggtgaggtttggagatttagaatgaacgtcaacgtctgatctgatcttggcatgtatggtaagttttttggtggtctgaatgcctgattggttgtatcggattccatgatcttgtgcccagttgtgcttgctgttggccgttgctggattct

SEQ ID NO: 12843 - protein, 72 aa, Panicum virgatum
  misc_feature: Ceres CLONE 1766080
  misc_feature: Useful for making plants with altered carbohydrate content
  misc_feature: Useful for making plants with altered cell wall content and/or composition
  misc_feature: Useful for making plants with modulated nitrogen use efficiency
  misc_feature: Useful for making plants with modulated salt sensitivity
MAAPRAPLGAVAMAALVVAIFMPAAAAQGPAPAPTSDGTSIDLGIAYILMLVALVLTYLIHPLDASSPYKLF

SEQ ID NO: 12844 - DNA, 672 bp, Panicum virgatum
  misc_feature: Ceres CLONE 1766139
  misc_feature: Encodes the peptide sequence at SEQ ID NO. 12845
accacacccctctgtccccagctctctcctcatggcttgctggaagctctcctctatgctgatggcgctcctcctggccatcgccgccggccctgggacgacgcggccggtggtggctgcgacgtcggcggcggcccacctgcacttctacatgcacgacgtgacgggtggcccgtcacccacggcggtgcgtgtggtcaacgggccgcgcggcaccttcggcaacacggtggtgatcgacgacgagctgacggagggcacgtcaccgtcgtcggcctcggtgggccgcgcgcagggctactacatggtggcgtccgtgtccaacctggagctcatggtgaacatgaacgtcgtgctcacgtccggcctgtacgccggcagctcgctgacggtggtggggcacgacgatgtgagcacgccggtgcgggagctctcagtggtcggcggcacggggcagttcaggatggcgcgcggctacgtgctctggaagaccgtcacccccgagatactcgacctcgaggtcttcgtcaacccttgagacaccactgctgtactagccaatgttttgattctgcttctggatgttttttttaaagcaaattcagcttccattaattagatcgtgctgaatcatcagcaataatacaggcaacatagtccggaatggatgcc

SEQ ID NO: 12845 - protein, 168 aa, Panicum virgatum
  misc_feature: Ceres CLONE 1766139
  misc_feature (11)..(168): Pfam Name: Dirigent Pfam Description: Dirigent-like protein
MACWKLSSMLMALLLAIAAGPGTTRPVVAATSAAAHLHFYMHDVTGGPSPTAVRVVNGPRGTFGNTVVIDDELTEGTSPSSASVGRAQGYYMVASVSNLELMVNMNVVLTSGLYAGSSLTVVGHDDVSTPVRELSVVGGTGQFRMARGYVLWKTVTPEILDLEVFVNP

SEQ ID NO: 12846 - DNA, 789 bp, Panicum virgatum
  misc_feature: Ceres CLONE 1766171
  misc_feature: Encodes the peptide sequence at SEQ ID NO. 12847
agaggatacgccggccgcgccgaaccgaaccgctgacgccgaacgagagaaggtagctgctgcgtgcgccagggggaggacgatatgcagggcggcggcggcggcgtggagcagcagccgatgcagatggtgctgcgggtgaagcacccgacgtcgtcgtcggcgctgggcggcgacgaggaggaggcgggcgagggctcgtcgaggtcggcgctctcggtgttcaaggccaaggaggagcagatcgagaggcgcaagatggaggtccgggagaaggtgttcgcgcacctcggccgcgtcgaggaggagtccaagcggctcgccttcatcaggcaggagctggaaggcatggcggatccaacgcggaaggaggtggagtcgatacggaagaggattgacacggtgaaccgtcagctcaagcctctcggcaagagctgcgtcaagaaggagaaggagtacaaggaggtcctggaggcgtacaacgagaagagcaaagagaaagcgctgctagtcaacaggctaatcgagctggtgagcgagagcgagaggatgcggatgaagaagctagaggagctcaacaagacagtcgactcactctactagacgcccagctgatgctcacctccaccgagagctcgcttgacgcctctgtaatctcagtgtgccataaggattcgggacttgttcaaggtgttgcttgtaactgatgtttctcatcgagtggttcttccttcttctttcttttccttttgtttcttctctttcatcagttggtttgagtctcgttgc

SEQ ID NO: 12847 - protein, 172 aa, Panicum virgatum
  misc_feature: Ceres CLONE 1766171
  misc_feature: Useful for making plants with modulated biomass
MQGGGGGVEQQPMQMVLRVKHPTSSSALGGDEEEAGEGSSRSALSVFKAKEEQIERRKMEVREKVFAHLGRVEEESKRLAFIRQELEGMADPTRKEVESIRKRIDTVNRQLKPLGKSCVKKEKEYKEVLEAYNEKSKEKALLVNRLIELVSESERMRMKKLEELNKTVDSLY

SEQ ID NO: 12848 - DNA, 784 bp, Panicum virgatum
  misc_feature: Ceres CLONE 1766181
  misc_feature: Encodes the peptide sequence at SEQ ID NO. 12849
ccgaagtccgacctactcctcctcctcctcctacccagcagcctccctaccctgtcgctctcacgcgcttcgtgctcgccgcctcccccacttccacgtcgcgccccgcgccccatggcctccatcgccggatccgctctctccttcgccgggcccgtcaaggccgtcaacactagctcgctctctttctctgctgcgagaaagggcaatgcatatctccgcctgcagccagtgcagaagagattcgctgtttgctatgctgccaaaaaggatacagtggacaaggtttgtgaaattgtgaagaagcagcttgctgttcccgagggcactgaagtttgtggtgcctctaagttctctgatctcggtgcagattcacttgatacggttgagatcgtgatgggccttgaggaggagtttcaaatcagcgtcgaggaatcaagcactcagtcaattgcgacagttgaggatgctgccgagctcatcgacaagcttgttgctgagaaatcgtcctgaagtcacaaggcgtgatgttggggacgaactcggaaactagttctaccttgttcctgccctgcccactcacaccatatctagaggtttctatgctctgtaggcttggcgattttctcagcattgttgtgcactgtgtctgtaataataccgatatgattttaagctgttgaaccttacggtggtgcgcattctgtcagttcattgttgtatgaatggttcttcctggaagaaaaatggaatcctgggagcatgtagcaaagattgcctaatt

SEQ ID NO: 12849 - protein, 132 aa, Panicum virgatum
  misc_feature: Ceres CLONE 1766181
  misc_feature (56)..(123): Pfam Name: PP-binding Pfam Description: Phosphopantetheine attachment site
MASIAGSALSFAGPVKAVNTSSLSFSAARKGNAYLRLQPVQKRFAVCYAAKKDTVDKVCEIVKKQLAVPEGTEVCGASKFSDLGADSLDTVEIVMGLEEEFQISVEESSTQSIATVEDAAELIDKLVAEKSS

SEQ ID NO: 12850 - DNA, 799 bp, Panicum virgatum
  misc_feature: Ceres CLONE 1766200
  misc_feature: Encodes the peptide sequence at SEQ ID NO. 12851
gtgtttcgcaaacccaccaataacaaaaaaaaaaaaaaaacgaagcagcacagccgaacccacaccaccaccaagaacagagcacccagcacagacacggagccgacccgacccgcgcgtcctccccgtcgccggcggtatggcttcctcggcggcgtaccccgacgcggacgagaatcttgaggccatcatcacccgcatcgagcagaagtcccgcaagatcgagaccctcctcaagcagtcgaagcccgtggaagccctgaagacggcgctcgaggggtcgcccctcaagacccgcgacgagcgatgcaagtcggcgaactggatcgtggtgcaccgggcgatgatggcgatcagggacgtcgacggcatgttcaactccctagatcccgagtactacgacatcctgatgaagtacctttatagaggattatcgacaggggacaggccaacatgtgaccagtgcctcaaaattcatgaaaaactgactgagaaagcaggattaggatgtatattgcggtcgcttgccgatactgtaaacactgtatgagcttgtgagcttcacctatgaggttggacagaacaaagtttccttcatgttctgtgctgcgataaatcacagcagacaacttagctgtatgaaaattgttggctagatatttagctctcatctggcagtttcagttagagcatcgttgtaccttactagaatggctggatctgaatttatgtagtattatgttgttttgaactccttgtactagactgttgggtttttttcttactatagtaaaaattc

SEQ ID NO: 12851 - protein, 136 aa, Panicum virgatum
  misc_feature: Ceres CLONE 1766200
  misc_feature (3)..(135): Pfam Name: P16-Arc Pfam Description: ARP2/3 complex 16 kDa subunit (p16-Arc)
MASSAAYPDADENLEAIITRIEQKSRKIETLLKQSKPVEALKTALEGSPLKTRDERCKSANWIVVHRAMMAIRDVDGMFNSLDPEYYDILMKYLYRGLSTGDRPTCDQCLKIHEKLTEKAGLGCILRSLADTVNTV

SEQ ID NO: 12852 - DNA, 696 bp, Panicum virgatum
  misc_feature: Ceres CLONE 1766235
  misc_feature: Encodes the peptide sequence at SEQ ID NO. 12853
cccacaccatccaaaacaaaaccctccccttccctcccccccccctgctgccaatcaaccaagaagcccgcgccgcccccccaagtcagggagaaggccatggccggcgtgaactcaaccagcgtcgtcgggctcaagcccgccgcggcggtgccgcaggccgccacctcctcgccggcggcgaagcgggtcccggtcccgcccaaggaccgggcggccgagggccggcgcgcggcgctcctcggcctggcggccgtcttcgccgtcacggccaccaccgggtcggccaaggccgggatcatcgacgagtacctcgagaagatttttttcaacaaggagctgaacgacaagaagaggctggctaccagcggcgccaacttctcccgcgcctacaccgtccagttcggcagctgccatttcccctacaacttcaccggctgccaggacctcgccaagcagaagaaagttcccttcatcactgacgacctcgagatcgagtgcgaggggaaggagaagtacaagtgccgctccaacgtcttctggaagtggtgaagcgcacgcttgattggcttgcaactggagggggcgctggcggtgtaacgtgtgtacctagatgcccaaactgcaggaaaaatttggatgtgtaatttaccgtcactgtatctgtgccatctcatcctcgtctgaacatgaacc

SEQ ID NO: 12853 - protein, 150 aa, Panicum virgatum
  misc_feature: Ceres CLONE 1766235
  misc_feature (9)..(150): Pfam Name: PsaN Pfam Description: Photosystem I reaction centre subunit N (PSAN or PSI-N)
MAGVNSTSVVGLKPAAAVPQAATSSPAAKRVPVPPKDRAAEGRRAALLGLAAVFAVTATTGSAKAGIIDEYLEKIFFNKELNDKKRLATSGANFSRAYTVQFGSCHFPYNFTGCQDLAKQKKVPFITDDLEIECEGKEKYKCRSNVFWKW

SEQ ID NO: 12854 - DNA, 680 bp, Panicum virgatum
  misc_feature: Ceres CLONE 1766249
  misc_feature: Encodes the peptide sequence at SEQ ID NO. 12855
attcagctgagtgtgctcgatcatcaagcaatcaacaaagcctcccaattatcctttcatcagatcatcttccttcttccaaattgtcttgcagctgcggatcaagctgcaactgcggctccaactgcaagtgcggcaagatgtaccctgaccttgaggagaagagcagcggcggcgctcaggccaccatcgtcctcggcgtggccccggagaagaaggccggccagttcgaggcggcggcggagtccggcgagaccgcccacgcctgcaagtgcggtaacagctgcagctgcgacccctgcaactgctgatttcgatggggaacgtcagaacacacctgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtctgtatgtgttgatcattgcaaagaaaccatgcaggcatacatctctgcatgtgtctctgtaatgatcggtccagagtgatgaatatataaaactggtttgctttatctgcctaatgcgtatttatcgtcttaatttggatcgtctttgcaaaatggaaaaaaataggttccagcc

SEQ ID NO: 12855 - protein, 102 aa, Panicum virgatum; identical to SEQ ID NO: 11990
  misc_feature: Ceres CLONE 1766249
  misc_feature (28)..(102): Pfam Name: Metallothio_2 Pfam Description: Metallothionein

SEQ ID NO: 12856 - DNA, 977 bp, Panicum virgatum
  misc_feature: Ceres CLONE 1766250
  misc_feature: Encodes the peptide sequence at SEQ ID NO. 12857
ctcctcttcggctcttccctgcgagaaccaaccagaagagcggcggcgcgggcggaccagaaggtggcagcgtagcagcagcagcaagccgggcaagggcacccgccgccaccatgggaatctcgcgtgactcgatgcacaagcgccgggccaccggtgggaagcagaaggcctggaggaagaagcgaaagtatgaactcgggcgccagcctgctaacaccaagctgtccagcaacaagacagtgaggagggtccgtgtccgtggaggtaatgtgaagtggagggctctacgcctggatactggtaactactcatggggtagtgaggctgttactcgcaagacccgtatcctggatgttgtctacaacgcgtcaaacaatgagcttgttcggacccagacccttgtgaagagcgccattgtgcaagttgatgctgccccattcaagcagtggtaccttactcactatggagtggacattggtaggaagaagaaggccccggctgctaagaaggatgctgctgagggtcaagagggtgaggccacagctgaggaaacaaaaaagagtaaccatgtccagaggaagcttgagaagcgccagcagggacgcacacttgacccgcacattgaggagcaatttggcagcggaaggttgttggcatgcattgcttctcgccctgggcagtgtggccgagctgacggttacatccttgagggtaaagagctcgagttctacatgaagaagctccagaggaagaagggcaagggtgccgcagcttagaaacattatattgtctggaagcgtggcctatcttatcctttactctgggttttgttagttctcaagtatgttatgtcgtgttgcagacctgatgaacagccaagtgaatcaactctagcttcaaggaactgagaattttcaccttctgtggtattctcttgatatttaaattcacagtttattgacagtttgtgttcg

SEQ ID NO: 12857 - protein, 221 aa, Panicum virgatum
  misc_feature: Ceres CLONE 1766250
  misc_feature (1)..(199): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAAEGQEGEATAEETKKSNHVQRKLEKRQQGRTLDPHIEEQFGSGRLLACIASRPGQCGRADGYILEGKELEFYMKKLQRKKGKGAAA

SEQ ID NO: 12858 - DNA, 1002 bp, Panicum virgatum
  misc_feature: Ceres CLONE 1766271
  misc_feature: Encodes the peptide sequence at SEQ ID NO. 12859
caaaaagaatctctttccagtaacaggatgcagcctagacttagaagaagctaagccgtcttttaattctctcgggtcctccaaagctgtttttcctcctttctctcatgcccacaatgctggcagccatctctttacggaatcttgcttgctcatcaaggttatcatcctgttcagaattcacatctggcaattcctggcgtcccatagaggctgcaaaactccaccggacatgttctgtgagctcgattcatataagctgtgctgctactaagcctgcaaagactcctgctgaagtagagtggaaagttaagcggcaactcctagcagaaaagcgggtacgcagtgttgatgtgaaggaagcattgcgccttcaaaaggagaataactttgtgattcttgatgtcagaccagaagcagagtttaaagaggctcatccacctggcgccatcaatgtacaaatatacagattaataaaggaatggacggcatgggatattgcaaggcgtgcagcatttgcgttctttggcatatttgctggaacagaagagaatcctgagttcatacaaagtgttgacacgaaaattggtaaagatgcgaagataattgtggcatgttctacaggagggacactaaagcctacacaaaattttcctgatggaaagcaatctcgatctctgatagcggcttacctgctggtcctaaatggctacaaaaatgtgtaccatctggaaggagggctttacacatggttcaaggaaggcctaccagctgttgaaggagaagaataagcaagagagacctatttcttgttacgacattgttgttcacatgctggagttgtgagttgtaatcatgcgcttcacaggatctcagatcgtttctccccattgagatgtctcatatcgccttggttgcccaacgtgtcggtgtatgttgcttgggcatgacagtatgatgactattagctttaaccaataaaagtgagcagaagcatagttc

SEQ ID NO: 12859 - protein, 224 aa, Panicum virgatum
  misc_feature: Ceres CLONE 1766271
  misc_feature (80)..(215): Pfam Name: Rhodanese Pfam Description: Rhodanese-like domain
  misc_feature: SWISSPROT Homolog: EC 2.8.1.1 Thiosulfate sulfurtransferase
MLAAISLRNLACSSRLSSCSEFTSGNSWRPIEAAKLHRTCSVSSIHISCAATKPAKTPAEVEWKVKRQLLAEKRVRSVDVKEALRLQKENNFVILDVRPEAEFKEAHPPGAINVQIYRLIKEWTAWDIARRAAFAFFGIFAGTEENPEFIQSVDTKIGKDAKIIVACSTGGTLKPTQNFPDGKQSRSLIAAYLLVLNGYKNVYHLEGGLYTWFKEGLPAVEGEE

SEQ ID NO: 12860 - DNA, 637 bp, Panicum virgatum
  misc_feature: Ceres CLONE 1766273
  misc_feature: Encodes the peptide sequence at SEQ ID NO. 12861
  misc_feature (57)..(57): n is a, c, t, g, unknown, or other
  misc_feature (82)..(82): n is a, c, t, g, unknown, or other
acaggagcccgcggagcgatcaaccttcaaggaccccgagaagatgaccgacgtcgngacgaccaccagcaccaccacgganggggaaagagaaccgaataaacccgacaagctgattgtgctggagttcatggcgccgtggagtgagccatgcaaggtcatgaaggaaccttataggcgaatcgccagagcaagaaaagacagagtcaacttctacacgctcaacgtcgacaagttcaaagatttggcggaggaagctggcgtggaggcgctaccgatgtacgttctactgaagaatgacgatgtgatcgacatggttttttttttcaggaggcacgagctcgagaacgccataaaaaacaatatctaacgactgatccgatcagatcatccatgcgtcgagaacgaacgggaaatgaatgattcatagttaaataagcccactactgtacgtcccatgtgttgtatcacggatactgaaactcgtgtgtgcatgtacacatcctagctagctcagccgccgtagatccccatgttatacattgtacgtatggatctcgattatcgattgtcccatgtttgatttcctaaacttctgtggaagtagatccccatgttatgtatactctggtttgaa

SEQ ID NO: 12861 - protein, 108 aa, Panicum virgatum
  misc_feature: Ceres CLONE 1766273
  misc_feature (3)..(107): Pfam Name: Thioredoxin Pfam Description: Thioredoxin
  misc_feature: SWISSPROT Homolog: EC 1.8.1.8 Protein-disulfide reductase
  misc_feature (5)..(5): Xaa is any aa, unknown, or other
  misc_feature (13)..(13): Xaa is any aa, unknown, or other
MTDVXTTTSTTTXGEREPNKPDKLIVLEFMAPWSEPCKVMKEPYRRIARARKDRVNFYTLNVDKFKDLAEEAGVEALPMYVLLKNDDVIDMVFFFRRHELENAIKNNI

SEQ ID NO: 12862 - DNA, 784 bp, Panicum virgatum
  misc_feature: Ceres CLONE 1766291
  misc_feature: Encodes the peptide sequence at SEQ ID NO. 12863
gagtcgaggcctcaagttcacatctcctccctcagtccctctgtttctcctttctctcggactctcccttgcagccttgctcttccttgcctggcggcgacgactgggcgagcggcggagccatttgtcacgtctttgccaagccctttgccggcgacgagcatcctccagatatggatatggatgcatcaggcctaccagcattcgccaatggagagatgctgaagacgttggttgggcgaagagtgcgcacagtggttcaagtcctgcgccgtgaaggtggactccttgttgggcagtcaactgacgggcatcagttgactattaggggtgccatggatgtccctgtatcacactttatggaggttttcggaactgctgaaactggccagtctatcagcgctgacgtttgcacagatttcggcgacaactttgatgctgaatcattcaatggactgtgcaagtctgcgaacatggtcaaggagctgttcctgtagagttcagtatctgacatgagacattttggccatccaagcggaagttgatgtcttaaatttgaagatttggctaaatgtttcttcataacctcagtgatctgttgctgtcagtattgggtagatctgttgctgtcagtattgggtatctcttatgacctattaatctaagctatgtaacaaggaagacaagtaactcatggtctcatgtagttgatgagattactgtgtttgtttcctccaacctaaacgagcagaagctttatattactgtcacttgcatttctacc

SEQ ID NO: 12863 - protein, 105 aa, Panicum virgatum
  misc_feature: Ceres CLONE 1766291
  misc_feature (1)..(104): Pfam Name: Rep_fac-A_3 Pfam Description: Replication factor A protein 3
MDASGLPAFANGEMLKTLVGRRVRTVVQVLRREGGLLVGQSTDGHQLTIRGAMDVPVSHFMEVFGTAETGQSISADVCTDFGDNFDAESFNGLCKSANMVKELFL

SEQ ID NO: 12864 - DNA, 832 bp, Panicum virgatum
  misc_feature: Ceres CLONE 1766299
  misc_feature: Encodes the peptide sequence at SEQ ID NO. 12865
atcgcaaaaaccactcgagcacaaccggaagaggcactccagagctaagcgttcgatcgacagccgatccagaacaagatgtgtcagatgaagatggagatgggcgccgagccgtcgggctcgccctcgacctcggagcaggagcaccaccggacggtgtggacgtcgccgccgaagcggccggcggggcggaccaagttccgagagacgcggcaccccgtgttccgcggcgtgcggcgccggggcaacgccgggcggtgggtgtgcgaggtgcgcgtgccgggccgccgcggctgcaggctctggctcggcaccttcgacgccgccgaggccgcggcgcgcgcgcacgacgccgccatgctcgccgtctcgggcccgggtgcgtgcctcaactttgcggactcggcgtggttgctcgcggtcccggcctcgtacgccagcctcgccgaggtgcgccgcgcggtcgccaaggccgtggaggagttccagcaccgggaggcgctcccggaggaggaggaggacgcgcgctcggccacgtcgtcgacgctgtcctcccccgccagcggcgaagacgaggcctccaccgacgaggacggggaggagtcctcgccggccgccgaggactcgccgttcgaactggacctgttcggtggcttgagctcggacttgtactacgcgagcttggcgcaggcgatgctcatggagccaccgtccacagtcgcggcgttctgcgacgagggcatggccgatgtgcctctctggagctattaggatcgaggccgccgctgggcttcaattttccgccttttctttctcttggactatccgaagc

SEQ ID NO: 12865 - protein, 230 aa, Panicum virgatum
  misc_feature: Ceres CLONE 1766299
  misc_feature (47)..(100): Pfam Name: AP2 Pfam Description: AP2 domain
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 2 in US patent 7138277
  misc_feature: The sequence is a functional homolog of SEQ ID NO 1248 in the 10/374,780 US patent application
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 1221 in the 10/374,780 US patent application
  misc_feature: The sequence is a functional homolog of SEQ ID NO 1410 in the 10/412,699 US patent application
  misc_feature: The sequence is a functional homolog of SEQ ID NO 720 in the 11/435,388 US patent application
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 752 in the 11/435,388 US patent application
MCQMKMEMGAEPSGSPSTSEQEHHRTVWTSPPKRPAGRTKFRETRHPVFRGVRRRGNAGRWVCEVRVPGRRGCRLWLGTFDAAEAAARAHDAAMLAVSGPGACLNFADSAWLLAVPASYASLAEVRRAVAKAVEEFQHREALPEEEEDARSATSSTLSSPASGEDEASTDEDGEESSPAAEDSPFELDLFGGLSSDLYYASLAQAMLMEPPSTVAAFCDEGMADVPLWSY

SEQ ID NO: 12866 - DNA, 743 bp, Panicum virgatum
  misc_feature: Ceres CLONE 1766300
  misc_feature: Encodes the peptide sequence at SEQ ID NO. 12867
acgcgcggctccgcaggagagcgaactttgcgaccctctccatggtctccgtccccatcgcaccctcctccctttccctctccacccggggccgcagctcctccgcttccttccccgctcccaagaaaggagggattggtcacggcggcctgcggattgagtgcatccgtattggtggtgttgagattccaaacaacaagagggtggagtactcgctgcagtacatccatggcattgggcggtcacgctcccatcagatccttttggacctcaatttcgacaacaagatcaccaaggacctctctgaggaggaggtcatcattttttggaaggaggttggcaagtacatgattgagggagaccttaaacggttcaaccgtgtggcgattgagaggttgaaggagattcggtgctacaggggcatacgacacaagctgggactcccagttcgtggccagaggacaaagaacaactgccggacactaaagggaaagagggcttcagttgccaagaagaagtcacctgcctcgcaggaggaataagacatattaccatgtatttaagttctgcctggtttttttgtgcaacatcacaactgttgggtgttccatttcgagctctgatgctgtcatagacgaatcatggggttatgatcgggtgctgggtgctgcaaattccatagctgtgaaatagcttatatgaatcgatgctaaatgaaggttacttcttgttttgttgcatcc

SEQ ID NO: 12867 - protein, 179 aa, Panicum virgatum
  misc_feature: Ceres CLONE 1766300
  misc_feature (56)..(160): Pfam Name: Ribosomal_S13 Pfam Description: Ribosomal protein S13/S18
ARLRRRANFATLSMVSVPIAPSSLSLSTRGRSSSASFPAPKKGGIGHGGLRIECIRIGGVEIPNNKRVEYSLQYIHGIGRSRSHQILLDLNFDNKITKDLSEEEVIIFWKEVGKYMIEGDLKRFNRVAIERLKEIRCYRGIRHKLGLPVRGQRTKNNCRTLKGKRASVAKKKSPASQEE

SEQ ID NO: 12868 - DNA, 559 bp, Panicum virgatum
  misc_feature: Ceres CLONE 1766333
  misc_feature: Encodes the peptide sequence at SEQ ID NO. 12869
ccgaaaaggcggaccagcgcaagcccggcacggccggacacacgcgcgccgccaaggagcccagcaccaagaccgaccaccagaagggccgccccggcgcggccgccgccggccccgcggcgcggcccgccaggagcgccgagcgccccagcggcgacgagaccggaggcagcccccccaccgcccgcaacgagcaggccgacccgacgaagcccgaaattttttttattatccgcaatgcaaagattgatatgttcaaaggttcaatgaggcttgctgtggacaaatggggccgcatcgaagtcactgaacctgcaagcttcagtgtgaaggaggacaacaatctctcacttgtggagtatgagcttgtcaacgttactgaagagtgaaggccttgttgatctcattcgataaccagaatttcagttggtaaaaaaattctacttgtcgcaccaagaatgagaacttgaggagatggagaagcttatgaagtagattggagctgttgggtcgaactagtgcaagttcctcgttatcatgcatttatgtctatcaatgg

SEQ ID NO: 12869 - protein, 128 aa, Panicum virgatum
  misc_feature: Ceres CLONE 1766333
  misc_feature: Useful for making plants with modulated drought sensitivity
  misc_feature: Useful for making plants with modulated water use efficiency
EKADQRKPGTAGHTRAAKEPSTKTDHQKGRPGAAAAGPAARPARSAERPSGDETGGSPPTARNEQADPTKPEIFFIIRNAKIDMFKGSMRLAVDKWGRIEVTEPASFSVKEDNNLSLVEYELVNVTEE

SEQ ID NO: 12870 - DNA, 710 bp, Panicum virgatum
  misc_feature: Ceres CLONE 1766348
  misc_feature: Encodes the peptide sequence at SEQ ID NO. 12871
ggctagggttcccgccgcatcgcaccgagggacggaggcgattgatggcacgacgcgggcgcgtggagctgcggcggatcgaggacaaggcgagccggcaggtgcgcttctccaagcgccgctcggggctgttcaaaaaggcgttcgagctcgccctcctctgcgacgccgaggtcgcgctgctcgtcttctcccccgccggcaagctctacgagtactcctccaccagcatagaagatacatatgagcgttaccagcgatttgcgggggcaggaagaaatgcgaatgaaggagaccaaaataacaacgataaccaggatgctgctgcttcagatttacagtccaagcttaggcagatctcaacatggtcagaacgaaacaatgctgacaagtcagatcccaatgaactagagaaactggagaaactcctgacaaatgctttgagggataccaaaaccaaaaaggtacacttgagtggctttgttttcttccattgtttcagttgatttagataagggtcactctagttcagtgtgttccaaaatgacatgactcagctgttattttggctttgtgctttttatttcgagctggacactataactgggtctgtattcagcatacaatttatttttatatcctgctgatattgctgtgtaatagatttgtcaatttgccacttggaataatgccatagaaatattgcaccc

SEQ ID NO: 12871 - protein, 153 aa, Panicum virgatum
  misc_feature: Ceres CLONE 1766348
  misc_feature (10)..(60): Pfam Name: SRF-TF Pfam Description: SRF-type transcription factor (DNA-binding and dimerisation domain)
  misc_feature: Useful for making plants with modulated biomass
  misc_feature: The sequence is a functional homolog of SEQ ID NO 1701 in the 10/412,699 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
MARRGRVELRRIEDKASRQVRFSKRRSGLFKKAFELALLCDAEVALLVFSPAGKLYEYSSTSIEDTYERYQRFAGAGRNANEGDQNNNDNQDAAASDLQSKLRQISTWSERNNADKSDPNELEKLEKLLTNALRDTKTKKVHLSGFVFFHCFS

SEQ ID NO: 12872 - DNA, 631 bp, Panicum virgatum
  misc_feature: Ceres CLONE 1766353
  misc_feature: Encodes the peptide sequence at SEQ ID NO. 12873
gccagcgccgccgcggccgccggcgcgccgcacgccgccgcggcgaccaccaccgaggccgccgcgacccgcgggcaggggagcgcggccagcggcccccgcaccgcccacgcccgcggcaccggccccggccccaccgcagccagcagcagcggcgagaggagccacaacccggcggccaggagcaccgccgacaggctttttgcatgcaactgcctcaagtccgccgccggcagggtgagtggcctcaaacttggaaacgccgcaagcatcccctccaagtgcggagtcagcatcccctacaccataagcccaaacgtcgactgctccagggtgagctaaacgacgaccagtaccgtcgctacctatctacttaattatcgtctatgatcgagttcgatgatgatgaataaaaatctctccggcgtcgcgtgcactgtcgtcatgcgctagctcagctcgcgtggtacgtcgtcgctcagcatgtgataagcgatcgagagacggagtcctctccgatccttgtgtccttttgcatgcttcgtacattttgtgtctgcatctgcatagtagtgtgtcctccatttccgtttggaggagacccactctgtaccttgtccactataccttt

SEQ ID NO: 12873 - protein, 113 aa, Panicum virgatum
  misc_feature: Ceres CLONE 1766353
  misc_feature (23)..(109): Pfam Name: Tryp_alpha_amyl Pfam Description: Protease inhibitor/seed storage/LTP family
ASAAAAAGAPHAAAATTTEAAATRGQGSAASGPRTAHARGTGPGPTAASSSGERSHNPAARSTADRLFACNCLKSAAGRVSGLKLGNAASIPSKCGVSIPYTISPNVDCSRVS

SEQ ID NO: 12874 - DNA, 783 bp, Panicum virgatum
  misc_feature: Ceres CLONE 1766386
  misc_feature: Encodes the peptide sequence at SEQ ID NO. 12875
aaaaaaaaaaaaaaaccccaccgtccttgctcacgaaggctactagaagagccctccctcctctccggcgccttctcctcggatccccaaccgactccgccgaccagccaggatcgatggaggcgaagatggggcgcttcttcgagtccgtgggcagcttcttcaccggcggcgacaacatcccctggtgcgaccgcgacatcatcgccggatgtgaaagagagcttgccgatgctgcaactgaagagcagaggaatgatagccttatgaggctttcttgggcccttgtgcactccaggcagatggacgatgtaaatcgtggaattagcatgcttgaagcttctttggataattctggcagccctctggagactagggaaaagctgtacttgttggctgttgggcattacaggaatggtgactactcaaaaagccggcaacttgcggaacgctgtttgcagattcaacctgattggaggcaggctatttctctgaagaaagcaatagaagataaaattgccaaagatggtcttattggaataggaattgcgacaactgctgtgggacttctggttggtggaattgcagctgctgttgccagaaagaagtaagatgaatagatggtgtctctgctcaccaatgaacaaggagacgctttcagctgttctggcctgggtgttaaactggtgatacttgagtcgaattgaaatggattttatgtgtacaaagtgagtagatgataatactatcgaggcaatgtatcctctgttcagttttttgccc

SEQ ID NO: 12875 - protein, 164 aa, Panicum virgatum
  misc_feature: Ceres CLONE 1766386
  misc_feature (87)..(120): Pfam Name: TPR_2 Pfam Description: Tetratricopeptide repeat
MEAKMGRFFESVGSFFTGGDNIPWCDRDIIAGCERELADAATEEQRNDSLMRLSWALVHSRQMDDVNRGISMLEASLDNSGSPLETREKLYLLAVGHYRNGDYSKSRQLAERCLQIQPDWRQAISLKKAIEDKIAKDGLIGIGIATTAVGLLVGGIAAAVARKK

SEQ ID NO: 12876 - DNA, 734 bp, Panicum virgatum
  misc_feature: Ceres CLONE 1766387
  misc_feature: Encodes the peptide sequence at SEQ ID NO. 12877
aggacggagtaaaccctagccgcagagggcgcctcaccacaaaagcggaccttccccacgccgccgccactcgccgcagcttcacgcccggatagggagcaccaccgcaggagcccgagccctcccttccgcagccgccaaaatggtgaatgttcctaagaccaagaagacctactgcaagaacaaggagtgcaggaagcacactctccacaaggtgactcagtacaagaagggtaaggatagcctttctgcccagggaaagcgtcgttatgaccgcaagcagtcaggatatggtggtcagaccaagcccgtcttccacaagaaggccaagaccaccaagaagattgtgctgaagctgcagtgccagagctgcaagcactactcccagcacccgatcaagaggtgcaagcactttgagattggtggagacaagaaggggaagggaacatctcttttctagattgctcgccgcctgtctggattctgaagttgtggtgtctaccactttttttagagctgtcgtcaaatctcagtgttactagtgttcttaaagcggaccatgcttatgtatccaaattccaatgcctgacatttgctccgagtgttggttgacttttggctaaatgatgttttgtagcttaatctgttttctgtcttcgattttggcagccttcatgtgaagttgcctgaatctgtgcagatgtatgtctcgtctcaacagcttcagcttgcat

SEQ ID NO: 12877 - protein, 105 aa, Panicum virgatum
  misc_feature: Ceres CLONE 1766387
  misc_feature (19)..(95): Pfam Name: Ribosomal_L44 Pfam Description: Ribosomal protein L44
MVNVPKTKKTYCKNKECRKHTLHKVTQYKKGKDSLSAQGKRRYDRKQSGYGGQTKPVFHKKAKTTKKIVLKLQCQSCKHYSQHPIKRCKHFEIGGDKKGKGTSLF

SEQ ID NO: 12878 - DNA, 977 bp, Panicum virgatum
  misc_feature: Ceres CLONE 1766392
  misc_feature: Encodes the peptide sequence at SEQ ID NO. 12879
aatccaagacgctccccccgactttctccacaagtccatctcgaactctctagacccctcctcctcggtcctccctcggcttcgtcgccgcccccctcttgggcaccgcagaaatggctttgccgaatcagcaggtcgtggattaccccagcttcaagctcgtcatcgtcggcgacggtggaactggtaaaaccacatttgtcaaaagacatctaactggcgagtttgagaaaaaatatgaacccaccattggtgttgaagttcaccctctggattttagcaccaactgtggcaaaatccgcttctattgctgggacaccgcggggcaagaaaagtttggtggtctcagagatggctactatatccatggtcagtgtgccatcatcatgtttgatgtcacttcaaggttgacatacaagaatgtaccaacatggcacagggacttgtgcagggtttgtgagaacattcccatcgtcctctgtggtaacaaggttgatgtgaagaacaggcaggtcaaagccaagcaagttacattccacaggaagaagaacttgcagtactatgagatttctgccaagagcaattacaactttgagaagcccttcctttaccttgcaaggaagctggcaggggaccagaaccttcactttgtcgaggctgttgctctgaaaccaccggaagtgcagattgatatggccatgcagcaacagcatgaagctgagcttgtggctgctgcggcacaacccctgcctgatgacgatgacgacttgatcgagtagagaatatcatggcctttgttgatgtgtgtgagaggaaggacttttctataaaaggccgtagtggctcatccttaggaacctggatgctttcttgttatgtatctgatgagttgagaacgagtcatggcatttctggattgttggtgactgaaccagctcctttcgagtaatacagtgcttgtcatatgctttcgcttg

SEQ ID NO: 12879 - protein, 221 aa, Panicum virgatum
  misc_feature: Ceres CLONE 1766392
  misc_feature (15)..(173): Pfam Name: Ras Pfam Description: Ras family
  misc_feature (15)..(128): Pfam Name: Miro Pfam Description: Miro-like protein
  misc_feature: SWISSPROT Homolog: EC 2.7.11.1 Non-specific serine/threonine protein kinase
MALPNQQVVDYPSFKLVIVGDGGTGKTTFVKRHLTGEFEKKYEPTIGVEVHPLDFSTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDQNLHFVEAVALKPPEVQIDMAMQQQHEAELVAAAAQPLPDDDDDLIE

SEQ ID NO: 12880 - DNA, 782 bp, Panicum virgatum
  misc_feature: Ceres CLONE 1766410
  misc_feature: Encodes the peptide sequence at SEQ ID NO. 12881
gcttctccgcgcactgcatctccctctctgccgccgccgccgcacgcagccgcatcggccatgggggcgtacaagtacgtgtcggagctatggaggaggaagcagtccgatgtgatgcgcttcgtgcagcgcgtccgctgctgggagtacaggcagcagccggcgatcgtccgcctcaccaggcccacccgcccggacaaggcccgccgcctcggcttcaaggccaagcagggctatgttgtttaccgtgtccgtgtcaggcgtggtggcagaaagaggcccgtgcccaagggtattgtctatggcaagccaaagcaccagggtatcacccaactcaagttccagaggaacaataggtctgttgctgaggagagggctcggcgtaagcttggtggactgaggtttctcaactcctactgggtgaatgaggatagtacctacaaataccttgaggtcatccttgttgatgttgcccacactgccatccgcaacgaccccaggatcaactggctgtgcaaggatgtgcacaagcaccgcgagctccgtggcctcacctcggctggcaagaagtaccgtggcctgcgcggcaagggccacacccaccacaagaacaggccatccaggagagccacctggaagcgcaaccagaccctctccctccgccgctaccgttgagctctgtgcctggatacaggaacccatctcaagcaaaacttcaactgtgtttgattgcatttttcaaattttgctacttgtgttttgagcacttggaactatgttag

SEQ ID NO: 12881 - protein, 204 aa, Panicum virgatum
  misc_feature: Ceres CLONE 1766410
  misc_feature (2)..(193): Pfam Name: Ribosomal_L15e Pfam Description: Ribosomal L15
MGAYKYVSELWRRKQSDVMRFVQRVRCWEYRQQPAIVRLTRPTRPDKARRLGFKAKQGYVVYRVRVRRGGRKRPVPKGIVYGKPKHQGITQLKFQRNNRSVAEERARRKLGGLRFLNSYWVNEDSTYKYLEVILVDVAHTAIRNDPRINWLCKDVHKHRELRGLTSAGKKYRGLRGKGHTHHKNRPSRRATWKRNQTLSLRRYR

SEQ ID NO: 12882 - DNA, 559 bp, Panicum virgatum
  misc_feature: Ceres CLONE 1766417
  misc_feature: Encodes the peptide sequence at SEQ ID NO. 12883
aaagaggctcgcagacgccagggccctatcgtcttcttgcttgccaatccgacgcaccacctaagcacatcggcggcgaagaggaggcggagaagcgatgggcgtcaccaaggaggacgtcgaggcggccatcacctccgctctcagcccttcccatctcgtggtgacggatacatctggagggtgtggcgcgagctatgagatcgaggtggtgtcggagaagttcgaggggaagcggctgctggagcggcaccggttggtgaacacggcgctggcgccgcacatggcggagatccacgccgtctccatcaagaaggcgctctctccggcgcaggcccaaccccagccggagccggccgccgataagccccaggcttaagtgcttaactcgcttcaaacagtttgatcacatatgcaccatgagtcaagctcatctctgttgtagtatgtggtctctgatacattaactactggttgaataatgtagcagacgcaattgcaaaattgcaggatgttatgcttgactgcttagaaatttctgtgctgtgcatttaacttc

SEQ ID NO: 12883 - protein, 93 aa, Panicum virgatum
  misc_feature: Ceres CLONE 1766417
  misc_feature (3)..(80): Pfam Name: BolA Pfam Description: BolA-like protein
MGVTKEDVEAAITSALSPSHLVVTDTSGGCGASYEIEVVSEKFEGKRLLERHRLVNTALAPHMAEIHAVSIKKALSPAQAQPQPEPAADKPQA

SEQ ID NO: 12884 - DNA, 698 bp, Panicum virgatum
  misc_feature: Ceres CLONE 1766419
  misc_feature: Encodes the peptide sequence at SEQ ID NO. 12885
atatagcatgcatcacacattgacacaccctctcgcgcccttcccagcatggcttgctgcaagctctaccattccgtggtgctcgccgtcgccgttgtcgtcctcgccgtcggaccggccgcgcggcccgtttcagccgcgtcggcgcaccttcacttgtacatgcacgacgtgctgacggggccggcgccgacggcggtgcaggtgctgaacggcccccggggccacttcggcgacacggtggtgatcgacgacgtgctcacggagggcgcgtcgcgggcgtcagccgcggtcgggcgcgcgcaggggcactacatctgggcgtcgacggggaacccggagctgctggtgaccatgaacgtggtgctcgatcacgggccctacgccggcagctccgtcaccgtggtggggcgggacgacatcggcgcgccggtgcgggagctgtcggtggtcggcggcaccgggcagttcaggatggcgcgagggtacgtgctgtggaagaccgtcagcctcgaccaccccaacgccgtgctcgagctcgatgtcttcgtcagcgcctgagcaagctgagctgcgcacacgtggtggcaagttccgcacatcgccgtgtacggtgtaccgccaaataagcttctagtactttgtggagtataattgcataaataaacgtacggtaacgaaagtgtttttttttgatc

SEQ ID NO: 12885 - protein, 170 aa, Panicum virgatum
  misc_feature: Ceres CLONE 1766419
  misc_feature (14)..(170): Pfam Name: Dirigent Pfam Description: Dirigent-like protein
MACCKLYHSVVLAVAVVVLAVGPAARPVSAASAHLHLYMHDVLTGPAPTAVQVLNGPRGHFGDTVVIDDVLTEGASRASAAVGRAQGHYIWASTGNPELLVTMNVVLDHGPYAGSSVTVVGRDDIGAPVRELSVVGGTGQFRMARGYVLWKTVSLDHPNAVLELDVFVSA

SEQ ID NO: 12886 - DNA, 667 bp, Panicum virgatum
  misc_feature: Ceres CLONE 1766431
  misc_feature: Encodes the peptide sequence at SEQ ID NO. 12887
acaaacaagtccgcccaccgcacgcaaccacgacagagagagtccacgggtcgccatggcgagcaagcagagcctcctcctcccggccgcctcggtcgccaccgacgtcgactactgcagtaggggcaagaagtacccggtgaaggtgagcggggtgcagatcgtgcccgatccggtgcagcccggcaagccggccaccttcaagatctccgcttccactgataaaatcatccagaaggggaagctggtaattgatgttaagtatttcttcctctacgtgcactcggaaactcgcgacatctgtggagagactacctgtccagcaactggtgacttcgtgctctctcatcagcagacattaccaagcttcactccaccgggttcttacaccatcaccatgaagattgttggggacgacaatgaggaactgagctgcatctcgttcgggttcagcatcgggttcgtcgcctccagctgaacggatgcatcttctatgagcaccagaagtttgccatggatgtaattatgaaccacacactgtatcctacgactcccagtagagttgaggtccatgtacgctttgtgggtgtcgcaaacttactgttcaactaagacgttttttatccagagttgaacaccgcaataaagcaaaaatctggttgtcacg

SEQ ID NO: 12887 - protein, 140 aa, Panicum virgatum
  misc_feature: Ceres CLONE 1766431
  misc_feature (14)..(134): Pfam Name: E1_DerP2_DerF2 Pfam Description: ML domain
MASKQSLLLPAASVATDVDYCSRGKKYPVKVSGVQIVPDPVQPGKPATFKISASTDKIIQKGKLVIDVKYFFLYVHSETRDICGETTCPATGDFVLSHQQTLPSFTPPGSYTITMKIVGDDNEELSCISFGFSIGFVASS

SEQ ID NO: 12888 - DNA, 782 bp, Panicum virgatum
  misc_feature: Ceres CLONE 1766444
  misc_feature: Encodes the peptide sequence at SEQ ID NO. 12889
cttgcccacccctcgccgccgccgcagacgcatccctccgcctcgaggcttccgctcgctggtcgcagccatggtgaagtactcgagggagccgaccaaccccaccaagtccgccaaggccatgggccgggacctccgtgttcacttcaagaacacgcgtgagacagcttttgcactcaggaagttgccactcactaaggccaaaaggtaccttgaggatgtgattgcccacaagcaggccatccccttccgcaggtactgtggcggtgttgggcgtactgctcaggctaagtcgcgccactcaaatggacagggacgctggcccgtcaagtctgctagattcattcttgatcttctaaagaatgctgagagcaatgctgaggtcaaaggtcttgatgtcgataccctgtatgtgtcgcacattcaagtaaaccaggctcagaagcagcggcgcaggacctaccgtgctcatggacgcatcaacccttacatgtcctctccgtgccacatcgagctgatcttgtctgagaaggaagagccagtgaagaaagaggcggagtctcagattgcaaccaggaaggcttaaagaagggagctctacggtgttagagtgggttagagtggattgtaggttgtcgttgcctaagtgaaaattttggctggttatctgtcgcctcctttatcagtgtactgctagctcgttctgtcaccttgatcagtgtctgtactgcctatacaattcgaagctatgaatgaagtgtttgtggattctttctatattt

SEQ ID NO: 12889 - protein, 171 aa, Panicum virgatum
  misc_feature: Ceres CLONE 1766444
  misc_feature (17)..(153): Pfam Name: Ribosomal_L22 Pfam Description: Ribosomal protein L22p/L17e
MVKYSREPTNPTKSAKAMGRDLRVHFKNTRETAFALRKLPLTKAKRYLEDVIAHKQAIPFRRYCGGVGRTAQAKSRHSNGQGRWPVKSARFILDLLKNAESNAEVKGLDVDTLYVSHIQVNQAQKQRRRTYRAHGRINPYMSSPCHIELILSEKEEPVKKEAESQIATRKA

SEQ ID NO: 12890 - DNA, 820 bp, Panicum virgatum
  misc_feature: Ceres CLONE 1766448
  misc_feature: Encodes the peptide sequence at SEQ ID NO. 12891
gatcagcactcgcctcccgtcgccacctcgcgttccccgattcgacgcatatacccattcctctgctccgccgaagccccatctctgaatcctgaccgccgccgcaagcccgcaagcggagccaatggcgctcctcgcgccgagcccccgcgcgctctgcgtacgggaggccgcgtcgccgcacccgcactcgtcagccgcttgctcgaccgtcggcggcgaggcggccgggcgggccctgtgggtgtggaacggcggcgggagggggaggaggagggagcgcggggagagggtcagggcggcggcctacttctgggacgtgtccaagccggtggagatggaggagatcgacagcatgaagaagcttgacgacgcgctcaggtggtccgtcgagaacaaccaggccatcataattgactggatggctagttggtgtcggaaatgcatttacctgaagcctagaattgagaagatagcaggagaatatccaggagtcaggttttactttgttgatgtcaataaagttccacaagcagtggtaaaaagagggaatataactaaaatgcccactattcagttatggaaagatggagaatggaaagcagaggtaataggaggccataaagcttggcttgtgatggatgaggttagagaaatgatccagaagaacaagtaactaaacacccaaggcccaagcagtgcaattgatattgtactgcaaaatgtatatatagagatgtcagctgatctcttcatatgctaagtcagcaatcaaatcaataaatctatatttcagctccttatcacagcagagctggtt

SEQ ID NO: 12891 - protein, 183 aa, Panicum virgatum
  misc_feature: Ceres CLONE 1766448
  misc_feature (77)..(175): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MALLAPSPRALCVREAASPHPHSSAACSTVGGEAAGRALWVWNGGGRGRRRERGERVRAAAYFWDVSKPVEMEEIDSMKKLDDALRWSVENNQAIIIDWMASWCRKCIYLKPRIEKIAGEYPGVRFYFVDVNKVPQAVVKRGNITKMPTIQLWKDGEWKAEVIGGHKAWLVMDEVREMIQKNK

SEQ ID NO: 12892 - DNA, 664 bp, Panicum virgatum
  misc_feature: Ceres CLONE 1766464
  misc_feature: Encodes the peptide sequence at SEQ ID NO. 12893
acggttgcagacccagcgagagacgcgacttgcttttcgcttcatccgtagcgagcttacgagttgctgcccatcactttcttggtcgtctctgatcgatcggcctgagctcccggcagcggaagcggaaggagaggaggaggatgagctcggtgtgcgcgaggcccgtgggctcgggctgctacttcgccggggccaggggccagcggcgggcgcgggtgcgggtggccgccgcggcggcggtggccgcgccggcgtcgaaggcgacgatgtacgaggtgctggcggtggaggagacggcggggcccgaggagatcaaggcggcgtaccggcgcgcggcgcggcggtggcacccggacgcgtgccccggcggcgccgaccgcttcatggcggcgcgggaggcctacgagatgctgtccgacccggagcgcaggcgcggctacgacatccagctccgctgcggcggcttcggcttcggcgacgcgggctgccgcgctgcgcggcgcgcggggttcgccgactgggaggcgcagctggccgggctgcagtggcgcgcggcggagcggcgcggccgggagacgtggggcagcaggatgcgccgggccgccgcgtagcagacccggtaggggtggcgtcgtacagtaggtgcttgttgatatatttt

SEQ ID NO: 12893 - protein, 156 aa, Panicum virgatum
  misc_feature: Ceres CLONE 1766464
  misc_feature (42)..(101): Pfam Name: DnaJ Pfam Description: DnaJ domain
MSSVCARPVGSGCYFAGARGQRRARVRVAAAAAVAAPASKATMYEVLAVEETAGPEEIKAAYRRAARRWHPDACPGGADRFMAAREAYEMLSDPERRRGYDIQLRCGGFGFGDAGCRAARRAGFADWEAQLAGLQWRAAERRGRETWGSRMRRAAA

SEQ ID NO: 12894 - DNA, 492 bp, Panicum virgatum
  misc_feature: Ceres CLONE 1766470
  misc_feature: Encodes the peptide sequence at SEQ ID NO. 12895
aagatccaagaactcgcgccccggcacggacagggcaggagatagagagtgagagtgaccgacagtctctggcgccatgaacgtggaggaggaggtcgggaagctcaaggaggagatccagaggctcggccagcagcagcccgatggctcctacaaggtcaagttcggtgtactattcaatgatgatcgctgtgcaaacatttttgaagcactagtcggcaccttgagggcctccaagaagaggaaaattttgacatatgatgacgagctgcttctgcagggtgttcatgacaatgtggagataaccctattgccgcctcctgcagttgctgccgcttgaggcgcacagatccaccagtccccctattctgtaccgttgatatgctagcactttgttgtgcctatatgtttcatgaactattttgtattcccagaagactgctattgtatgatgtactacgaagttgtgatgctaaaaaaattggcttgctt

SEQ ID NO: 12895 - protein, 87 aa, Panicum virgatum
  misc_feature: Ceres CLONE 1766470
  misc_feature: Useful for making plants with modulated nitrogen use efficiency
MNVEEEVGKLKEEIQRLGQQQPDGSYKVKFGVLFNDDRCANIFEALVGTLRASKKRKILTYDDELLLQGVHDNVEITLLPPPAVAAA

SEQ ID NO: 12896 - DNA, 943 bp, Panicum virgatum
  misc_feature: Ceres CLONE 1766484
  misc_feature: Encodes the peptide sequence at SEQ ID NO. 12897
agagacgacgaagcagtgggatctggtggggatcgatctctcctccgcgcccgcacccgcggcaccccgaaattttattggggtttggaggggaaggatccatagagtccgttcgcgggggcaccatgagctcggcgcaagatccattctacatcgtccgggaggagatccaggactcgattgataaactgcaaagtgccttccaccgctgggagcaaactgcttcctacacaggagaatatgttcatctgacaaaggagcttcttaccagctgtgaaagcatagagtggcaggtagatgagctggaaaagacaatcacagttgcatcacgggatccagcatactatggacttgatgaagtcgagctttctagacgaagaaactggactggttctgcccgtaatcaggttggtacagtcaggagagctgttgaaaaggggaagagcaattcagcaacttcaaaataccaggacacaagcaggattaacctctattctgcccaagacaatgatgacttcatttcttcagaatcagatagacagcagctactcatgaggcagcaggatgaagaacttgatgagctcagtgcaagtgtccaaaggattggtggtgtagggctaaccatacatgaagagctgtctgggcaggaaaggatcttaaacgacctaagcttggagatggagactacttccaaccgacttgatttcgtgcagaaaagagtggccatggtgatgaagaaggctggcatcaaggggcagattatgttgattgcgttcctggtcgttctatttattattctctttgttttggtgttcttgacatagccacaacggcaccagaggcatcatcagtttctcccatttgtgatatctgctttatgtaatgtgtggtgaaaccttagtatacgagctacccatcctttataaatcaggatttttcttgc

SEQ ID NO: 12897 - protein, 232 aa, Panicum virgatum
  misc_feature: Ceres CLONE 1766484
  misc_feature (6)..(99): Pfam Name: Syntaxin-6_N Pfam Description: Syntaxin 6, N-terminal
  misc_feature (145)..(207): Pfam Name: SNARE Pfam Description: SNARE domain
MSSAQDPFYIVREEIQDSIDKLQSAFHRWEQTASYTGEYVHLTKELLTSCESIEWQVDELEKTITVASRDPAYYGLDEVELSRRRNWTGSARNQVGTVRRAVEKGKSNSATSKYQDTSRINLYSAQDNDDFISSESDRQQLLMRQQDEELDELSASVQRIGGVGLTIHEELSGQERILNDLSLEMETTSNRLDFVQKRVAMVMKKAGIKGQIMLIAFLVVLFIILFVLVFLT

SEQ ID NO: 12898 - DNA, 819 bp, Panicum virgatum
  misc_feature: Ceres CLONE 1766543
  misc_feature: Encodes the peptide sequence at SEQ ID NO. 12899
gacagttcacacacgagacaatcacagctccactagtccactactaccagacgcttcctcgccggccgcgccgctcccaagcccgcacgcttctcttccccctctcctccgatggcgacgctgcagctcaaccacatcgcgcgggagacctccgacgtggcccgcctcgcggccttctacgaggccgtgctggggttcgagcgcgtgccgtccccgacctactcgggcttccaggtcgcctggctccgcctcccgggctcccccgacgtcgcgctccacctcatcgagcgggacccagccgcggcccccgtcgcggtggggcccggcgccgagggcgcgccgccggcgcagctgccccggcgccaccacctggccttctccgtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccg

SEQ ID NO: 12899 - protein, 115 aa, Panicum virgatum
  misc_feature: Ceres CLONE 1766543
  misc_feature: SWISSPROT Homolog: EC 5.1.99.1 Methylmalonyl-CoA epimerase
MATLQLNHIARETSDVARLAAFYEAVLGFERVPSPTYSGFQVAWLRLPGSPDVALHLIERDPAAAPVAVGPGAEGAPPAQLPRRHHLAFSVAAYTILRMTWLSTHQSQKSILRMA

SEQ ID NO: 12900 - DNA, 890 bp, Panicum virgatum
  misc_feature: Ceres CLONE 1766546
  misc_feature: Encodes the peptide sequence at SEQ ID NO. 12901
agctagctctgctccattcccattccattcaaattccgcacactcacccccgctctcctgctcggtggtcgccgtgacaactgcacccatggccgctgccaaccagctgactgctctcctcaccaacatgtatgccacgggtttgctggatgagcaattccagcagctacagatgctccaggacgccagctcccctgacttcatctccgaggtcgtcaccctcttctgccaggacggcgagaggatcatcggcgagctcgccaagctgctggagaagcccaacgtggattttgatagggtcgacgcatttatgcatcagctcaaggggagcagtgcaagtgttggtgcccagaaagtcaaaaacacctgcatccagcttcgagagttctgtcggtcaaagagcagggatggatgcctcaaaacactggactcagtaaggactgagttttattatctccgtggcaagttccagactatgcttcagcttcagaggcaactccatggcttctaccccaagtaaaccagagttggggagtggagctgcatgtcgggatgatgcttacacctctcaagtttcaagaacatgccgattgcgctcctcagttggcttctgtgaagcctgtaataacatagctgcgagattagcgctgacaccttcgccgtcatcatcctagtatcatccgtgtcgggtgatccatgttcgtgcaaccagtcgcaggtggtatggtcactcctagtagtaatcaccatttcgtattatctcttaggtactcaatccgcatagcggttcgagctaaaacggtgtcaagctagtccatcgcctgtgccctggtggtgttatttggtgaagcagaacaatgctctggttaatgttgatgaatcttttgctc

SEQ ID NO: 12901 - protein, 143 aa, Panicum virgatum
  misc_feature: Ceres CLONE 1766546
  misc_feature (41)..(126): Pfam Name: Hpt Pfam Description: Hpt domain
MAAANQLTALLTNMYATGLLDEQFQQLQMLQDASSPDFISEVVTLFCQDGERIIGELAKLLEKPNVDFDRVDAFMHQLKGSSASVGAQKVKNTCIQLREFCRSKSRDGCLKTLDSVRTEFYYLRGKFQTMLQLQRQLHGFYPK

SEQ ID NO: 12902 - DNA, 657 bp, Panicum virgatum
  misc_feature: Ceres CLONE 1766562
  misc_feature: Encodes the peptide sequence at SEQ ID NO. 12903
atctccactctccctgccccaaagcattgcagagcagagcagagctgagctgaaacaagaccatgtcgtcgtccaaggtcttcaccctcgaggaggtcgctaagcacaacacccaggacgactgctggctcatcatcgctggcaaggtgtacaatgtgaccaaatttcttgaggatcaccctggaggtgatgatgttctgttgtcctccactgccaaggatgctactgatgactttgaagatgtgggccacagcaccactgctcgtgcgatgatggacgagtacttagtcggtgaaattgatgcaactacaatacccactaaggtgaagtacacgcccccgaagcagccgcactacaaccaggataagacccctgagttcatcatcaagattctccagtttttggtccccttggcgatattgggcttggctgtcgccgtaaggatctacaccaagtcggaatccacctaattattgtcatcacttggccaaagattacaactgaataagttagtgaggattgtacgagcgagcatggcctgtcatgaatttggaaactttagtctctgtgatggtatgattacgtgcaacatctattggtaaattgagactcgagtgaagtggatggatattcagttttatttttccttattccttg

SEQ ID NO: 12903 - protein, 135 aa, Panicum virgatum
  misc_feature: Ceres CLONE 1766562
  misc_feature: SWISSPROT Homolog: EC 1.7.1.1 Nitrate reductase (NADH)
MSSSKVFTLEEVAKHNTQDDCWLIIAGKVYNVTKFLEDHPGGDDVLLSSTAKDATDDFEDVGHSTTARAMMDEYLVGEIDATTIPTKVKYTPPKQPHYNQDKTPEFIIKILQFLVPLAILGLAVAVRIYTKSEST

SEQ ID NO: 12904 - DNA, 778 bp, Panicum virgatum
  misc_feature: Ceres CLONE 1766586
  misc_feature: Encodes the peptide sequence at SEQ ID NO. 12905
ataatctggggcatcctgtgaactgtatatcattatcaaatgacaacaattgccttttagctaactgtttagattctactgtgaggcttctagacaagtcatcaggagaactgttgcaggagtacaaggggcatgcgtgcaagtccttcaagatggattgctgcctgacgaatgatgatgcatttgttgttggtggatctgaggatggctatgttttcttctgggagttagtggatgcacctgttgttgcaagattcagggcacatagttctgtggtaaccagcatcagttaccacccaacaaagtcgtgcatgttgacatcttctgtggatggttctatacgtgtttggacctaacaccagttgttgacgtgtcacatatattgttcctccaaatcatccaattatctagcggcgacgataaaaaaggtggatgcatgttctaacctattgggagtcctgtacaccatgttgctgtgccagtgtgccgctaagagaatgcccaactgttgaacctatttgtgaagcacaaaatgttcgaaggcggtatactgacatgtacacgcttggatggtggaagaaacaagttgtgagtttcatggactagataacactctatttctgagaagtcttgctgcaagtgtcatattgccttcatttttaagtacgtctgcttcccacttgttaggcaggtgtatggtggttgtacttggactggggcataaaacaaggtacgcctagctattaagtggaggaagaaaaatatctgcaaatcacat

SEQ ID NO: 12905 - protein, 117 aa, Panicum virgatum
  misc_feature: Ceres CLONE 1766586
  misc_feature (79)..(117): Pfam Name: WD40 Pfam Description: WD domain, G-beta repeat
NLGHPVNCISLSNDNNCLLANCLDSTVRLLDKSSGELLQEYKGHACKSFKMDCCLTNDDAFVVGGSEDGYVFFWELVDAPVVARFRAHSSVVTSISYHPTKSCMLTSSVDGSIRVWT

SEQ ID NO: 12906 - DNA, 802 bp, Panicum virgatum
  misc_feature: Ceres CLONE 1766589
  misc_feature: Encodes the peptide sequence at SEQ ID NO. 12907
aaccaagaagcacgcgcagccacaccaagtcagggagaaggccatggccggcgtgaactcaaccagcgtcgtcgggctcaagcccgccgcggcagtgccgcaggccgccacctcctcgccggcggcgaagcgggtccaggtcgcgcccaaggaccgggcggccgagggccggcgcgcggcgctcctcggcctggcggccgtcttcgccgtcacggccaccaccgggtcggccaaggccgggatcatcgacgagtacctcgagaagagcaaggccaacaaggagctgaacgacaagaagaggctggctaccagcggcgccaacttctcccgcgcctacaccgtcgagttcggcagctgccagttcccctacaacttcaccggctgccaggacctcgccaagcagaagaaagttcccttcatcactgacgacctcgagatcgagtgcgaggggaaggagaagtacaagtgcggctccaacgtcttctggaagtggtgaagcgcacgcttgattggcttggaactggagggggcgctggcggtgtaacgtgtgtacctagatgcccaaactgcaggaaaaatttggatgtgtaatttaccgtcactgtatctgtgccatctcatcatcgtctgaacatgaacctcttgtattggggagtgtgaaattgtagttggttgactactctgagttcttccgcgcacaacgagggtgacaagacgaaggaggctttagtctagtatgaaattacaattctagcctctgcaatgagccaatacaagagaaatagaaaaaacaagtcactac

SEQ ID NO: 12907 - protein, 150 aa, Panicum virgatum
  misc_feature: Ceres CLONE 1766589
  misc_feature (9)..(150): Pfam Name: PsaN Pfam Description: Photosystem I reaction centre subunit N (PSAN or PSI-N)
MAGVNSTSVVGLKPAAAVPQAATSSPAAKRVQVAPKDRAAEGRRAALLGLAAVFAVTATTGSAKAGIIDEYLEKSKANKELNDKKRLATSGANFSRAYTVEFGSCQFPYNFTGCQDLAKQKKVPFITDDLEIECEGKEKYKCGSNVFWKW

SEQ ID NO: 12908 - DNA, 533 bp, Panicum virgatum
  misc_feature: Ceres CLONE 1766602
  misc_feature: Encodes the peptide sequence at SEQ ID NO. 12909
ggccgtctccaactctgggccacgttttctgcggcagcagattagcgccgcagcttcctttcctccggcgatggcgacgccggctgcaaaagatgctgctgctcccgcggaggaggaggagggtcccgtcgcggccgggccggcggcgcctgcggcgagggtgaaggtgctcttcttcgcccgcgcgcgggacctgacgggcgtggcggagtcgtcggtggaggtgccggcaggggccaccgcgggggagtgcgtcgtccgggtgctggccgagttccccaagctggaggagatacgcggctccatggtgctcgcgctcatcgaggagtacgcgccggactccgccaaggtcaccgacggcgacgagctcgccgtcataccgcccatcagcggcggctgatgttaccacgagcgagttggatagggaaaaagaagaaaaaacaaagaaaaaaaaaggttcagtttgcttcggttcttgccttgtttctccatacaatgtgcatactggataagcaatctcctgttcttggctc

SEQ ID NO: 12909 - protein, 109 aa, Panicum virgatum
  misc_feature: Ceres CLONE 1766602
  misc_feature (33)..(109): Pfam Name: ThiS Pfam Description: ThiS family
MATPAAKDAAAPAEEEEGPVAAGPAAPAARVKVLFFARARDLTGVAESSVEVPAGATAGECVVRVLAEFPKLEEIRGSMVLALIEEYAPDSAKVTDGDELAVIPPISGG

SEQ ID NO: 12910 - DNA, 773 bp, Panicum virgatum
  misc_feature: Ceres CLONE 1766603
  misc_feature: Encodes the peptide sequence at SEQ ID NO. 12911
aggaggataaggcgggtcgcttcttcacgctatagcagaggaaccaagccaaagcacagaagggagggaaaaagaggagagccacgatgatgcccgccgccgccgccgccgccaccagcactggcgggttccgcctcgtgctccccgcggcgcacaggcggccgcctccgcttcctagtcttgcaatcagctccgctagaggacaaggaggaggaaagctacgagcggccgcagaagcgtcatcaggagacgtcgccggcggcggcggcggcgcgccgctggggcggcccctggaggacgtgtacaaggtgcgcgtcgagcgcggcgcggcggcgcgggcgcgcgcggaggcgctgcgcgtgatggagacatggtcgtcgtggcgcacgggcgggcggtgccggatgccgtgggactggcaggtggaccagctcgtgtacatcatgtccggcgaggtcaaggtcatccccgccggcgccgtccacggcgacgactacatgcacttcgtcgccggggacctcgtcaggtacccgcgctggttcgaggccgacctctacttcgacggcccctacgaggagcgctaccgcttcctcgcctacggagacgacaactaggcccctagtcttcaacatgctcattgtcagcagcttatcctgtactcttatcatttcttgtttcagctttactagtttttaggcttattgttaggtaccctacccgttggagaaacatacgcagttaactgatcctatgcattagtatttgtgtgacag

SEQ ID NO: 12911 - protein, 175 aa, Panicum virgatum
  misc_feature: Ceres CLONE 1766603
  misc_feature (88)..(166): Pfam Name: Cupin_3 Pfam Description: Protein of unknown function (DUF861)
MMPAAAAAATSTGGFRLVLPAAHRRPPPLPSLAISSARGQGGGKLRAAAEASSGDVAGGGGGAPLGRPLEDVYKVRVERGAAARARAEALRVMETWSSWRTGGRCRMPWDWQVDQLVYIMSGEVKVIPAGAVHGDDYMHFVAGDLVRYPRWFEADLYFDGPYEERYRFLAYGDDN

SEQ ID NO: 12912 - DNA, 697 bp, Panicum virgatum
  misc_feature: Ceres CLONE 1766627
  misc_feature: Encodes the peptide sequence at SEQ ID NO. 12913
tgctctctcagaggtgggttggcttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcctacggcggcggcggcggcggctacggaggcggtggtggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttaatccgagttacccctgagttttgtccgtgtgttaccgttcgattaggtgttggttcccatgtttaccgttcccgagttgtttccgcaatgaaatgagaagaaaagagtgtccgcaattaaacg

SEQ ID NO: 12913 - protein, 142 aa, Panicum virgatum
  misc_feature: Ceres CLONE 1766627
  misc_feature (10)..(81): Pfam Name: RRM_1 Pfam Description: RNA recognition motif. (a.k.a. RRM, RBD, or RNP domain)
  misc_feature (48)..(134): Pfam Name: GRP Pfam Description: Glycine rich protein family
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
  misc_feature: The sequence is a functional homolog of SEQ ID NO 22 in US patent 7244875
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with altered terpenoid content
  misc_feature: Useful for making plants with modulated phosphate use efficiency
MAAADVEYRCFVGGLAWATDNASLQQAFASYGDVLDSKVITDRETGRSRGFGFVTFSSEQSMLDAIEAMNGKDLDGRNITVNQAQSYGGGGGGYGGGGGGGGYGGGRREGGYGGGGGGGRREGGYGGGGYGSRGDSGGNWRN

SEQ ID NO: 12914 - DNA, 765 bp, Panicum virgatum
  misc_feature: Ceres CLONE 1766681
  misc_feature: Encodes the peptide sequence at SEQ ID NO. 12915
atctcctccctttgtttcttgaaccgttcccttctctcggactctctcctgtctcctcccttccctggcggcgacgaccgagcggcggcgtcatttgtcctgtcttggcccaaccctttgccagcgacgagcgcatcctccagtttcaacaatgaagatgatcgctgcctacctgctcgctgtcctgggtggaaacacttcccccactgctgatgacgttaagaacattctggaatcagttggggctgaagctgatgaagagaaactggacttcctgctcacagaactcaaaggcaaggacataacagaagtgattgcagctggaagggaaaaattcgcctccgtgccttcaggtggtggtgcaattgctgtgggagctccggctgctgcagctggtggtgctgcacctgctgaagaggcaaagaaggaagagaaggttgaagagaaggaggaatcagatgacgatatgggtttcagcttgttcgattaagcactgctgccctgcatgtagtttcttcgcacgtatggtctgatacaccggtcggtatcgtatggtctgatacaccggtcggtatccgcaaaataaccatgccgagaactagtatcagtgtgctattttgcttgtgataatggcatgtctagtactttggtgtcatgatatgcgagtatgcagtcctctgtgctatttcgtgtgtacatgtctagtaccgttggcatcctgtgatggtagcatgtctttcaggaaacttaagaagttgaatgtta

SEQ ID NO: 12915 - protein, 112 aa, Panicum virgatum
  misc_feature: Ceres CLONE 1766681
  misc_feature (17)..(111): Pfam Name: Ribosomal_60s Pfam Description: 60s Acidic ribosomal protein
  misc_feature: Useful for making plants with altered oil content
  misc_feature: Useful for making plants with modulated biomass
MKMIAAYLLAVLGGNTSPTADDVKNILESVGAEADEEKLDFLLTELKGKDITEVIAAGREKFASVPSGGGAIAVGAPAAAAGGAAPAEEAKKEEKVEEKEESDDDMGFSLFD

SEQ ID NO: 12916 - DNA, 791 bp, Panicum virgatum
  misc_feature: Ceres CLONE 1766695
  misc_feature: Encodes the peptide sequence at SEQ ID NO. 12917
attcccccacacagcaccactgccccttcacagcatttgcttaattagctaataagcacgaccctatcggtactaatggcggctttgatgatgaagatcaagaagcagatgccggcggtggtggcgttggccgttgtggtggcggcggcggcgctggtggcgtcggcgtcggcggccatcacgtgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagctcggaccggcaggttttttgccggtgcctcaagagcctggccagcaccgtcaagtcggtgaacatgggcaccgtcgccaccatccccggcaagtgcggcgtctccgtgccattccccatcagcatgtccactgactgcaacaaggtcaactaataaattgtgcatcaatataataatcctaccatctgatgaggaagctcagctcgatccgctcagaagctagctgctagctagcgagctttcaggagaataaaataaagttgaggcatcatcagcaggcagcagcacatcatctatatatattattgttgtactcgatctgtgtgtacgtgcgcgtatacatacatgcatgcttatacgatcgatgtatatatatgtgctgcttctctcacaagtacgcgtgctcatatatatacatacatgtgtgctagctttgtgtcctgctgtgatcaataacaactactcctgctactgttcagtgctgcttc

SEQ ID NO: 12917 - protein, 126 aa, Panicum virgatum
  misc_feature: Ceres CLONE 1766695
  misc_feature (37)..(122): Pfam Name: Tryp_alpha_amyl Pfam Description: Protease inhibitor/seed storage/LTP family
MAALMMKIKKQMPAVVALAVVVAAAALVASASAAITCGQVGSALAPCIPYATGKASALPSSCCGGVRSLNSAARTSSDRQVFCRCLKSLASTVKSVNMGTVATIPGKCGVSVPFPISMSTDCNKVN

SEQ ID NO: 12918 - DNA, 606 bp, Panicum virgatum
  misc_feature: Ceres CLONE 1766700
  misc_feature: Encodes the peptide sequence at SEQ ID NO. 12919
gttcctgctcccgcgagagtgccgggaggcgtgccgggtgatgggctacgacgtgcccaggggcaccaaggtgctcgtcaacgcgtgggcgatcgcgagggacccgagctactgggagagcccggaggagttcaggccggagaggttcgaggggcccggcggcggcgtggacttcaggggtgccgacttcgagttcatccccttcggcgccggccggcggatgtgcgccggcgcggcgctcgggctggccaacatggaggtggcgctcgcggggctgctctaccacttcgactgggagctcccggagggaggggaggagcttgagatgggcgaggtgcttggcatcaccgtgaagaggaagtccaagctcgtgctgcgcgctacgccacggatcccatgcgcgtactgatgttcaccccctagatcgctgtctgtgtgtgtagtatcacttaatttagctgatcttgctagctagaacaatagtccgcaagggtttggtttgtactccctcctttcccaaaataagtgcacttttagagttagagtttgagtaaataaatcaatgttagtgtgaaaatatatatgtaaagatgtgatcattagtgc

SEQ ID NO: 12919 - protein, 135 aa, Panicum virgatum
  misc_feature: Ceres CLONE 1766700
  misc_feature: SWISSPROT Homolog: EC 1.14.13.88 Flavonoid 3',5'-hydroxylase
  misc_feature: Useful for making plants with altered carbohydrate content
FLLPRECREACRVMGYDVPRGTKVLVNAWAIARDPSYWESPEEFRPERFEGPGGGVDFRGADFEFIPFGAGRRMCAGAALGLANMEVALAGLLYHFDWELPEGGEELEMGEVLGITVKRKSKLVLRATPRIPCAY

SEQ ID NO: 12920 - DNA, 692 bp, Panicum virgatum
  misc_feature: Ceres CLONE 1766710
  misc_feature: Encodes the peptide sequence at SEQ ID NO. 12921
attcccccacagcacaaagcagccccatataaactccgctcacacactgcagctagcatttgcttagcttagcaggagcatcatatcgataataataattcaaagacaatggctttgatgatgaagaacaacaggatgcaggcggtggtggcgttggccgttgtcatggcagctgcggcgctggtggcgtcggcgtcggcggccatcacgtgcgggcaggtgggttcggcgctggcgccgtgcatcccgtacgcgacggggaaggcgagcgcgctgccgtcgtcgtgctgcagcggcgtgcgcagcctcaacagcgcgttttttacgagcgcggaccggcaggcggcgtgccggtgcctcaagagcctggccagcaccgtcaagtcggtgaacatgggcaccgtcgccaccatccccggcaagtgcggcgtctccgtcccattccccatcagcatgtccacagactgcaacaaggtcaactaaattaatggtatgtacataccagctgatcgacgatgacaagctttggtgacgtcgtccttcacaagatctgctgtaatatacatgttatactcgatctgtgtgtacgtgcgcatatatatacatgtgtacatgcctatgtacgatcgatgttatgtgcacatgtatgcttgtgtgtcctgctgtaataatcgagacagagaactgctgct

SEQ ID NO: 12921 - protein, 124 aa, Panicum virgatum
  misc_feature: Ceres CLONE 1766710
  misc_feature (35)..(120): Pfam Name: Tryp_alpha_amyl Pfam Description: Protease inhibitor/seed storage/LTP family
MALMMKNNRMQAVVALAVVMAAAALVASASAAITCGQVGSALAPCIPYATGKASALPSSCCSGVRSLNSAFFTSADRQAACRCLKSLASTVKSVNMGTVATIPGKCGVSVPFPISMSTDCNKVN

SEQ ID NO: 12922 - DNA, 416 bp, Panicum virgatum
  misc_feature: Ceres CLONE 1766775
  misc_feature: Encodes the peptide sequence at SEQ ID NO. 12923
attttacccaagttaatctccttgccgcacctccccctttcgccaggtggcgcaataccgaagaagcccgaacccatcgcccttcccaacagttgcgctaccggaatggcgcatgggacgcgccctgtacaggggcatcaagcgcggcgcctgtggtgattacgcacagcgtgaccgctacacttgccaccgccgaagcgcccgcgcctgtcgctttcttcacatcattgctcgccacgttcgcccagcttaccacgtcgcagctatgatacagtcggctcgcttgcgagttccgatttagaagctctacggccaccgcgctcccaaccatctacagcaaggtgatggttcacgtagtgggcaagcccaccgagaaagcgtttctctccccttgacgttggactccaccttgtata

SEQ ID NO: 12923 - protein, 88 aa, Panicum virgatum
  misc_feature: Ceres CLONE 1766775
  misc_feature: SWISSPROT Homolog: EC 3.2.1.23 Beta-galactosidase
FTQVNLLAAPPPFARWRNTEEARTHRPSQQLRYRNGAWDAPCTGASSAAPVVITHSVTATLATAEAPAPVAFFTSLLATFAQLTTSQL

SEQ ID NO: 12924 - DNA, 667 bp, Panicum virgatum
  misc_feature: Ceres CLONE 1766775-R
acgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctc

SEQ ID NO: 12925 - DNA, 733 bp, Panicum virgatum
  misc_feature: Ceres CLONE 1766808
  misc_feature: Encodes the peptide sequence at SEQ ID NO. 12926
attcacagccctcccggctcctgctctgggctcagggctcaaggctcagggcctcgtctctcccttctctcagactctccttgctcttccttccctggcggcgacgactgggcgagcggcgacgccatttctcacgtcttcgccaagccctttgccggcgacgagcatcctccagacatggatgcgtcaggccttccagcattcgccaatggagagatgctgaagacgttggttgggcgaagagtgcgcacagtggttcaagtccagcgccgtgaaggcggactccttgttgggcagtcaactgacgggcatcagttgatttttagaggtgccatggatgtccctgtatcgcactttatggaggtttttggaactgctgaaggcgaccagtctatcagtgctgaaatttgcacagatttcggcaacaactttgatgctgaatcattcaatggactgtgcaagtttgcgaacatggtcaaggagccgttcctgtagagttcagtatctgacataagttgatgtcttagatttgaagatttggctaaatgtttcttcataacttcagtgatctgttgctgtcagtattgggtatctcttatgacctattaatctaagctatgtaacaagaaagacaagtgactcatggtctcatgtagtagatgagattactgcgtttgtttcctccaagcaaaacgagcagaagctttatgttaatgtcacttgcatttctacc

SEQ ID NO: 12926 - protein, 105 aa, Panicum virgatum
  misc_feature: Ceres CLONE 1766808
  misc_feature (1)..(104): Pfam Name: Rep_fac-A_3 Pfam Description: Replication factor A protein 3
MDASGLPAFANGEMLKTLVGRRVRTVVQVQRREGGLLVGQSTDGHQLIFRGAMDVPVSHFMEVFGTAEGDQSISAEICTDFGNNFDAESFNGLCKFANMVKEPFL

SEQ ID NO: 12927 - DNA, 784 bp, Panicum virgatum
  misc_feature: Ceres CLONE 1766819
  misc_feature: Encodes the peptide sequence at SEQ ID NO. 12928
atcctcgccgtcgactcccatccccacccacctctgacctcacctctccccgcgacgaatcggcgaggcggcggcggcggcggcggcgagcgctagagccttgctgctgaagacgcgggatggccggcatgggcgagatgccgatgaggccggcgcggccgggcccgccgatgcagcaccggggcccgccgccgatggcgcgcctccgccccgaaccgatagaccgcgagaagacctgtcctctcttgctcagggtcttcacaagggttgctggccatcaccaaaatgaagagtttgcggtgagagggaaggagccaaaagatgaagttcagatttacacatggaaggatgccacgctccgtgagctcacagaccttgtaaaagaggttgctcttccagcaaggaaaagaaatgctaggctttcttttgcttttgtgtacccagacaagaatggccgttttgttgtcagacaggtgggttcgacctttgcatatggtcatggaagaggggatgatgccaaaactctggcagagctcgggttccagattggtgattacttgagcgttgcaatcatgtagacgatagcccatgctgaacgtgacagactgcaccgaactggatgtaactgttgtgatgtcaaaagcccccggggcaagggatgaatctgtgttagcactagggaattggaaccaaaattgtctgtaatactggaacaatcaaagttcactaaacattctgaacgttcaaggtgtctggtgtggttgcttgttaatatggtacttgt

SEQ ID NO: 12928 - protein, 152 aa, Panicum virgatum
  misc_feature: Ceres CLONE 1766819
  misc_feature (30)..(151): Pfam Name: SAP18 Pfam Description: Sin3 associated polypeptide p18 (SAP18)
MAGMGEMPMRPARPGPPMQHRGPPPMARLRPEPIDREKTCPLLLRVFTRVAGHHQNEEFAVRGKEPKDEVQIYTWKDATLRELTDLVKEVALPARKRNARLSFAFVYPDKNGRFVVRQVGSTFAYGHGRGDDAKTLAELGFQIGDYLSVAIM

SEQ ID NO: 12929 - DNA, 890 bp, Panicum virgatum
  misc_feature: Ceres CLONE 1766839
  misc_feature: Encodes the peptide sequence at SEQ ID NO. 12930
gtgtccggtctccgcgagctctcacgcgctcctgtcctgggctcgcctccacccaactcgtcctcttctcttgtcgtcgccctcgccctcccctctaccgggggggcgcatgagctagtgtggactggaattcgatccatctgctggacctgggttgatttcttctttccctgagacatcggaggatgtcgactccggcgaggaagcggttgatgagggatttcaaacggttgatgcaggatcctccggccggcataagtggcgctccgcaggataacaacatactgctatggaatgctgttatctttggcccagacgatagtccatgggatggaggtacgttcaagctgactctccagtttactgaagaatatccaaacaagccaccaactgtgcggtttgtttctcggatgtttcatcctaacatttatgctgatgggagcatatgcttggatatcctgcagaatcagtggagcccaatatatgatgtagctgctatacttacgtccatccagtcgttgctgtgtgatccaaacccgaattcgcctgcaaactccgaagctgcccgcatgttcagcgagaacaagcgtgagtacaaccgcaaagtgcggggagttgtggagcagagctggacggcggactgatgcattgcattgcgcagcttgtcactgcttccttgtgccctactcataccaaaatgcctgcatttgtgtaactaaaatagccgaattcagctgtgactgctgttctcctgtatgagctttgccatgcttctctctatctttgctgggccgatggagattgtgccgtcatgacttttaccctatgctggatcttggatacaaaccgaattaatctaccatcatgctgatattttataattttatacg

SEQ ID NO: 12930 - protein, 152 aa, Panicum virgatum
  misc_feature: Ceres CLONE 1766839
  misc_feature (8)..(145): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFKRLMQDPPAGISGAPQDNNILLWNAVIFGPDDSPWDGGTFKLTLQFTEEYPNKPPTVRFVSRMFHPNIYADGSICLDILQNQWSPIYDVAAILTSIQSLLCDPNPNSPANSEAARMFSENKREYNRKVRGVVEQSWTAD

SEQ ID NO: 12931 - DNA, 725 bp, Panicum virgatum
  misc_feature: Ceres CLONE 1766868
  misc_feature: Encodes the peptide sequence at SEQ ID NO. 12932
gaaccgggcagcctagcgcccctgcggtcgactccgcgggagggggacgcaatcgccgtccggcagccactgcctgcgctgctctccggcgaccgactcgctccactccccggcgaaaacatgatcgtctgcgtcgccgtcgtcggacaccagaacaacccgctgtacctgcagagcttcacggaggcggacgacgccatcaagctccaccacatcgtccactgctccctcgacgtcatcgacgagcgagtaaacaatcctaaaaggagtgcgcctacattgaatgagacatttttgggtcttctgtacccaactgagaactacaaagtgtatggctatttgacaaacacaaaggtcaaatttatcatggtcacgactgatcttgatgtcaaagatgcagatgccagaaattttttcaggaagttccatgctgcatatgtggatgctgtctcgaaccccttccatgtcccagggaagaagattgcttccagaagctttggcgcaagagtaagcaccattgtgaagtcattcggttcaggaactactggttgagttgaaaggctcttttgtcagacttcctgtaatcaaatatggttcagtcccgctgattgatggtttactctacacattgtgtactacttgtatgttgaacgagattctagtgtggtactgatgaaagaaagatggttgttcattcattcaaagattgtgtttttttcttgttc

SEQ ID NO: 12932 - protein, 143 aa, Panicum virgatum
  misc_feature: Ceres CLONE 1766868
  misc_feature (7)..(136): Pfam Name: Sedlin_N Pfam Description: Sedlin, N-terminal conserved region
MIVCVAVVGHQNNPLYLQSFTEADDAIKLHHIVHCSLDVIDERVNNPKRSAPTLNETFLGLLYPTENYKVYGYLTNTKVKFIMVTTDLDVKDADARNFFRKFHAAYVDAVSNPFHVPGKKIASRSFGARVSTIVKSFGSGTTG

SEQ ID NO: 12933 - DNA, 819 bp, Panicum virgatum
  misc_feature: Ceres CLONE 1766886
  misc_feature: Encodes the peptide sequence at SEQ ID NO. 12934
gtgcgcgaggtggagagcagccgcgtggtggcgccgccgccggaggcggagaagcggccgcgcaagcgcgggcgcaagccggcgaacggccgcgaggagccgcttaaccacgtcgaggcggagcggcagcggcgcgagaagctcaaccagcgcttctacgcgctgcgcgcggtggtgcccaacgtgtccaagatggacaaggcgtcgctgctcggcgacgccatctcctacatcaacgagctccgcggcaagctgacggcgctggagtcggacaaggacacgctgcacgcccagatcgaggcgctcaagaaggagcgcgacgcgcggccggcccctcacgctgccgggcacgacgccgggccgcgctgccacgcggtggagatcgacgccaagatcctggggctggaggccatgatccgcgtgcagtgccacaagcgcaaccacccgtcggcgcggctgatgacggcgctgcgcgagctggacctggacgtctaccacgccagcgtctccgtcgtcaaggacctcatgatccagcaggtcgccgtcaagatggccagccgcgtctactcacaggagcagctcaacgctgccctctacagtcgcctcgcggagcctggcaccgccatgggcaggtaatcacggcagggcgagctcagctcacacctggggcagccagatagggacgatactgttaccgttatcgcaaccggattgtcgccgtcgtcacctccatggtcacaacacaatagctggagagattggcgaggaggaagacgacgatgacgccggtgttgttgtaaactttagaagggaggatgg

SEQ ID NO: 12934 - protein, 211 aa, Panicum virgatum
  misc_feature: Ceres CLONE 1766886
  misc_feature (33)..(82): Pfam Name: HLH Pfam Description: Helix-loop-helix DNA-binding domain
  misc_feature: The sequence is a functional homolog of SEQ ID NO 1238 in the 10/412,699 US patent application
  misc_feature: The sequence is a functional homolog of SEQ ID NO 943 in the 10/374,780 US patent application
  misc_feature: The sequence is a functional homolog of SEQ ID NO 116 in the 10/374,780 US patent application
  misc_feature: The sequence is a functional homolog of SEQ ID NO 386 in the 10/412,699 US patent application
  misc_feature: The sequence is a functional homolog of SEQ ID NO 596 in the 10/225,066 US patent application
  misc_feature: The sequence is a functional homolog of SEQ ID NO 894 in the 11/479,226 US patent application
  misc_feature: The sequence is a functional homolog of SEQ ID NO 184 in the 10/666,642 US patent application
  misc_feature: The sequence is a functional homolog of SEQ ID NO 1842 in the 10/412,699 US patent application
  misc_feature: The sequence is a functional homolog of SEQ ID NO 2082 in the 10/374,780 US patent application
  misc_feature: The sequence is a functional homolog of SEQ ID NO 746 in the 10/412,699 US patent application
VREVESSRVVAPPPEAEKRPRKRGRKPANGREEPLNHVEAERQRREKLNQRFYALRAVVPNVSKMDKASLLGDAISYINELRGKLTALESDKDTLHAQIEALKKERDARPAPHAAGHDAGPRCHAVEIDAKILGLEAMIRVQCHKRNHPSARLMTALRELDLDVYHASVSVVKDLMIQQVAVKMASRVYSQEQLNAALYSRLAEPGTAMGR

SEQ ID NO: 12935 - DNA, 995 bp, Panicum virgatum
  misc_feature: Ceres CLONE 1766910
  misc_feature: Encodes the peptide sequence at SEQ ID NO. 12936
gcttccgcaccaccgcatcgtccgccgccgccagtcgcgcgcacgcgtccggcaccggcaccggtaccagcacagcacgccaagcctcctcccctgaccctcccgtgcacccggccccgccgcgaaagccccgagatccgccgcgccgtcggaagatggggcggagaggggagccctactacgtggaggcggcgccgccggtggacatcaacaagaacaccgagtggttcatgtacccgggcgtctggaccacctacatcctgctgctcttcttcgcgtggctcctcgtcctctccgtctccggctgctccccgggggccgcctggaccgtcgtcaacctcgggcacttcgccatcacttaccacttctttcattggaagaaaggaaccccatttgctgctgatgaccagggcatctacagccgattgacatggtgggagcaaattgacaatggccagcagcttactcggaacagaaagtttttaactgtggtacctgtggtcctgtacctgattgcatcacacttgaccgactacaagcagccgatgtttttcctcaacacggtggcagttttcgtgctggttgtagcaaagctgccaaacatgcacaaggtccgcatatttggaatcaatgcagacatctgagtgccacttgaggaagtatctggatgttctcgtgctccaaggtctgaaagagggacgtggaacaagtgaatgctttgcaaaggcaactcggtcgccgcctgtaatatctgtataggtgtagaaagaactgtaaatgttactctagcatactgtacaaggtttgcctgcagactgctgtgtgtttgttgttgcagcttcttccttcagagttggttcgctggaagctgtctgttagtgcaacacagcagtatgtggataagaaagtgtgtagcaaatgctatttgccgtcttgtatagaatggaacccagacataagtgaaatcatctttctgtgggtaggccccagggtgt

SEQ ID NO: 12936 - protein, 162 aa, Panicum virgatum
  misc_feature: Ceres CLONE 1766910
  misc_feature (18)..(161): Pfam Name: ORMDL Pfam Description: ORMDL family
MGRRGEPYYVEAAPPVDINKNTEWFMYPGVWTTYILLLFFAWLLVLSVSGCSPGAAWTVVNLGHFAITYHFFHWKKGTPFAADDQGIYSRLTWWEQIDNGQQLTRNRKFLTVVPVVLYLIASHLTDYKQPMFFLNTVAVFVLVVAKLPNMHKVRIFGINADI

SEQ ID NO: 12937 - DNA, 872 bp, Panicum virgatum
  misc_feature: Ceres CLONE 1766922
  misc_feature: Encodes the peptide sequence at SEQ ID NO. 12938
cccgacaaaaccctagcccccagcagccgcagcggccaccacttcgcgtcccctgtctccctctcgtcacccgtcggcggcggcggcagcggcgggatggcggcttcgacggcgaggacggtgaaggatgtcaacccgcacgagttcgtcaaggcctactccgcccacctcaagcgctccggcaagatggagctccctgagtgggttgacattgtgaagactgcgaggttcaaggagctccctccttatgaccctgactggtactacaccagggctgcctcaattgcaaggaagatctacctcaggcaaggcattggggtgggtggattccagaagatttatggtggccgccagaggaacggctcccgcccaccacacttctgcaagagcagtggtgccatttcacgcaacatcctgcagcagttgcagaagatgggcatcattgatgttgaccccaagggtgggcggctcatcacctcccagggtaggcgtgatcttgaccaagtagctggaagagttgctgttgacgcatgagcatctcagcgttctgttttgatgatgtccgtgtttgatggttaagatggctacactttatttgcagttttgaactaggacttgccctgccttgctggttcagagaatttaagatttaatgcatctagttatggaactgcactatgtttcccccaagtacctaatgcagtattggaactcattctggaatgaaacaaaggaattgtgcttgtgatgtgaatgagcagcccatgtcttgccatgttgattagatgaatacgttatactgttttactaaactttgatcgtgaagattataagtggaaattttatgtatgcagttatgattgtttctcgtc

SEQ ID NO: 12938 - protein, 145 aa, Panicum virgatum
  misc_feature: Ceres CLONE 1766922
  misc_feature (7)..(145): Pfam Name: Ribosomal_S19e Pfam Description: Ribosomal protein S19e
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDVDPKGGRLITSQGRRDLDQVAGRVAVDA

SEQ ID NO: 12939 - DNA, 695 bp, Panicum virgatum
  misc_feature: Ceres CLONE 1767033
  misc_feature: Encodes the peptide sequence at SEQ ID NO. 12940
atcacttcacaattataagctagctaataagcgaacaagagtgttaggagtggagatgatgacaagcgtcggtggtggcggatacccctccttgccccaacgcatttgtgggagcggcgtccacccccagcacgaccttctccttgtagtctaccaccacaacgccgccgtttcttgcaacctctgcaccaagcccctcgccggccttcacgcctacaactgcgccatctgcatgttcaacttccactgggaatgcgtctttgggtcgtcgtctgtccagcagccacaagtagtgccgccccaagtcggagtagtcgcggccaacgtccagccgccaccgccgccacgaccgccgcccaatgtccagccgccgccactacctgcaggaagaggtttgggcagcataattgcaggtagcgccatcggcgcattcgtcagtgagatcgtgaagcaaatcattcgccatggcgacgaacaggcctctgaggaatagcttgtctctcggacccctgctagtagcaaggctgcagcttcagcggggcgacatagatggctgctacatcatatgtaccatctgtatgcttggatgatgtacgattacacgtgtgccgtgcatggttttcaattattatttgttaactttctacttcatgagaatgcaataagagaaaaaaaacatgtttatgttgttgcag

SEQ ID NO: 12940 - protein, 145 aa, Panicum virgatum
  misc_feature: Ceres CLONE 1767033
  misc_feature (39)..(68): Pfam Name: C1_3 Pfam Description: C1-like domain
MMTSVGGGGYPSLPQRICGSGVHPQHDLLLVVYHHNAAVSCNLCTKPLAGLHAYNCAICMFNFHWECVFGSSSVQQPQVVPPQVGVVAANVQPPPPPRPPPNVQPPPLPAGRGLGSIIAGSAIGAFVSEIVKQIIRHGDEQASEE

SEQ ID NO: 12941 - DNA, 804 bp, Panicum virgatum
  misc_feature: Ceres CLONE 1767034
  misc_feature: Encodes the peptide sequence at SEQ ID NO. 12942
aacgccgagaagacggagacgagagagaggggaggaggtgctccaccgcaggaaggaaacccaatcccccaccccatcgatccggttgcggcggcggcacggcgtggtagctagctactagcgactatggtggtggaggagatcaccgagggcgtgaagaacatcagcgtcgccggggacgcggcggcgtcaggcggcggcgccggcggggaggggcagaagaggggcggcggcggcagcagcaaccgcatccaggtgtccaacaccaagaagcccctcttcttctacgtcaacctcgccaagaggtatatgcagcagcacggcgatgttgagctctccgcgctcggaatggcaatagtaacagttgtgactgtggcggagattctgaaaaacaatgggtttgctgttgaaaagaagattagaacatctactgtggaaataaatgatgaatcgagagggcgcccattccaaaaggccaagattgagatagtgttgggaaagagcgaaaaatttgacgagctgatggccgctgccgcggaagaaaggggagaagtggaagatggtgaagagcatgcttaataaagtgctcgagcgacaagcatctgtcattgtgctctgttagtgttgtttaataccgcgtgcattagagatggcacgcgttcttgtttgactgcattcccatgggagtgccagcgagctcatcgactgatggatgatgatgatttcctcacattttggactgccagtttatttctttggctttgtgttgctagttgaatgttcttgaaaagtatgctctctttt

SEQ ID NO: 12942 - protein, 150 aa, Panicum virgatum
  misc_feature: Ceres CLONE 1767034
  misc_feature (38)..(107): Pfam Name: Alba Pfam Description: Alba
  misc_feature: Useful for making plants with modulated nitrogen use efficiency
MVVEEITEGVKNISVAGDAAASGGGAGGEGQKRGGGGSSNRIQVSNTKKPLFFYVNLAKRYMQQHGDVELSALGMAIVTVVTVAEILKNNGFAVEKKIRTSTVEINDESRGRPFQKAKIEIVLGKSEKFDELMAAAAEERGEVEDGEEHA

SEQ ID NO: 12943 - DNA, 630 bp, Panicum virgatum
  misc_feature: Ceres CLONE 1767041
  misc_feature: Encodes the peptide sequence at SEQ ID NO. 12944
ccccccagccggctccccttgcctcccccccgcgcaccacctgttcgacccgactccccatcctccacctgtcagccctcccgcccgccgctcccaatggcgccccccgccgccgcgtccgtggcgccgccctccacctccaccgcatcctcggtgttcttgctccgccgcttcccgtccccgtcccccgcctccggccgccgccccgcccagcagccccgccgcgcgcgcctgctcctccaggtcgcgctcaccagcgaggtatcctcggatgacgtggcggccgaggaggccgcggcggcgcccaatatttttttgcgggtgcgcgtcacggcgccgctccgcgtccaccacatcgtcaaggcgcccgacctggacatccagggcatggagggcgtcgtcaagcagtacgtcggcgtctggaagggcaagcgcatcacggccaacctccccttcaaggtcgagttccagatcgctgtcgaggggcagcccaagcccgtccgcttcttcgcccacctccgggaggacgagttcgagttcgtcgacgaggagtaacggcctcgaggtgcggttctcgcgcctgtggacgtgtaagcggcagcgccgttcttatagaataataaccatggc

SEQ ID NO: 12944 - protein, 152 aa, Panicum virgatum
  misc_feature: Ceres CLONE 1767041
  misc_feature (72)..(145): Pfam Name: FeThRed_A Pfam Description: Ferredoxin thioredoxin reductase variable alpha chain
MAPPAAASVAPPSTSTASSVFLLRRFPSPSPASGRRPAQQPRRARLLLQVALTSEVSSDDVAAEEAAAAPNIFLRVRVTAPLRVHHIVKAPDLDIQGMEGVVKQYVGVWKGKRITANLPFKVEFQIAVEGQPKPVRFFAHLREDEFEFVDEE

SEQ ID NO: 12945 - DNA, 819 bp, Panicum virgatum
  misc_feature: Ceres CLONE 1767043
  misc_feature: Encodes the peptide sequence at SEQ ID NO. 12946
gcctccctcgaaaaccctagaagcccttcaccctcccctgcggcggccgccttctcctcgcggaatccttctcgcctcgcgaaaatgagccaggaggcagtgaacccgaaggcgtacccgctggcggacgcgcagctgacgattagtatcctcgagatcatccagcaggccgccaactacaagcagctcaagaagggcgccaacgaagcgacgaagaccctaaacaggggaatatcggagttcgtggtgatggcggctgacaccgagccgctcgagatccttctccacctccccttgctagctgaggataagaatgtgccatatgtatttgttccatcgaagcaagctcttggacgcgcttgtggtgtgacaagaccggttattgcttgctcagtgaccagcaacgagggtagccagctgaaacagccgattcagagtctcaaggactctatcgagaagcttctcatctgatttaccaaagacctttcagtgtgatgggcctcagagggacacatttttcagaggcttggactggtgatggtgtcttgtttactagattttgtgcgttccaaactattatgtttgaagactgttaaaagtcgatcatacttgaatttgtgctgcggcatcttatcttatttgtgactcttgtaaggcgtctgtatcatggtggtttctgtcgagattccgaccattattgtaacagctgatggcaatgagttgtgagaattgataatttggctggtttgcaacttcttgcgaccactttcagcacaaaaggtttatgtgtgttggctaggtgaagggtgcctaagttcc

SEQ ID NO: 12946 - protein, 128 aa, Panicum virgatum
  misc_feature: Ceres CLONE 1767043
  misc_feature (20)..(114): Pfam Name: Ribosomal_L7Ae Pfam Description: Ribosomal protein L7Ae/L30e/S12e/Gadd45 family
MSQEAVNPKAYPLADAQLTISILEIIQQAANYKQLKKGANEATKTLNRGISEFVVMAADTEPLEILLHLPLLAEDKNVPYVFVPSKQALGRACGVTRPVIACSVTSNEGSQLKQPIQSLKDSIEKLLI

SEQ ID NO: 12947 - DNA, 593 bp, Panicum virgatum
  misc_feature: Ceres CLONE 1767062
  misc_feature: Encodes the peptide sequence at SEQ ID NO. 12948
atccgcgagcgcggagggacaccagtcacaccacagcgcgcaagatgagcagcggcggcggcgacaacaagtccggctcgggtggcggcggcggggcggtgaagacgccgtcggacttcctcaagtccatcaggggccggcccgtcgtcgtcaagctcaactccggcgtcgactaccgaggtattctggcttgtcttgatggatacatgaacatcgcgatggagcaaactgaagagtatgtgaatggtcagctaaagaacaaatatggtgacgcattcataagaggaaacaatgtattgtacatcagtacatccaagcgtacccttacagacggttcgtgagaggtgaaactgttaagatcttcagtgccagtcttgcaactcgaccgattatgagtgaattttatgtattactttcttttccagttgtactgacaggcgacagctatgcttgatgttaatgttagcagcttggaactctgtccacatattttgcactcaagatatgtggtggtaattcgacctgtagagatacagataagactctggtgtcataaactgaaatgtctgctatctcaaatatttttgtgaatc

SEQ ID NO: 12948 - protein, 98 aa, Panicum virgatum
  misc_feature: Ceres CLONE 1767062
  misc_feature (24)..(89): Pfam Name: LSM Pfam Description: LSM domain
MSSGGGDNKSGSGGGGGAVKTPSDFLKSIRGRPVVVKLNSGVDYRGILACLDGYMNIAMEQTEEYVNGQLKNKYGDAFIRGNNVLYISTSKRTLTDGS

SEQ ID NO: 12949 - DNA, 759 bp, Panicum virgatum
  misc_feature: Ceres CLONE 1767067
  misc_feature: Encodes the peptide sequence at SEQ ID NO. 12950
cctgtcctcctctcctctacgcgctcgctcgcgccgccgccgccgccgccgccgccgcacttcccgtctggtctcgtctgcgcagcaaaccctagcagcaggtgggtcggttatcgacggacagtagccatgagtaagttgcaaactgaggccctcaaggaggccatctccctggtcgtgtcggaggcaagggagaagaacaggaagttcacagagaccatcgagctccagattggactgaagaactatgatccgcaaaaggacaagcgtttcagtagctccgtcaagctgccccacatccctcgccccaagatgaaggtctgcatgcttggtgatgcccagcacgtggaggaggctgagaagatcggtcttgattacatggatgttgaagctcttaagaagatgaacaagaacaagaagcttgtcaagaagcttgctaagaagtaccatgctttcttagcttctgaggctattatcaagcagattccccgtctccttggtcctggtctcaacaaggcaggcaagttcccaactttggttactcaccaggagtctctggaatcaaaggtgaatgagacgaaagctacagtgaagttccagctcaagaaggttctttgcatgggtgtggctgtgggtaacctgtcgatggaggagaagcagatccagcaaaacatccagatgagcgtcaacttcctggtttcattgctgaagaagaattggcagaacgtgaggtgcctgtacatcaagagcaccatgggg

SEQ ID NO: 12950 - protein, 209 aa, Panicum virgatum
  misc_feature: Ceres CLONE 1767067
  misc_feature (10)..(209): Pfam Name: Ribosomal_L1 Pfam Description: Ribosomal protein L1p/L10e family
MSKLQTEALKEAISLVVSEAREKNRKFTETIELQIGLKNYDPQKDKRFSSSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTM

SEQ ID NO: 12951 - DNA, 746 bp, Panicum virgatum
  misc_feature: Ceres CLONE 1767085
  misc_feature: Encodes the peptide sequence at SEQ ID NO. 12952
attccacgaaccacaagccacacagccccctttccccacctcgatctcgcacgcctagggtttcgtctcgccgccctcctccaccgccaagatgccgaagaacaagggtaagggaggcaagaaccggaagcggggtaagaacgaggcggacgacgacaagcgcgagctcgtcttcaaggaggacgggcaggagtacgcgcaggtgacccgcatgctcggcaatggccgttgcgaggccatctgcgtcgacggcacgcgccgcctctgccacatccggggcaagatgcacaagaaggtctggatcgcggcgggcgacatcgtcctcgtcggcctccgcgactaccaggacgacaaggccgacgtcatcctcaagtacatgaacgacgaggcgcgcctgctcaaggcctacggcgagctccccgagacgctcaggctcaacgagggcgtcgacgtcgacgggcccgaggacggcgaggagggcagcgactacatccagttcgaggacgaggacatcgacaagatctaagattcctgtttctcctcgcggctactttcttatatgtaacttattgttatgtgttctagtgccttgtggtgatatggtttaggctggctgttatggatttgcacttttgccagcataatcttgtgatgcgacgagatgtggttaggatctgaggtggttaaataatcgcggattaatatcgttccaatctggtacatgctgttattacaacaagtgctat

SEQ ID NO: 12952 - protein, 144 aa, Panicum virgatum; identical to SEQ ID NO: 10083
  misc_feature: Ceres CLONE 1767085
  misc_feature (30)..(94): Pfam Name: eIF-1a Pfam Description: Translation initiation factor 1A / IF-1

SEQ ID NO: 12953 - DNA, 582 bp, Panicum virgatum
  misc_feature: Ceres CLONE 1767089
  misc_feature: Encodes the peptide sequence at SEQ ID NO. 12954
tttttggcgagttcttcttctcttcggcggcggcggcggcggcaagcgaagaagccggcggcgaaatgggcaagggtacgggaagcttcggcaagcgccggaacaagacgcacacgctatgcgtgcgctgcggccgccgcagctttcacctgcagaagagcacctgctcctcctgcggctaccccgcggcccgcatccgcaagtacaactggagtgtgaaggccattagaaggaagactactggcacagggaggatgaggtaccttcgccacgtgccacggaggttcaagagcaacttcacggagggaactgaggccgtatcacggaagaagggggcttctgctggcaccaactaagtgtgttctccacttacgctaggccgggctgtggatcatgaaactaatgttttctttttctttacgtctatgttcctgaattgtgaggcaaacgatgcttgtctatgttatttcacattctgtatgtcaatccttcagttttgaatgttgaaacgtgccagattggtagttgtcaccctatttacagaattaaatctgcagctgcctgtgtgatgttgcttatgtt

SEQ ID NO: 12954 - protein, 96 aa, Panicum virgatum
  misc_feature: Ceres CLONE 1767089
  misc_feature (2)..(55): Pfam Name: Ribosomal_L37e Pfam Description: Ribosomal protein L37e
MGKGTGSFGKRRNKTHTLCVRCGRRSFHLQKSTCSSCGYPAARIRKYNWSVKAIRRKTTGTGRMRYLRHVPRRFKSNFTEGTEAVSRKKGASAGTN

SEQ ID NO: 12955 - DNA, 810 bp, Panicum virgatum
  misc_feature: Ceres CLONE 1767112
  misc_feature: Encodes the peptide sequence at SEQ ID NO. 12956
aaatcaaatcctcccccccccccccccccaaaaccaagagatccaatcgaccaagaccaccaccatgggctccgccagccgcgccgtctcctgcctctgctgcccctgcaaatgcctcgcctgcggcctcttcagctgcctctgcagcatcctcatctccctcctcgtcaccctcggcgtcctcgccctcatcttctacctcatcttccgcccccacatgatcgccgccaccgtcgactccgcctccctcgccacattcaccctctccccgacctcctcgctcgcatacaacctcaccgtcgccatgaccgtgcgcaatcccaacaagcgcgtcggcctctactacgacaacgtcgaggccctcgccttctacaaggaccagcgcttcggctacgacccgctcgacgccttctaccagggcaccgaggcctccacccagctcaagcccgagttccacggacagcagctgctgcagggggacgtcaccgccgcgcagttcaggcaggaccagaccgacggcagcttcgccatcaacgtcggcctcaacgccaagctcagggtcaaggtctgggccttcaaggtccgggggcccaaggccaggatcacctgcaagctcctcgtcccggcgccgggagccaccaacggagccaccttccagcccacagactgcaaagtctggttctgagatctgcttgcattgctgctgctttgcctgcctgctaacaactgctagctagtagttgattctttctgttcttgggtcccgtacccttaattaggcaggcatattcatttcatccatcgatattt

SEQ ID NO: 12956 - protein, 206 aa, Panicum virgatum
  misc_feature: Ceres CLONE 1767112
  misc_feature (45)..(182): Pfam Name: Hin1 Pfam Description: Harpin-induced protein 1 (Hin1)
MGSASRAVSCLCCPCKCLACGLFSCLCSILISLLVTLGVLALIFYLIFRPHMIAATVDSASLATFTLSPTSSLAYNLTVAMTVRNPNKRVGLYYDNVEALAFYKDQRFGYDPLDAFYQGTEASTQLKPEFHGQQLLQGDVTAAQFRQDQTDGSFAINVGLNAKLRVKVWAFKVRGPKARITCKLLVPAPGATNGATFQPTDCKVWF

SEQ ID NO: 12957 - DNA, 917 bp, Panicum virgatum
  misc_feature: Ceres CLONE 1767152
  misc_feature: Encodes the peptide sequence at SEQ ID NO. 12958
cacccaccaatagtttccttccatccatggcatgcatcaacaccttccagagttgctccattgccagaggggcaaagatcaacacaagagctaggggcagtgctggaaagggatcaccaacctttcagtgcagggcgtccactttcgttgacgccagcctacggcttgggctcgacgagaaccctgaggcaatcatctcaggcgagtggcctgagaacttctcccttctcagctacgatgatctccgtgcctaccttcagtcacaggagaccgtccaagaaggcaatcagcaggtagctctcttgagtgagaccatgtcaacacctgtgctagtggccacagcagagcagacgctggaggaggtggaatgccactttgaggctgtctcagggcttccagttgtagacagcagcctcagatgtgttggggtggtcgtcaagaatgaccggaacaaagcttcgcacgggccaaaaacaaagattgaagaagtaatgacctctccagccatcacaatatcatcagataaaacagtgatggatgctgcagttctgatgctcaagaagaagattcacagactaccaattgtaaatcaggataaacaagtgataggtatagttacccgtgctgatgttcttcgcgagttggaaggactgctgaagatttagaagggcagcattccatgctcggaagtcagaacttgttgtaaatatgtccatggtgtttttgagtggtagcaagcagatctataatctgtaggagtgcgctgtagaatcggtgaaaataagccaggaagagtttgagatcttgtcctcgtaaaagtagcacaccaggaaacttctcctctgtattgtactgctcgcacaaccaaatgctgtaacaagtcaaatatttccagagcaatataaatagacgtgcct

SEQ ID NO: 12958 - protein, 212 aa, Panicum virgatum
  misc_feature: Ceres CLONE 1767152
  misc_feature (95)..(207): Pfam Name: CBS Pfam Description: CBS domain pair
  misc_feature: SWISSPROT Homolog: EC 1.1.1.205 IMP dehydrogenase
MACINTFQSCSIARGAKINTRARGSAGKGSPTFQCRASTFVDASLRLGLDENPEAIISGEWPENFSLLSYDDLRAYLQSQETVQEGNQQVALLSETMSTPVLVATAEQTLEEVECHFEAVSGLPVVDSSLRCVGVVVKNDRNKASHGPKTKIEEVMTSPAITISSDKTVMDAAVLMLKKKIHRLPIVNQDKQVIGIVTRADVLRELEGLLKI

SEQ ID NO: 12959 - DNA, 684 bp, Panicum virgatum
  misc_feature: Ceres CLONE 1767185
  misc_feature: Encodes the peptide sequence at SEQ ID NO. 12960
aacgagtggccgaaaggcgataagaaacgagtgcacatgaaagcgctaccctttgacgagcaaagcactatataaacctcatctcacaaatctccaacgcaacgcctcgtacagttcatcaagtaaatccacatcagatcacacacaagctagctgcaaaaatggcgtcgacggtggcgagcctctctaccccggcgacggccttcgcggccgcggacgtggtcccgaggaggaaggccgccgaaggccgcgtctggttccccgtggcgcgccacggcagcttcgcggtgaggtcgagcgggccggggacgccgccggggatctccgacaaggtgtcggagagcatcaagaaggcggaggagacgtgcgcggacgagaaggtctccggggagtgcgcggcggcgtgggacgaggtggaggagctcagcgccgcggcgagccacgcccgggacaagctcaaggacagcagcgacccgctcgagaactactgcaaggagaaccccgagaccgacgagtgccgcatctacgacaactagagcaagcctgctgtatatatcgatctgtgtatcagcaatcaaaagaagttaaatttgttatagatatagataattaataaacgaataaaggatatttgaccgcgggtcatacatagacgtcactataaaaaatcatttaatctatgac

SEQ ID NO: 12960 - protein, 124 aa, Panicum virgatum
  misc_feature: Ceres CLONE 1767185
  misc_feature (54)..(124): Pfam Name: CP12 Pfam Description: CP12 domain
MASTVASLSTPATAFAAADVVPRRKAAEGRVWFPVARHGSFAVRSSGPGTPPGISDKVSESIKKAEETCADEKVSGECAAAWDEVEELSAAASHARDKLKDSSDPLENYCKENPETDECRIYDN

SEQ ID NO: 12961 - DNA, 959 bp, Panicum virgatum
  misc_feature: Ceres CLONE 1767206
  misc_feature: Encodes the peptide sequence at SEQ ID NO. 12962
aggcaggactggccgctagcagaggggaagcgaagcgaggagagcaatggcgtcgccgtccacgctgtctttgacgtccgccttccccttcccctcctcctcgcgccgcctcacggcatctcgccgggcgacgtctctggtcatcgtcgcccagggaaaggtcaagaagtaccgccaggtcatactgacagacgacatagaagaactaggtcggaagggggatacattgaaggtgcgagctggattctaccgcaatttcctccttcccaagggcaaggccacgcttctaaccccagaagtcctcaaggaaatgcaactcgaacaggagagaatagaagctgagaagaagcgggtcaaagaagagtcacaacaacttgctcgagtttttgaaaccatcggggctttcaagattccacgcaaaggcggaaaaggaaaacaaatctttggaagcgtcacagcacaggatgttgttgacataataaagtcacaacttaatagagatgtcgacaagaggcttgtgacagttccagaaatccgtgaaaccggggagtatgttgcagagattaagcttcacccggatgtgacagctcgagtaaggctgaatgtctatgcgaaatgagatgtgcagttactgaagcttgaatggacggtgggggtctgggggagcctgatttcgccaggtgagctcagatgcaatcaggggtcctgtccgtgagagttggctcttagagttgtgatggtcgtggtcttacgcttacacatacagttgctttggtttcgtgcagagattttgctgaaaatgccaggcgttgtggtagaaaaatggaggtctggactggttcatcctgcctgtaaagttaattttcagtttgttgatttcgtggagtgaaaactagaaaagtttgtaaaccacagttggtttgaccgcagtttgtaaaccacagttggtttgaccgcag

SEQ ID NO: 12962 - protein, 190 aa, Panicum virgatum
  misc_feature: Ceres CLONE 1767206
  misc_feature (104)..(190): Pfam Name: Ribosomal_L9_C Pfam Description: Ribosomal protein L9, C-terminal domain
  misc_feature (43)..(90): Pfam Name: Ribosomal_L9_N Pfam Description: Ribosomal protein L9, N-terminal domain
MASPSTLSLTSAFPFPSSSRRLTASRRATSLVIVAQGKVKKYRQVILTDDIEELGRKGDTLKVRAGFYRNFLLPKGKATLLTPEVLKEMQLEQERIEAEKKRVKEESQQLARVFETIGAFKIPRKGGKGKQIFGSVTAQDVVDIIKSQLNRDVDKRLVTVPEIRETGEYVAEIKLHPDVTARVRLNVYAK

SEQ ID NO: 12963 - DNA, 789 bp, Panicum virgatum
  misc_feature: Ceres CLONE 1767209
  misc_feature: Encodes the peptide sequence at SEQ ID NO. 12964
acgtggtgggagctcacccggggcctcatcccgggcgccacctacctgggcttcggcggctcctacggcgacctgctcggcaacacgttccgcctcgccgaagtcgcgctcgggcggctcggcccgcagcagaaggcggacgccgccaagaagctcgccgcgcgcgccaggctcggcctcgccggcgtcgagctcggcccgcagcagatggcggacgccgccaacgcgctcgccacgcgcgccaggggcgacctcgcctccggcaaagagcagcagcgggcgagcgaggcgctgctcgtgatcctgctgatggtgcacgaggccacgcggttcgccaccgtgtcggcgttcgtggccgcgctgatgcaccccacggcggcgatgaagaggggcaccatcaccgcgcagatgaaggagcaggtgaacgggtgggaggacctgtccaaatcgctgctccaggcggacgccgtgcggccgccgggcccgttcaagccgttcccgaagatgggggtgaggacggtggaggaggccgccgcgacgatcgggatattgctgttcgttgaggtgccgggcgggatgacggcggccacggcgctgcagctgttccatgggaactaagctccgcgtgcgccagccagtatgttgctgcttgaggcagagcatgaaccacttgttgctgtaaaactacgaataagagcggtgccgtatctgtatctcaatcacctaaaaataatgagattgatatttaatcaatgcatgtaatttgtgactgatatttaatcaaagtgt

SEQ ID NO: 12964 - protein, 205 aa, Panicum virgatum
  misc_feature: Ceres CLONE 1767209
  misc_feature (4)..(192): Pfam Name: RIP Pfam Description: Ribosome inactivating protein
  misc_feature: SWISSPROT Homolog: EC 3.2.2.22 rRNA N-glycosylase
TWWELTRGLIPGATYLGFGGSYGDLLGNTFRLAEVALGRLGPQQKADAAKKLAARARLGLAGVELGPQQMADAANALATRARGDLASGKEQQRASEALLVILLMVHEATRFATVSAFVAALMHPTAAMKRGTITAQMKEQVNGWEDLSKSLLQADAVRPPGPFKPFPKMGVRTVEEAAATIGILLFVEVPGGMTAATALQLFHGN

SEQ ID NO: 12965 - DNA, 796 bp, Panicum virgatum
  misc_feature: Ceres CLONE 1767219
  misc_feature: Encodes the peptide sequence at SEQ ID NO. 12966
cttcctacctccgccatccatcatcagtttctcccatccctgtcaaagtcaccacaaagcaaaatgggctcggagacggagacggtcaccgtggaaggcatcccgttcccggcggagatcacattcaccgccggcggcaaccctgctctgtccctcgttggtaacggcatcacggacatcgagatccacttcctgcagatcaagtacaacgccatcggcatctacctccacagcaacgacgtcctgctcgaccacctgcacggctggaagggcaagtcggccgacgagctgctcggcgacgactccttcttccaggccctcgtcgcagctcccgtggagaagctgttccgggtcgtcgtcatcaaggagatcaagggctcgcagtacggcgtgcagctcgagagctccgtgcgcgaccgcctcgtcgccgccgacaagtacgacgacgacgaggaggaggcgctcgagaagatcaccgacttcttccaggccaagtacttcaagcctggctctgtcatcaccttccacttcccggccacttcagcagctggggctgtggagatatcgttcgcgacggagggcaaagacgcggccaagatgaaggtggagaacgagaacgtggccaggatgatccagaagtggtacctcggcggcgactccgcggtgtctccgaccaccgtccggagcatggcagatcgtttcgcggcgctgctctccgccgccgcctgatcgatcgatcgattagtataatattgctgcggatgctaattacgtaataatttcctagcttccaccc

SEQ ID NO: 12966 - protein, 221 aa, Panicum virgatum
  misc_feature: Ceres CLONE 1767219
  misc_feature (3)..(218): Pfam Name: Chalcone Pfam Description: Chalcone-flavanone isomerase
  misc_feature: SWISSPROT Homolog: EC 5.5.1.6 Chalcone isomerase
MGSETETVTVEGIPFPAEITFTAGGNPALSLVGNGITDIEIHFLQIKYNAIGIYLHSNDVLLDHLHGWKGKSADELLGDDSFFQALVAAPVEKLFRVVVIKEIKGSQYGVQLESSVRDRLVAADKYDDDEEEALEKITDFFQAKYFKPGSVITFHFPATSAAGAVEISFATEGKDAAKMKVENENVARMIQKWYLGGDSAVSPTTVRSMADRFAALLSAAA

SEQ ID NO: 12967 - DNA, 466 bp, Panicum virgatum
  misc_feature: Ceres CLONE 1767226
  misc_feature: Encodes the peptide sequence at SEQ ID NO. 12968
aagagaaggctctcgggcatagctatagccagagggagcagcaacacaggcctcacctgaagctccatcagccatggcattcacgcccgccacggcctgctgcaatccctcgctgctggcggcgccccgggcgccgtcgcgcggctcgtccccccgcgcgcaggcggcgctcctcggcgcggtctccacctccgcgttccgcggcgtccgggcgcccgcggccaccgcggcggccccgcggtggagccgcgcgcccgcgtctaccggcatcgtctgcggcaaggtgaccaagggcagcgcgccctccaactccaccctccatgacctcaactggaggcccgtgtcgctgaacaagttcaagggcaagccggtggtggtctacttcaaccccgtcaaccagacgcccggatgcaccaaacaggcgtgcgcgttccgcgactcgtacgagaagtccgagaatgccgga

SEQ ID NO: 12968 - protein, 130 aa, Panicum virgatum
  misc_feature: Ceres CLONE 1767226
  misc_feature: SWISSPROT Homolog: EC 1.11.1.15 Peroxiredoxin
MAFTPATACCNPSLLAAPRAPSRGSSPRAQAALLGAVSTSAFRGVRAPAATAAAPRWSRAPASTGIVCGKVTKGSAPSNSTLHDLNWRPVSLNKFKGKPVVVYFNPVNQTPGCTKQACAFRDSYEKSENA

SEQ ID NO: 12969 - DNA, 724 bp, Panicum virgatum
  misc_feature: Ceres CLONE 1767253
  misc_feature: Encodes the peptide sequence at SEQ ID NO. 12970
tagtagtagtagggttctagccatggcgtggagcgccaccgccgtctccaggttcgccgcggcctccccggccgcggcgcccgtccccgccaggctcggcgccgccgcctcctcgctctccttcgccggggcgcgcggccgccgcttcggccccgtcgccgagtccctctcgacctccgcgactgctttaaaggaggctgttcagacagagaaggcaccggctgcactaggcccttattcccaggccatcaaagcaaacaatcttgtgtttgtttctggagttcttggcctgaatcctgagaccgggaagtttgtctctgaaagcgttgaggagcaaaccgagcagataatgaagaacatgggtgaaatattgaaagcaagtggcgctagctatgcttcagtggtgaagacaacaatcatgttggctgatctgcaggatttcaagaaagtgaacgagatctatggcaaatacttcccagctcctgcacctgcccgctcaacctatcaagtggcagcactgcccctgaacgccaggattgagatcgagtgcatcgccgctctctgagcatatcattcggccagccatcggaccatcaataagcatctcaaccctgtcgatgtagttattctatttcctgggatgcactactcataggaatttatggtaccaagtgcttagtgtcgcccatgagagatctttgtaccaattaagatcttgaaaact

SEQ ID NO: 12970 - protein, 180 aa, Panicum virgatum
  misc_feature: Ceres CLONE 1767253
  misc_feature (62)..(180): Pfam Name: Ribonuc_L-PSP Pfam Description: Endoribonuclease L-PSP
MAWSATAVSRFAAASPAAAPVPARLGAAASSLSFAGARGRRFGPVAESLSTSATALKEAVQTEKAPAALGPYSQAIKANNLVFVSGVLGLNPETGKFVSESVEEQTEQIMKNMGEILKASGASYASVVKTTIMLADLQDFKKVNEIYGKYFPAPAPARSTYQVAALPLNARIEIECIAAL

SEQ ID NO: 12971 - DNA, 879 bp, Panicum virgatum
  misc_feature: Ceres CLONE 1767276
  misc_feature: Encodes the peptide sequence at SEQ ID NO. 12972
gccgcaccctaacacggcaccaccctagtacatcggcaaggcaagtaggcggctggcggccatggcggcggcgaatgctggggacgtggaggtggtcgacttcgactccgatgacgacgacctcatggacgacgacgcccccgaggccaacccggccccggccgccccccgcctccgctccaccatcgccgccggcggggactccgccgccgcgcgcaagaccaagggccgcggattccgcgaggagccttcctcctcgcgccccctagccggccgcgccgatttcgattccctcggctccgacgacggccctggacccctcagatctattgaggggtggattattttggtaaccggcgtccatgaagaagcacaggaggatgacctacataatgctttccgggaatttgggcaggtcatgaacctgcacttgaatttagatcgtcgtactgggtttgtcaaaggatacgctttgattgaatatgaaagctttgacgaagctcaggctgcaataaaagcaatggacggaactgagcttgttacacagataataaatgttgactgggcatttagtagtggcccagtcaaacgaagaaatgttcgcaggagatctaggagccctgccaggaggaggtattgagcttgccttcaccatgtcataaggagggcttgttttgcagttcccgatttcatgagttcagtttgacgcatgatggtttgcttttgatttccatctatgtagtatgactgctgtatctaatttcctgtttcctattattttggtgtacgttggtgtttgcacaaacatgccatgagcacaaatgcctggattgtaattgcgatctgttactctgaaatggatgcttcgacttttatgcc

SEQ ID NO: 12972 - protein, 192 aa, Panicum virgatum
  misc_feature: Ceres CLONE 1767276
  misc_feature (95)..(166): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAANAGDVEVVDFDSDDDDLMDDDAPEANPAPAAPRLRSTIAAGGDSAAARKTKGRGFREEPSSSRPLAGRADFDSLGSDDGPGPLRSIEGWIILVTGVHEEAQEDDLHNAFREFGQVMNLHLNLDRRTGFVKGYALIEYESFDEAQAAIKAMDGTELVTQIINVDWAFSSGPVKRRNVRRRSRSPARRRY

SEQ ID NO: 12973 - DNA, 600 bp, Panicum virgatum
  misc_feature: Ceres CLONE 1767290
  misc_feature: Encodes the peptide sequence at SEQ ID NO. 12974
atctcgcaaaaaaatccccaaatcttcctcctcccaaatccctcgaatcctccgcgcctcgggcaagctctaggtcgtcgtcgcagcagcaaccatgtcgggccgcggcaagggaggcaagggcctgggcaagggcggcgcgaagcgccatcggaaggtgctccgcgacaacatccagggcatcacgaagccggcgatccggaggctggcgaggaggggcggcgtaaagcgcatctccgggctgatctacgaggagacccgcggcgtgctcaagatcttcctcgagaacgtcatccgcgacgccgtgacctacacggagcacgcccgccgcaagaccgtcaccgccatggacgtcgtctacgcactcaagcgccagggccgcaccctctacggcttcggcggctgagcccctggctcccgcccgcgtcctgtgtgtcgcgtgcaggcgcaagctggggttcctgatgggttagagaagttgatgtgctgggttctgtcctgtgcctagctgcgttgtggtgttaacttaatagttggtgtttatggttgtaatggtgaagtatggtagcctatcaattgaatgaatggatgttctgaggt

SEQ ID NO: 12974 - protein, 103 aa, Panicum virgatum; identical to SEQ ID NO: 12044
  misc_feature: Ceres CLONE 1767290
  misc_feature (25)..(94): Pfam Name: Histone Pfam Description: Core histone H2A/H2B/H3/H4

SEQ ID NO: 12975 - DNA, 838 bp, Panicum virgatum
  misc_feature: Ceres CLONE 1767296
  misc_feature: Encodes the peptide sequence at SEQ ID NO. 12976
cagccacagagcctgaggaagaataatccattcgccttgcttgggcctcccgtgtgcgtgcgctcgacgcagagaggcgcgggcgctcaacgccaccgccaccgccaccctccggctccgatccgatggccttcctgcggtcgcactcaaatgcatcttccggcatgggagttgctcctaacatcagggagacattcgttgagcttcagatgaagaaggcattccgatatgttatcttcaaaattgaggaaaagcaaaagcaggtggttgtcgagaagactggcgctactactgaaagctatgatgactttttggcctccctcccagaaaatgactgcagatacgctctgtatgattttgacttcgtcacgggggagaacgtgcagaaaagcaagatatttttcattgcctggtccccgtcgacttcccgcattcgtgcgaagatgttgtactccacctccaaggaccgcatcaagcatgagctcgatgggttccactacgagatccaagcaaccgacccgtcagaggtggacattgaagtcttcagggagcgggctcactgaagctggtttacctatgaagggacctgtggagggccttggaacttcagccagattcaaattctatattcaaagatgctcctgccatggtatttgttaataagttcatgtaagcatatgatttagtcgtgatgcgtgactctagctggtgaagcgctgtcgaaggtctttctgtatgagatcttgagcctgtaaacgaagcaatttgcaaactcatggtattgttgtgatgatactggttactggaactctggaagtactggttgtggattgtttgg

SEQ ID NO: 12976 - protein, 145 aa, Panicum virgatum
  misc_feature: Ceres CLONE 1767296
  misc_feature (18)..(145): Pfam Name: Cofilin_ADF Pfam Description: Cofilin/tropomyosin-type actin-binding protein
  misc_feature: Useful for making plants with modulated time to senescence
MAFLRSHSNASSGMGVAPNIRETFVELQMKKAFRYVIFKIEEKQKQVVVEKTGATTESYDDFLASLPENDCRYALYDFDFVTGENVQKSKIFFIAWSPSTSRIRAKMLYSTSKDRIKHELDGFHYEIQATDPSEVDIEVFRERAH

SEQ ID NO: 12977 - DNA, 845 bp, Panicum virgatum
  misc_feature: Ceres CLONE 1767298
  misc_feature: Encodes the peptide sequence at SEQ ID NO. 12978
gatctccttccagttccatccccttcctccctgcccttcttcttcctcccatctcgcgaggctcgaggaggtgacggcggcggcgatggtggacgtctcgcgcgtgcagaaggagctcaccgagtgcaaccgcgaccgggaggtctcgggcgtctccatcgcgctgcacgacggcgccaacatctcccacctcaccggcaccatcgccgggcccgccgacagcccctacgagggcggcaccttcgtcatcgacatccgcctacccggtggatatccctttgaacctccaaagatgcagttcgtcactaaagtatggcatcctaacatcagcagccaaaacggagcaatttgcttggacattctgaaagatcagtggagcccagctcttactctgaagactgcgttgctttctcttcaagctctgctttcttctcctgcacctgatgatcctcaggatgctgtcgttgcacaacagtacctgcgtgattatccaacattcgctgctacagctcgctactggacagaggccttcgcaaagagcacgtccactggcatggaagagaaggtgcagaagctggttgagatgggcttcccagagaatctggtgagaagtaccctgaagagtgtcgatggtgatgagaacatggctctcgaaaagctctgctctggctgaaccacccttatggtggatatatgaactgtaaattgcatcctcattggttattatattatataagagaacaatgcctgctaatgcccctgctctgccatttcagtgtggccatttatggagacaatttatataggggattggaccatggggctcgtgaaaaccgccttatgat

SEQ ID NO: 12978 - protein, 195 aa, Panicum virgatum
  misc_feature: Ceres CLONE 1767298
  misc_feature (6)..(146): Pfam Name: UQ_con Pfam Description: Ubiquitin-conjugating enzyme
  misc_feature (156)..(192): Pfam Name: UBA Pfam Description: UBA/TS-N domain
  misc_feature: SWISSPROT Homolog: EC 6.3.2.19 Ubiquitin--protein ligase
MVDVSRVQKELTECNRDREVSGVSIALHDGANISHLTGTIAGPADSPYEGGTFVIDIRLPGGYPFEPPKMQFVTKVWHPNISSQNGAICLDILKDQWSPALTLKTALLSLQALLSSPAPDDPQDAVVAQQYLRDYPTFAATARYWTEAFAKSTSTGMEEKVQKLVEMGFPENLVRSTLKSVDGDENMALEKLCSG

SEQ ID NO: 12979 - DNA, 768 bp, Panicum virgatum
  misc_feature: Ceres CLONE 1767306
  misc_feature: Encodes the peptide sequence at SEQ ID NO. 12980
acagcagctcaaagcagcagagtactctttctctgctccttcagcttctccgcaggcctctgcaggcgcgaggaagaagcagcagcgcagaaggcgatcgccatggctcagggaaggggcagtgcgacgacccggtgcctcgccgtcggcggcctgctcgccgtgtgcctcctcctcggcgccgccgacgcggccacccacagggtcgactggtcgttcaacgcggacagctggtcccggggcaagagcttccgcgccggggacgtcctcgagttcaactacgacccctccgtgcacaacgtggtagccgtggacgccggcggctactccggctgcggcttctccggcagggcatacagctccgggagcgaccgcatcacgatcggctccgggaccagctacttcatctgcagcctcaacgggcactgcgggatggggatgaagatggccgtccacgccagctgaaggctgaagcccccccgctgcttgcagagcaccaataataagcgatgcgtgtcactggcggtccggtcgtgcaacaactcaatcgttttggcagcgccgatacaggtctcatgtgtcatgtatgtgtgtagtggagtggtagttgaggcatggtgtgtgtatggttactggcagggcagtgaagcgttactcagcttttgttgtttgtttgaactttcatgaagcagtagcctcttttctttgtttcattcgtcaggaatttgacatggattttcgccacaaggacccaaatatcccattgcg

SEQ ID NO: 12980 - protein, 120 aa, Panicum virgatum
  misc_feature: Ceres CLONE 1767306
  misc_feature (37)..(113): Pfam Name: Cu_bind_like Pfam Description: Plastocyanin-like domain
MAQGRGSATTRCLAVGGLLAVCLLLGAADAATHRVDWSFNADSWSRGKSFRAGDVLEFNYDPSVHNVVAVDAGGYSGCGFSGRAYSSGSDRITIGSGTSYFICSLNGHCGMGMKMAVHAS

SEQ ID NO: 12981 - DNA, 797 bp, Panicum virgatum
  misc_feature: Ceres CLONE 1767315
  misc_feature: Encodes the peptide sequence at SEQ ID NO. 12982
agacaaatcctatcctcctccacctagtcaccacagtcgtctctccctgcgccgcgtgagctgccaacgatggcccttgagacgtgcttcagagcgtgggcgctgcacgccgcccctgccggcggcaaggacaggctcgccgtcggcggcggcggcagcagcttcgcgccgtccaagcgggccgccgccgccgccgcgccgctgtccgtcggccgcgtcgccacgcggcggccccggcacgtctgccagtccaagaacgccgtcgacgaagtgctggtggcggatgagaagaactgggacgggatggtgatggcgtgcgagacaccggtgctggtggagttctgggcgccgtggtgcgggccctgccggatgatcgcgccgttgattgacgagctggccaaggactacgccggcaagatcaagtgctgcaaggtgaacacggacgactgccccaacgtcgcctccacctacggcatccgcagcatccccaccgtgctcatcttcaaggccggcgagaagaaggagagcgtcatcggcgccgtgcccaagaccacgctcaccaccatcatcgacaagtacatcggcagctcgtgatcgagccaactggggttgatgggtgatgttgttgttggagatgaactaaatacatacgtgtccgtgctcgcgcatacacaccatgtatctcttgttgcgatgatgcgataactcaggcagccgtctgctcctgctcccttatactatgtcgaatccaactccattaattagtttccagtgcatgatttcacagtgaatattat

SEQ ID NO: 12982 - protein, 174 aa, Panicum virgatum; identical to SEQ ID NO: 10152
  misc_feature: Ceres CLONE 1767315
  misc_feature (67)..(170): Pfam Name: Thioredoxin Pfam Description: Thioredoxin
  misc_feature: SWISSPROT Homolog: EC 1.8.1.8 Protein-disulfide reductase
  misc_feature: Useful for making plants with modulated heat sensitivity

SEQ ID NO: 12983 - DNA, 742 bp, Panicum virgatum
  misc_feature: Ceres CLONE 1767336
  misc_feature: Encodes the peptide sequence at SEQ ID NO. 12984
atcaccaaacgctccaaaccaatctcgcgatcgagagagagcaactcggcgtggtcgtcgtacatagcaccgtagcaagcagcgcgatggcatcggcgggttccggcgacgagacggcggccgcggccacgatcacgctcatcagctcggacggcgtgtacttcacggtgctggaggcggcggcgaacctgtccgagaccatccaacacatgatcgaggacggctgcaccgacggcggcatcccgctccccaacgtcaccggcagcatcctcgccaaggtcctcgagtactgcaacaagcacgccgccgcgagcgccggcggcgaaggctcgtcctcgtcgtcggacaaggaggagctggacaagttcgacaaggcgttcgtggaggtcgaccaggccacgctgttcgacctcatcctggccgccaactacctcaacgtcaaggggatgctggacctcacctgccagacggtcgccgacatgatgaagggaaagtcggtggaggagatcaggcagacgttcaacatcaagaacgacttcacgccggaggaggaggcggagattcgcaaggagaatcagtgggccttcgacgattagatttagatttagaggccgcacgctcaagttcattatgttttattagcccgtcaggttgcttctttaaaatagttattataattgtttgcttcttaatgtactaggtataataacggattaatatcagtcataattcttctaccctc

SEQ ID NO: 12984 - protein, 169 aa, Panicum virgatum
  misc_feature: Ceres CLONE 1767336
  misc_feature (91)..(168): Pfam Name: Skp1 Pfam Description: Skp1 family, dimerisation domain
  misc_feature (14)..(74): Pfam Name: Skp1_POZ Pfam Description: Skp1 family, tetramerisation domain
MASAGSGDETAAAATITLISSDGVYFTVLEAAANLSETIQHMIEDGCTDGGIPLPNVTGSILAKVLEYCNKHAAASAGGEGSSSSSDKEELDKFDKAFVEVDQATLFDLILAANYLNVKGMLDLTCQTVADMMKGKSVEEIRQTFNIKNDFTPEEEAEIRKENQWAFDD

SEQ ID NO: 12985 - DNA, 788 bp, Panicum virgatum
  misc_feature: Ceres CLONE 1767374
  misc_feature: Encodes the peptide sequence at SEQ ID NO. 12986
atttagcagctcaccacaagaggtttagaaatggcggtcaagtttgtagttcttcttggtgttgtgctggcctttctcctcgtctcccaggatttggcctgtgctagagagctcactgaaaccaatgagtcgtctaaaggaaaagatgtaaagcccgctggaggagtgcctggactcaaggatgaaaagtggggaggtggatacaatggaggatatggcaacggcggtggttacggtggaggttatggtggtggtggcgggtacggtggtggctatgggcctagatatggtggaggataccaccatggccacggaggaggctatgggcccggatatggtggaggatatggatctggacatggtggtgggtatggtggccctggatacggtggtggatatggtcagcctgggtatggcggaggatatggcggtggctacggtggtggctatggaggaggatatggtagtggcggcgggtatggtggaggtgggggctatggaggtggatacggagggggtggcggacaccgtggtggatggaattaagggacagagctatgtatgtctctctacgtcaaataagaaacgcgtcatgatgatatatggtataaaacatggtgatggacatattgtcgatgggatcttgtcttgcatgaagtgtgataataagagctaggcagctagccatgtctggcggtgtgcacagctggcttttagaactggtacctcatccagtatggacctatgtatacatataaataaatgactatcctgtaaagttgtgtatc

SEQ ID NO: 12986 - protein, 171 aa, Panicum virgatum
  misc_feature: Ceres CLONE 1767374
  misc_feature (1)..(164): Pfam Name: GRP Pfam Description: Glycine rich protein family
  misc_feature: Useful for making plants with modulated nitrogen use efficiency
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with altered lignin content 220>
  misc_feature: Useful for making plants with altered alkaloid content
  misc_feature: Useful for making plants with altered terpenoid content
MAVKFVVLLGVVLAFLLVSQDLACARELTETNESSKGKDVKPAGGVPGLKDEKWGGGYNGGYGNGGGYGGGYGGGGGYGGGYGPRYGGGYHHGHGGGYGPGYGGGYGSGHGGGYGGPGYGGGYGQPGYGGGYGGGYGGGYGGGYGSGGGYGGGGGYGGGYGGGGGHRGGWN

SEQ ID NO: 12987 - DNA, 833 bp, Panicum virgatum
  misc_feature: Ceres CLONE 1767389
  misc_feature: Encodes the peptide sequence at SEQ ID NO. 12988
attccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatataattaaaccctacgtcgtgcgtgctatagctatagctatagctatactatacttaattggtttgcaattcagctatatgcataatgcatgctagctgtggctatttatatctggtttatttgcaattgatcgagctattttttttgtgttaatgtttcagctccatataaataatgtaatgtttaaatgatatgcttgtctatgaaatattgaaataaaacttaatttgtactgccatattt

SEQ ID NO: 12988 - protein, 149 aa, Panicum virgatum; identical to SEQ ID NO: 10105
  misc_feature: Ceres CLONE 1767389
  misc_feature (58)..(133): Pfam Name: Fer2 Pfam Description: 2Fe-2S iron-sulfur cluster binding domain

SEQ ID NO: 12989 - DNA, 790 bp, Panicum virgatum
  misc_feature: Ceres CLONE 1767392
  misc_feature: Encodes the peptide sequence at SEQ ID NO. 12990
acatcaagaatccagccaacagaagcatcaagctggtagctagcaaaaatcaggcgacgcggatagatacaactaacccatggcggcgtcgcacctcgcagcgcttctgatcctcgccgccgccgtcctgtccggcgccccggtggcgcgcggccaggcggcgtcggtgccggcgccggcccctgcggcgccgaagacgatcacggccatcctgagcaaggccgggcagttcaccaagttcctccagctgttgcagtcgacgcgggaggcagagcagatcaccaaccagctcaagggaaagtcgtcgagcggcgggctcacggtgttcgcgccgccggacaacgccttcacggcgctccccgtcggcacgctcaactccctctccgaccagcagaagacgtcgctggtgcagttccacgtcgtgtccatggtgatgccggcctcgcagctcgagaccgtcagcaacccgctgcggacgcaggccggggacaccggccccggcaagtacccgctcaacatcacggcggacggcaccaacgtcaacgtctccaccggggtcgtcaacgccacgctcgacggcacgccgctctacgccggggacaggctcgtcgtgtaccaggtcaacaaggtgctgctgccctgggcgctctacgggccggcgctgccgcccgcgccggcgccggcgccggcggagagcaagaagaagaagaaggccgcgccggacgcggcggcggatgcgccggcggcggactccgcggcggggacgacggcgtcggaggccgcgcggagg

SEQ ID NO: 12990 - protein, 236 aa, Panicum virgatum
  misc_feature: Ceres CLONE 1767392
  misc_feature (50)..(187): Pfam Name: Fasciclin Pfam Description: Fasciclin domain
  misc_feature: Useful for making plants with altered carbohydrate content
  misc_feature: Useful for making plants with altered cell wall content and/or composition
MAASHLAALLILAAAVLSGAPVARGQAASVPAPAPAAPKTITAILSKAGQFTKFLQLLQSTREAEQITNQLKGKSSSGGLTVFAPPDNAFTALPVGTLNSLSDQQKTSLVQFHVVSMVMPASQLETVSNPLRTQAGDTGPGKYPLNITADGTNVNVSTGVVNATLDGTPLYAGDRLVVYQVNKVLLPWALYGPALPPAPAPAPAESKKKKKAAPDAAADAPAADSAAGTTASEAAR

SEQ ID NO: 12991 - DNA, 717 bp, Panicum virgatum
  misc_feature: Ceres CLONE 1767400
  misc_feature: Encodes the peptide sequence at SEQ ID NO. 12992
attgcactacaacacctatgcgttcttcatcgatttggcacagccatcatctagctaggagctcacaattaagttcaaccccgggcagctatatggcggcgatcaccggtggaagggcggcgctcgcggtggccgcgctcctctgcgccatggcggcgatggccgctgcgcagcaggcctccaacgtgcgcccgacgtaccacctgtacaacccggcgcaaaacggctgggacctcaaccgcgtcagcgcctactgtgccacgtgggacgccaacaagccgctgtcgtggcggcagaagtacggctggaccgccttctgtgggccctcgggccctaggggccaggcctcctgcggcaagtgcatcaaggtgacgaatcgtgcgacaggcgcgtcgaccgtggcgaggatcgtggaccagtgcagcaatggtggcctggacctggacttcgagacggtgttcaagaagattgacaccaacgggcagggctaccagatgggccacctaaacgtcgactaccagttcgtctcctgctgagtgagctcgcacacgcacgaaccgggggggagaatccggacggatgtaataataataagccacgcctagctagatgtgtggtgtgatggaataaaagggaaagagatcggatgatggtagctagtaatacagaataagcgaaaccgcattggactaaataaagcggatactgactcgtgat

SEQ ID NO: 12992 - protein, 147 aa, Panicum virgatum
  misc_feature: Ceres CLONE 1767400
  misc_feature (28)..(147): Pfam Name: Barwin Pfam Description: Barwin family
MAAITGGRAALAVAALLCAMAAMAAAQQASNVRPTYHLYNPAQNGWDLNRVSAYCATWDANKPLSWRQKYGWTAFCGPSGPRGQASCGKCIKVTNRATGASTVARIVDQCSNGGLDLDFETVFKKIDTNGQGYQMGHLNVDYQFVSC

SEQ ID NO: 12993 - DNA, 769 bp, Panicum virgatum
  misc_feature: Ceres CLONE 1767401
  misc_feature: Encodes the peptide sequence at SEQ ID NO. 12994
aacaacgctatctcatcgagacaaaaatatcccccacccacgacgagcgccagcagcagcagcagcagcagccatggggatagccgtggtggctcccgtcgcggcggcctcctcctcctacctcggggcgccgccgaggcgcgccgcggcgccggcgcgcgcccacgtcgcggcggccgggatgtccgcgagggcgtcttccttcgtcgggaccgggctcgcgggggcggccgcgtcggtggccgcgcggccgaggaggagggccggctcggggggcggcggggcgctcgggtgcaagtgcctgttcgggctcggggtacctgagctcgcggttatcgccggcgtcgccgcgctcgtgttcgggcccaagcagctccccgagatcggccgcaacatcggcaagaccgtcaagagcttccagcaggcggctaaggagtttgaaactgaactgaagaaagagcctggggaaggcggcgacgagcccccgcctgcaacccccatggcggtaggcgatggggaggagaaaaagggggcttgaggcatcgtctagtaacaaggagcacacgaggatccatcttgttagcgttctgtatgtacaactgtattctgggcttctggagttagcagcaaatgcctgcccgtttattttggtcaccttgcagtttcaggccacatagcgatattgtttgtagttttgtacccgggaagaacaacttttctgtgaaagatgtcgtgttattcaataaatatgaggcttaccttgagcatt

SEQ ID NO: 12994 - protein, 154 aa, Panicum virgatum
  misc_feature: Ceres CLONE 1767401
  misc_feature (80)..(132): Pfam Name: MttA_Hcf106 Pfam Description: mttA/Hcf106 family
MGIAVVAPVAAASSSYLGAPPRRAAAPARAHVAAAGMSARASSFVGTGLAGAAASVAARPRRRAGSGGGGALGCKCLFGLGVPELAVIAGVAALVFGPKQLPEIGRNIGKTVKSFQQAAKEFETELKKEPGEGGDEPPPATPMAVGDGEEKKGA

SEQ ID NO: 12995 - DNA, 799 bp, Panicum virgatum
  misc_feature: Ceres CLONE 1767407
  misc_feature: Encodes the peptide sequence at SEQ ID NO. 12996
gagaggggaaaaaaaaggagaggccgagaagccgcttcagctagccgtcgtagcgataagggtagctgccccgagctagctggtgctccggcatgatggcggccacggcgtactccgtggcgctcctcggcggcgcgcgcctccccgccgccccgcgctccgccgccctcctcccgcgccgcagcgcctgccagctccgcctccaagatgcaccgaggctctccctgctccgcgtgaaggccgcctccgaggacacctcggcctccgccgacgagctcatcgaggacctcaaagccaagtgggacgccgttgaggacaaacccaccgtgctcctgtacggcggcggcgccatcgtcgcgctctggctgacgtccgtggtcgtcggcgccatcaacgccgtgcctctgctacccaagatcatggagctcgttggcctcggctacaccggctggttcgtctaccgctacctcctcttcaaggaaagccggaaagagttggctagcgacattgagaccttgaagaaaaagatcaccggaacagaataaacgcacgctcttggagagttttgagtggttctttcatcttgggggagaaaatatgtaatgggagaaccgtctgcttgagtactactgccgatgtgtgctatatatctggatacaaaggaagctttgttatgttgtgcagtaacattgtagtttaaatatatcgctctaccagtttgtttaatttctctcttcctttagcaaaatggtgagtacatattacacaaaatacataaaccatgacaactgcttgtgtt

SEQ ID NO: 12996 - protein, 149 aa, Panicum virgatum
  misc_feature: Ceres CLONE 1767407
  misc_feature: SWISSPROT Homolog: EC 6.1.1.9 Valine--tRNA ligase
MAATAYSVALLGGARLPAAPRSAALLPRRSACQLRLQDAPRLSLLRVKAASEDTSASADELIEDLKAKWDAVEDKPTVLLYGGGAIVALWLTSVVVGAINAVPLLPKIMELVGLGYTGWFVYRYLLFKESRKELASDIETLKKKITGTE

SEQ ID NO: 12997 - DNA, 742 bp, Panicum virgatum
  misc_feature: Ceres CLONE 1767410
  misc_feature: Encodes the peptide sequence at SEQ ID NO. 12998
atccacgggcggtgggcgatggccgccgtgctgggcatcttcgtcgggcaggcgtggagcggcatcccgtggttcgaggccggcgccgacccgggcgccatcgcgcccttctccttcggttcgctcctgggcacgcagctgctgctgatggggtgggtggagtcgaagcggtgggtggacttcttcaacccggactcgcaggccgtcgagtgggccaccccctggtcgcgcaccgccgagaacttcgccggcaccatcaaggacggcgtctacatccccgacaccgacaagctcgagcggctcaagctcgccgagatcaagcacgcccgcctcgccatgctcgccatgctcatcttctacttcgaggccggccagggcaagacgccgctcggcgcgctcggcctataatctgccgccgacggtgccgcgtgtacttgtacgcatcgatagattcgaccacgattgcgcgcgtggtgactggtgagggacgttaaggctgcgcatcagatcggtcaggcgcaagcgtcaatggacattgcattggatcggttggattattggaggggaaagaagagcgcgtagcaacaaatgtatctctgttcgtggcttcttttgggtggtgtgcgtcaatcgaatggggagttttttttctttcaatttcgtatgtaccatgtaatgtatagtctgcatcgatctctgtaataaggcaggataaagtgaggacatttccttgatctcttag

SEQ ID NO: 12998 - protein, 135 aa, Panicum virgatum
  misc_feature: Ceres CLONE 1767410
  misc_feature (1)..(124): Pfam Name: Chloroa_b-bind Pfam Description: Chlorophyll A-B binding protein
IHGRWAMAAVLGIFVGQAWSGIPWFEAGADPGAIAPFSFGSLLGTQLLLMGWVESKRWVDFFNPDSQAVEWATPWSRTAENFAGTIKDGVYIPDTDKLERLKLAEIKHARLAMLAMLIFYFEAGQGKTPLGALGL

SEQ ID NO: 12999 - DNA, 763 bp, Panicum virgatum
  misc_feature: Ceres CLONE 1767464
  misc_feature: Encodes the peptide sequence at SEQ ID NO. 13000
ttaaagaatccgattctccacgccctgcaatttttgcaatgtccaatccaactactaaagctgaatgtacacctgaggatgtattcaagcatgttggggagaatgcgatatttgctagtggaagccctttcagtaacgtttctttaggaaatggtaagaccggctatgctaatcaagcaaacaacatgtatctatttcctgggattggtttaggagctctcctttcaggtgctcggcacatttcagatgacatgcttcaagcaggagctgagtgcctggcatcatacatcatttttgatgaaattcaaaaaggaatcctcttccctgaagtctccagtataaggcacatcaccgcacgtgtcggcgcagcagttgtccgtgccgccgttgctgaagacctagctgaggggtgccgcactgtgggtcctaaggagcttgggagcatgtcagagtcgcaaacggtggagtacgtcgctcggaatatgtggtaccctatttacagcccccttgtgaacaacaaataaatcgggaaaatcacacgggctgcacggaagcagatgcccatgacattccatacgaaggaatgtatcagacctaggcatttgttttggcttcttgttatcactaaagaatgctcaattttgagatccgttgatcttcatactgccacagtaagtgtacttatcatgattattgtaataagcatcagacactggagcttctagttctttccatcctgaaaataaatgtcatgaaatcagag

SEQ ID NO: 13000 - protein, 173 aa, Panicum virgatum
  misc_feature: Ceres CLONE 1767464
  misc_feature (1)..(129): Pfam Name: Malic_M Pfam Description: Malic enzyme, NAD binding domain
  misc_feature: SWISSPROT Homolog: EC 1.1.1.39 Malate dehydrogenase (decarboxylating)
KESDSPRPAIFAMSNPTTKAECTPEDVFKHVGENAIFASGSPFSNVSLGNGKTGYANQANNMYLFPGIGLGALLSGARHISDDMLQAGAECLASYIIFDEIQKGILFPEVSSIRHITARVGAAVVRAAVAEDLAEGCRTVGPKELGSMSESQTVEYVARNMWYPIYSPLVNNK

SEQ ID NO: 13001 - DNA, 601 bp, Panicum virgatum
  misc_feature: Ceres CLONE 1767488
  misc_feature: Encodes the peptide sequence at SEQ ID NO. 13002
  misc_feature (52)..(52): n is a, c, t, g, unknown, or other
attcagctgagtgtgctcgatcatctagcaaacaacaaagccccccaagcancccggcaacagatcatcttccttcttccaaaatgtcttgcagctgcggatcaagctgcaactgcggctccaactgcaagtgcggcaagatgtaccctgaccttgaggagaagagcagcggcggcgctcaggccaccatcgtcctcggcgtggccccggagaagaaggccggccagttcgaggcggcggcggagtccggcgagaccgcccacgcctgcaagtgcgataacagctgcagctgcgacccctgcaactgctgatttcgatttttaacgtcagaacacacctgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtgtctgtatgtgttgatcattgcaaagaaaccatgcaggcatacatctctgcatgtgtctctgtaatgatcggtccagagtgatgaatatataaaact

SEQ ID NO: 13002 - protein, 75 aa, Panicum virgatum
  misc_feature: Ceres CLONE 1767488
  misc_feature (1)..(75): Pfam Name: Metallothio_2 Pfam Description: Metallothionein
MSCSCGSSCNCGSNCKCGKMYPDLEEKSSGGAQATIVLGVAPEKKAGQFEAAAESGETAHACKCDNSCSCDPCNC

SEQ ID NO: 13003 - DNA, 808 bp, Panicum virgatum
  misc_feature: Ceres CLONE 1767511
  misc_feature: Encodes the peptide sequence at SEQ ID NO. 13004
atgaactgctgaagcttaatggccttggtttgaattccaaggagggtatggttgtttcttctgctgacgatgatgcttgggagactgttggacgaattaacaaatctgcaatagttagaactccgagttttgttccctccgaactaagttctatttttggggggcaactacagagtgttgtgaaagctgcaggtaacaaagcatcagctacagttgagcccttcctacttctccatcttgatatattcccagatgctgttcagacactgaacgatgcacttcatcttttctctactcctgagtctttagaaggatatttatcagctgctggaaagggtagaaaatatgaacttgttgcgaccatcactcatcatgggagggacccatacagggggcactacactgctcatgcaaagcatgccaacggccagtggcttcgatttgacgatgatgctgtcgcccctgtgggccagaacgaggtcttgcatgaccaagcatatatcctgttctaccagcaagtctgaaagtaccacgcagttgattaatagcccttattgctgctgcaagcatgattaacctgtttggaaagcttcaaatcatttcggtttcatggtggcatggccctgtcatggagtcctggcccttgaatccaacatgtcaaggaaggtgtgaagtgaatacgctttcatctgacatgaagtattgttttgagaaaagtctttgttctgattcatacacacttgttatgtccactgtagtatttccacttctattattaggagttgttgaaacaaatgtttcacaagcc

SEQ ID NO: 13004 - protein, 173 aa, Panicum virgatum
  misc_feature: Ceres CLONE 1767511
  misc_feature (3)..(170): Pfam Name: UCH Pfam Description: Ubiquitin carboxyl-terminal hydrolase
  misc_feature: SWISSPROT Homolog: EC 3.1.2.15 Ubiquitin thiolesterase
ELLKLNGLGLNSKEGMVVSSADDDAWETVGRINKSAIVRTPSFVPSELSSIFGGQLQSVVKAAGNKASATVEPFLLLHLDIFPDAVQTLNDALHLFSTPESLEGYLSAAGKGRKYELVATITHHGRDPYRGHYTAHAKHANGQWLRFDDDAVAPVGQNEVLHDQAYILFYQQV

SEQ ID NO: 13005 - DNA, 551 bp, Panicum virgatum
  misc_feature: Ceres CLONE 1767512
  misc_feature: Encodes the peptide sequence at SEQ ID NO. 13006
aacaaggcctcttcgctctcccactcttgtcatcccggcggcggcggcggcgcggaagcggaagcaggaggagcagcagtaggcggagccgaagatcagcaaaccaccccagctcgcgaccatggctgctgtgccagtcaaccctaaacccttcttgaacaacctaacagggaagcctgtaattgtcaaacttaagtggggtatggagtacaaaggttatcttgtttctgtggactcctacataaatcttcagcttgctaacacagaggagtacattgatgggcaattctctgggaacctgggagagattttgatcaggtgcaacaatgttctgtacctccgaggtgttccagaggatgctcagatagatgatgcggactgagaagacttgaacggtgcttagatggattgatcattgatgtaattttattctgacgtgtgtttgggtgtgccggggacaacctattctgccggggacccacgaccgtctttgtgtcgcttgctaccatgtacttacaaatgcaaatgcagacatcttgggcgtgtttgat

SEQ ID NO: 13006 - protein, 86 aa, Panicum virgatum
  misc_feature: Ceres CLONE 1767512
  misc_feature (10)..(75): Pfam Name: LSM Pfam Description: LSM domain
MAAVPVNPKPFLNNLTGKPVIVKLKWGMEYKGYLVSVDSYINLQLANTEEYIDGQFSGNLGEILIRCNNVLYLRGVPEDAQIDDAD

SEQ ID NO: 13007 - DNA, 640 bp, Panicum virgatum
  misc_feature: Ceres CLONE 1767531
  misc_feature: Encodes the peptide sequence at SEQ ID NO. 13008
gtctacccgccgccagcacgactcctccttcccgcttgaacagcttttccgcttcctctcggtagtctccggcgccggcgagctccttcaccggcatccctcccccttccttctgcgcgcttcattttcctcgtcgtcgggctccccgcctccgcagccacagaaccgaagcggcgtcgatgggaggcgaggccacgagtgccggcggcgggggtttccgcgcgcggatggagcactacctgtacagtggagagaagaagcacgtcctcgccggcatcgccatcttcgccgccgtcttcggcgtcccgtggtacttcatgacccgaggagcaaagcatgaatctcatcaagattacatggaaagggctaacaaggcgaggtcggagaggctttcttctggacagccatcggcactgaaagaatgaagtagtagtgcctattctggcccctgacgtctagagctcagcatactcttttttgtttgtaatcagaggattttggtctattgtgaaataagcagatatctttcttatctcgctagatgtagaaaattggtgtaatacccaccagaaaatttgtctactggagcctacgtttccgtctgatattctcgagggcatgacccatacagaagtcttgc

SEQ ID NO: 13008 - protein, 81 aa, Panicum virgatum
  misc_feature: Ceres CLONE 1767531
  misc_feature: Useful for making plants with modulated biomass
MGGEATSAGGGGFRARMEHYLYSGEKKHVLAGIAIFAAVFGVPWYFMTRGAKHESHQDYMERANKARSERLSSGQPSALKE

SEQ ID NO: 13009 - DNA, 514 bp, Panicum virgatum
  misc_feature: Ceres CLONE 1767551
  misc_feature: Encodes the peptide sequence at SEQ ID NO. 13010
ctcctccgccgtcgcctctccactttccccatcctgcgccgacgtcgcggtcgcctcgcagtccgaagagcccccgactccgatggccagccgctgggtccgacccgaggtgtacccgctgttcgcggcgatgggcgtggccgtcggcatctgcggatttcagctcttccggaacatcaccggcaacccggaagtcagggtaaacaaggcagggagggcagctggtgtgcttgagaatcatgaggaggggaggcgttacgcaatgcacagcctcagaagctttgtgcatgacaagacccctgaaataatgccatccatcaacaagttcttcactgagccgaagtgaagcgatttgctcgggtgctgctgctggagtcactattgtctagttcctattaaggcattcaatgtcatgtcatccataaattggaggacagcagatacctcttattaaaagtaccttatgagtgattggtgatggcttggtatgtgtatggtttatgagtgttgcatc

SEQ ID NO: 13010 - protein, 87 aa, Panicum virgatum
  misc_feature: Ceres CLONE 1767551
  misc_feature (2)..(87): Pfam Name: B12D Pfam Description: B12D protein
MASRWVRPEVYPLFAAMGVAVGICGFQLFRNITGNPEVRVNKAGRAAGVLENHEEGRRYAMHSLRSFVHDKTPEIMPSINKFFTEPK

SEQ ID NO: 13011 - DNA, 777 bp, Panicum virgatum
  misc_feature: Ceres CLONE 1767560
  misc_feature: Encodes the peptide sequence at SEQ ID NO. 13012
tcctgggcgccctcaggctcgctccgtctccgcccgccctcgccggcgccgcgccgccggcgacgcctgcgcgctcctccgtgcacttccacctcgccaatgccggcgccgccgccctcgtcgccgcctcgctcctcgtcgccgacccgtccctcgcattcataggaggaggcccgtacgggaagcaggtgacgcgggggcaggacctcaccggcaaggacttcagcggccagaccctcgtcaagcaggacttcaagacgtctatactgaggcaggccaacttcaagggcgcgaacctgctcggcgcgagcttcttcgatgcagacctcacaagtgctgatctctctgatgctgatcttagaggcaccgatttctcgctggcaaatttatcaaaggcaaatttaacaaatgccaacttggaaggggcattggtcacaggaaacacttctttcaaaggcgctaacataactggggcagattttaccgatgtcccactgcgagacgaccaacgggaatacctgtgcaaaatcgctgatggagtgaactcaaccactgggaacgccacaaaggaaactctgttctgcagctgaccgacgaggctactgcgctagcggctcattgagactgattttagcgactgatcaatcatatgcctatcgattttcgagagcacacgaggattgtaaattgggttatagagaagagatgctgctgcaagtatttgctggtaattacatagaatcaacgaaaataaagcccgcgttacttgatgtaatt

SEQ ID NO: 13012 - protein, 195 aa, Panicum virgatum
  misc_feature: Ceres CLONE 1767560
  misc_feature (87)..(126): Pfam Name: Pentapeptide Pfam Description: Pentapeptide repeats (8 copies)
  misc_feature (127)..(167): Pfam Name: Pentapeptide Pfam Description: Pentapeptide repeats (8 copies)
  misc_feature: SWISSPROT Homolog: EC 2.7.11.1 Non-specific serine/threonine protein kinase
LGALRLAPSPPALAGAAPPATPARSSVHFHLANAGAAALVAASLLVADPSLAFIGGGPYGKQVTRGQDLTGKDFSGQTLVKQDFKTSILRQANFKGANLLGASFFDADLTSADLSDADLRGTDFSLANLSKANLTNANLEGALVTGNTSFKGANITGADFTDVPLRDDQREYLCKIADGVNSTTGNATKETLFCS

SEQ ID NO: 13013 - DNA, 749 bp, Panicum virgatum
  misc_feature: Ceres CLONE 1767594
  misc_feature: Encodes the peptide sequence at SEQ ID NO. 13014
atcgagacaaaaatatcccccacccacgacgagcgccagcagcagcagcagccatggggatagccgtggtggttcccgtcgcggcggcctcctcctcctacctcggggcgccgccgaggcgcgccgcggcgccggcgcgcgcccacgtcgcagcggccgggatgtccgcgagggcgtcttccttcgtcgggaccgggctcgcgggggcggccgcgtcggtggccgcgcggccgaggaggagggccggctcggggggcggcggggcgctcgggtgcaagtgcctgttcgggctcggggtgcctgagctcgcggttatcgccggcgtcgccgcgctcgtgttcgggcccaagcagctccccgagatcggccgcaacatcggcaagaccgtcaagagcttccagcaggcggctaaggagtttgaaactgaactgaagaaagagcctggggaaggcggcgacgagcccccgcctgcaacccccatggcggtaggcgatggggaggagaaaaagggggcttgaggcatcgtctagtagcaaggagcacacgaggatccatcttgttagcgttctgtatgtacaactgtattctgggcttctggagttagcagcaaatgcctgcccgtttattttggtcaccttgcagtttcaggccacatagcgatattgtttgtagttttgtacccgggaagaacaacttttctgtgaaagatgtcgtgttattcaataaatatgaggcttaccttgagcatt

SEQ ID NO: 13014 - protein, 154 aa, Panicum virgatum
  misc_feature: Ceres CLONE 1767594
  misc_feature (80)..(132): Pfam Name: MttA_Hcf106 Pfam Description: mttA/Hcf106 family
MGIAVVVPVAAASSSYLGAPPRRAAAPARAHVAAAGMSARASSFVGTGLAGAAASVAARPRRRAGSGGGGALGCKCLFGLGVPELAVIAGVAALVFGPKQLPEIGRNIGKTVKSFQQAAKEFETELKKEPGEGGDEPPPATPMAVGDGEEKKGA

SEQ ID NO: 13015 - DNA, 580 bp, Panicum virgatum
  misc_feature: Ceres CLONE 1767601
  misc_feature: Encodes the peptide sequence at SEQ ID NO. 13016
attcccctgagcgccgctcgatcatctcacaagcaaccaagccccccaagaaaacgaccaggagaacaggcacccgccaccaagacggcgggcagcatctgatcaagctgcaactgcggctcccactgcaagtgcggcaagatgtaccctgaccttgaggagaagagcagcggcagccctcaggccaccatcgtcctcggcgtggccccggagaacaagactggccagttcgaggcggcagcggagtccggcgagaccgcccacgcctgccagtgcgataacagctgcaactgcgacccctgcaactgctgattatctttttttgaacgtcagaacatacctgcgtgcctgcatgctagctactaccaactactctgcttgtgtgtgacttgatgattgaacaagaataaggatgagcctgagccatcatgtctcatgtatcggtttggctccggcctcatcaagcatgcatgcatcacctgcccctctgagtgctttgcgaccgtcctgtgtctatatgtgttgatctttgcaaagaaaccatgcaggcatacctctctgtatgagtctctgtaatgac

SEQ ID NO: 13016 - protein, 56 aa, Panicum virgatum
  misc_feature: Ceres CLONE 1767601
  misc_feature (1)..(56): Pfam Name: Metallothio_2 Pfam Description: Metallothionein
MYPDLEEKSSGSPQATIVLGVAPENKTGQFEAAAESGETAHACQCDNSCNCDPCNC

SEQ ID NO: 13017 - DNA, 476 bp, Panicum virgatum
  misc_feature: Ceres CLONE 1767612
  misc_feature: Encodes the peptide sequence at SEQ ID NO. 13018
ctctagggtttcctcgccaccgccgcttccgccttcgctgccgccgccgccgccgccgcagccatgccgtcccacaagaccttccggatcaagaagaagctggccaagaagcagcgccagaaccgccccatcccctactggatccgcatgcgcaccgacaacaccatcaggtacaacgcgaagcgcaggcactggcgccgcaccaagctcggattctgagcgggggaagagatgccgggcaccgatgcttggggaaactcgtgattacgagccggcctcgggacgcttccatgattccgcatgctaggaagctgcttgtttagattttgcttgtgttaaattgatcttatcagttgtttctttagcgaactgagaataccatgttttgctgatggttggagaacatcatttataattatgccgaagctatcttgatctgccgtgcgttaatcagttgatctgggcagcttttttgc

SEQ ID NO: 13018 - protein, 51 aa, Panicum virgatum; identical to SEQ ID NO: 9830
  misc_feature: Ceres CLONE 1767612
  misc_feature (9)..(51): Pfam Name: Ribosomal_L39 Pfam Description: Ribosomal L39 protein

SEQ ID NO: 13019 - DNA, 871 bp, Panicum virgatum
  misc_feature: Ceres CLONE 1767671
  misc_feature: Encodes the peptide sequence at SEQ ID NO. 13020
aaaaacaaacccccttcttcgcgaaaagaaaagaaaaaaaaaggttactcgcgacttgccaaacgcccaaacccgatccgatccccaaaattccccacacccatggcggcgagcttgtggcgggcggtgatgggcaccggcgcggcgtccgcggacgccgattcagcgggcggcggcgtggagttctggcgtgttccggagcgcgtgggttggctgaccaagcagggcgagtacatcaagacgtggcggcggcggtggttcgtgctcaagcaagggaggctcttctggttcaaggactcgaccgtcacgcgcgcctccgtgccccgcggcgtcatccccgtcgcctcctgcctcaccgtcaagggcgccgaggacgtgctcaaccggccctacgccttcgagctctccaccccgcgcgagaccatgtacttcatcgcggacaccgagaaggagaaggaggagtggatcaactacataggccgctccatcgtacagcactcccgctccgtcaccgacgctgaggtcgtcgactacgacagccgccctggcgagaagtgatcgatttattcgatttttgattggtgagcaaggaccggacacaccttgtaactctgcagcatctctatgttattactcctttaggtttcgcgcttgcatcttcttgcttcgtggatatgatctgtgcatttgtataatatttcggtcattgggggaataagttcaggattatagcttgctgtctgatatgatctctgttcaaatttctgcacggccgtttgatttatttggtcaattgatttgtattggctgttttagaattttgtgaagagacaccattggatgtgtaaagttactgcaatttttcttgctg

SEQ ID NO: 13020 - protein, 151 aa, Panicum virgatum
  misc_feature: Ceres CLONE 1767671
  misc_feature (32)..(130): Pfam Name: PH Pfam Description: PH domain
  misc_feature: SWISSPROT Homolog: EC 2.7.11.1 Non-specific serine/threonine protein kinase
MAASLWRAVMGTGAASADADSAGGGVEFWRVPERVGWLTKQGEYIKTWRRRWFVLKQGRLFWFKDSTVTRASVPRGVIPVASCLTVKGAEDVLNRPYAFELSTPRETMYFIADTEKEKEEWINYIGRSIVQHSRSVTDAEVVDYDSRPGEK

SEQ ID NO: 13021 - DNA, 670 bp, Panicum virgatum
  misc_feature: Ceres CLONE 1767716
  misc_feature: Encodes the peptide sequence at SEQ ID NO. 13022
gcgcaaacaccggatcgccggactcgtggctgccctgctcgccctcgccctctccctctcgtccctccgcaccgcgcaagaggagccgcccatggcggacagcgggcctctggcgggcggcgtcacggacgtgccgcagaacgaaaacgacatccacctacaggagctcgcccgcttcgccgtcgacgagcacaacaagaaggccaatgctctcctggggttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcaggaattcaagcctgttgaagagagtgctagcgcttaaggatatctcgtcttccacgtgcaattgctacctgaagcactaaacagacttttttttgttttgaagtcgaagcactaaacagacttgcagaataaggagctggttcggatgtataatagatgtgctgttgcgagctccgttgtgtagtatcataagatcaccttgccctttgtgtaatatcatgaataacggtgtcctttgtgtaaaatcatgaattcagtgccctttatgtgtaacattataaataaataacagggctgagtattcatc

SEQ ID NO: 13022 - protein, 132 aa, Panicum virgatum
  misc_feature: Ceres CLONE 1767716
  misc_feature (39)..(127): Pfam Name: Cystatin Pfam Description: Cystatin domain
RKHRIAGLVAALLALALSLSSLRTAQEEPPMADSGPLAGGVTDVPQNENDIHLQELARFAVDEHNKKANALLGFEKLVKAKTQVVAGTMYYLTVEVKDGEAKKLYEAKVWEKPWENFKELQEFKPVEESASA

SEQ ID NO: 13023 - DNA, 530 bp, Panicum virgatum
  misc_feature: Ceres CLONE 1767745
  misc_feature: Encodes the peptide sequence at SEQ ID NO. 13024
actcgacgcaccaactctctctctctctctctctctctcacttcctcaggagcgctagggttttcctgcggcggcggcggaggaaggcggcgatggggcactcccacgtgtggaactcccaccccaagaactacgggcccggatcccgcgtctgccgggtctgcgccaaccctcatggactgatcaggaagtacgggctgatgtgctgcaggcagtgcttccgcagcaacgccaaggacattggcttcatcaagtaccgctgaagtcagctgtgggctatgagaatgccatcttcgggtatgacatggaccatgttttagaagcgaggcgataatttaaattccagtaatttagatgttttgttcagaactctgcaagtgaagtctgttgcctgtgtttttgatggagaacttggccatgtcggtcatgtttgaatcatgagttacctgcatatgtgcagaatttgagctaccttgtttgataaccattttatctttgtctagttgagcatcaagtggatggttattgtt

SEQ ID NO: 13024 - protein, 56 aa, Panicum virgatum
  misc_feature: Ceres CLONE 1767745
  misc_feature (3)..(56): Pfam Name: Ribosomal_S14 Pfam Description: Ribosomal protein S14p/S29e
  misc_feature: Useful for making plants with modulated nitrogen use efficiency
MGHSHVWNSHPKNYGPGSRVCRVCANPHGLIRKYGLMCCRQCFRSNAKDIGFIKYR

SEQ ID NO: 13025 - DNA, 796 bp, Panicum virgatum
  misc_feature: Ceres CLONE 1767771
  misc_feature: Encodes the peptide sequence at SEQ ID NO. 13026
tccttgcccacccctcgccgccgccgcagacgcatccctccgcctcgaggcttccgctcgctggtcgcagccatggtgaagtactcgagggagccgaccaaccccaccaagtccgccaaggccatgggccgggacctccgtgttcacttcaagaacacgcgtgagacagcttttgcactcaggaagttaccactcactaaggccaaaaggtaccttgaggatgtgattgcccacaagcaggccatccccttccgcaggtactgtggcggtgttgggcgtactgctcaggctaagtcgcgccactcaaatggacagggacgctggcccgtcaagtcttctagattcattcttgatcttctaaagaatgctgagagcaatgctgaggtcaaaggtcttgatgtcgataccctgtatgtgtcacacattcaagtaaaccaggctcagaagcagcggcgcaggacctaccgtgctcatggacgcatcaacccttacatgtcctctccgtgccacatcgagctgatcttgtctgagaaggaagagccagtgaagaaagaggcggagtctcagattgcaaccaggaaggcttaaagaagggagctctacggtgttagagtgggttagaacttagagtggattgtaggttgtcgttgcctaagtgaaaattttggctggttatctgtcgcctcctttatcagtgtactgctagctcgttctgtcaccttgatcagtgtctgtactgcctatacaattcgaagctatgaatgaagtgtttgtggattctttccatatttatatt

SEQ ID NO: 13026 - protein, 171 aa, Panicum virgatum
  misc_feature: Ceres CLONE 1767771
  misc_feature (17)..(153): Pfam Name: Ribosomal_L22 Pfam Description: Ribosomal protein L22p/L17e
MVKYSREPTNPTKSAKAMGRDLRVHFKNTRETAFALRKLPLTKAKRYLEDVIAHKQAIPFRRYCGGVGRTAQAKSRHSNGQGRWPVKSSRFILDLLKNAESNAEVKGLDVDTLYVSHIQVNQAQKQRRRTYRAHGRINPYMSSPCHIELILSEKEEPVKKEAESQIATRKA

SEQ ID NO: 13027 - DNA, 752 bp, Panicum virgatum
  misc_feature: Ceres CLONE 1767822
  misc_feature: Encodes the peptide sequence at SEQ ID NO. 13028
acctcaaacagcgatctctcgaatccgcatcccccaattccccaaccgcccaaacaccgccgcgccgcgagccccaaagcagccgcagcaccaccgatggcgcccaaggcggagaagaagccggcggcgaagaagcccgcggaggaggagcccgcggccgagaaggcggagaaggccccggcggggaagaagcccaaggcggagaagcgcctccccgcgggcaagtccggcgccggcaagaacggcgagggcaagaagggcaagaagaaggctaagaagagcgtcgagacctacaagatctacatcttcaaggtgctcaagcaggtgcacccggacatcggcatctcctccaaggccatgtccatcatgaactccttcatcaacgacatcttcgagaagctcgccgccgaggccgccaagctcgcccgctacaacaagaagcccaccatcacctcccgcgagatccagacgtccgtccgcctcgtcctccccggggagctcgccaagcacgccgtctccgagggcaccaaggccgtcaccaagttcacctcggcctagttaggtttgccgcgtctggtggtgccagtactggttcggttgggtgctgctgctagtcctggctccctcggtttaatttatctggtagcagtagtattgtcatcaacactgtcgaatggaaatggatggttagtgtgtagtacgaattgtgtacctaatggatctggaacatcaatggtgccctgttctgttcg

SEQ ID NO: 13028 - protein, 153 aa, Panicum virgatum
  misc_feature: Ceres CLONE 1767822
  misc_feature (60)..(130): Pfam Name: Histone Pfam Description: Core histone H2A/H2B/H3/H4
  misc_feature: Useful for biocontainment applications
  misc_feature: Useful for making plants with modulated flowering time
MAPKAEKKPAAKKPAEEEPAAEKAEKAPAGKKPKAEKRLPAGKSGAGKNGEGKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSA

SEQ ID NO: 13029 - DNA, 692 bp, Panicum virgatum
  misc_feature: Ceres CLONE 1767845
  misc_feature: Encodes the peptide sequence at SEQ ID NO. 13030
atctctctgctctgctctgggccattccttccgcggcccccctagctccgcgtccgcccaaccaccgcgaccgccagcgcctcctccagatcggcgggcgggcaccggccggcgatgacatccgccgtcgccaccaccgtagggtgcggggggctccccttccgcccgtcctcgacggcgcccacaggacgaccccgcggcagataggtcgtccgagctcaagccgcaggagcggacgcctccgacgacaagtcggtggagatcatgcgcaagttctccgagcagtacgcccgccgctccaacacctacttctgcgcggattttttcttcactgccgttgtcatcaagggacttgctgatcacaaggatacactcggagctcctctatgcccttgtaggcattatgatgacaaagctgccgaggtagcacaaggattttggaattgcccatgcgttcccatgcgtgagaggaaggaatgccactgcatgctttttcttactcccgacaatgattttgctggaaaggaccaggctatctccttggaggagatcaaagaggcgacatccaagttctaaccccgtgtatttttcgccaaatgtttacttgacagctagttttcttttatatgtacatgtacttatgtagaagcatctataagatatgccccccaagaaaatttttcctaagatgt

SEQ ID NO: 13030 - protein, 103 aa, Panicum virgatum
  misc_feature: Ceres CLONE 1767845
  misc_feature (1)..(100): Pfam Name: FeThRed_B Pfam Description: Ferredoxin thioredoxin reductase catalytic beta chain
  misc_feature: Useful for making plants with high aluminum sensitivity
  misc_feature: Useful for making plants with modulated high pH sensitivity
  misc_feature: Useful for making plants with modulated low iron sensitivity
  misc_feature: Useful for making plants with modulated phosphate use efficiency
MRKFSEQYARRSNTYFCADFFFTAVVIKGLADHKDTLGAPLCPCRHYDDKAAEVAQGFWNCPCVPMRERKECHCMLFLTPDNDFAGKDQAISLEEIKEATSKF

SEQ ID NO: 13031 - DNA, 710 bp, Panicum virgatum
  misc_feature: Ceres CLONE 1767862
  misc_feature: Encodes the peptide sequence at SEQ ID NO. 13032
aagcagcagctcgagtccaaccaaacattaaccggaagagaagagaaggcaagaagagactcacccgtcgctacgaacaccaattcttgcagagaggaggtatgagaacccaagtgttcttcctcacattcgccttgctcgctgtgctcgggcaatcgagcaacaggcaccaccaccaccaccactcccatgttcagagcaaaggtactggatcttctcttcttgcacaaaagatgctccttttctcgacatgttgatccaagaattgcttgacccttttcctttcatgggtttccaagtaacaatcaaagaattcgtgatttttttggtttttcttgtgagtatatgcatcagtttggctcacccggttggaatctgtgtctggtttcagggcatggagggggaggaggaggaggggagctagcgagccgggggaaggcggcggcgcgggcgtggccgtgctgcgacaactgcggcgggtgcaccaagtcgaacccggcgcagtgccggtgccttgacgcggcgccccgcgggtgccacccggcctgccgggactgcgtcaagtccagcctcagcgccgacccgccggtgtaccagtgcatggaccgcgtccccaacttctgctcccgccgctgctccgccgccgccgcccacagaccggccggctgagcggacgacaacgagtcgacgactcgttctgattgctgctg

SEQ ID NO: 13032 - protein, 107 aa, Panicum virgatum
  misc_feature: Ceres CLONE 1767862
  misc_feature (39)..(65): Pfam Name: Bowman-Birk_leg Pfam Description: Bowman-Birk serine protease inhibitor family
MHQFGSPGWNLCLVSGHGGGGGGGELASRGKAAARAWPCCDNCGGCTKSNPAQCRCLDAAPRGCHPACRDCVKSSLSADPPVYQCMDRVPNFCSRRCSAAAAHRPAG

SEQ ID NO: 13033 - DNA, 225 bp, Panicum virgatum
  misc_feature: Ceres CLONE 1767862-R
acccacccgcccgcaattcctaccttctgaaggcaagctgtggattatagatttttgtgtgtagagactagagagatgaggaatctgttcatcagatgagcaaaccaaaccaagcttggatttttttttcctttttttttgtcttttgacttgacactgctctgtaattgctggctactactgcttgggctgtgttcagttcccacaaaatttccaaactttctg

SEQ ID NO: 13034 - DNA, 753 bp, Panicum virgatum
  misc_feature: Ceres CLONE 1767868
  misc_feature: Encodes the peptide sequence at SEQ ID NO. 13035
atttccaccccgaaacctccagccgggccgcccctgaatccccatccttcttcgccgccgccggcagacgcgccgcgaagtctccagaggaatcggagggggggggggcgaggagcgatggaggaggactcgccgctgacgaagacggtgaagggcgccgtgacggggctcgccgctgggaccatctggggcaccgttgtcgccacctggtacgacgtgccccgggtggagcgccacgtcgcgctcccgggcctcatccggacgctcaaaatgtgcgggacctacggggccaccttcgccaccatcggcgggctctacatcggcgtcgagcagctcgtgcagagtcagcgcaagaagcgcgacttcgtcaacggggccgtcggtgcgttcgtcgccggagcctccgtatgcggctacagaggaaagagcattcagtctgccctcatcggaggctcctgcctggcgttcacatctgctgtgctggacattggtggcaatacaacgagagtggacaatggcaaagagtactatccctacacaaccgagaagaagcccgctcattgatttaagcttgtgtacttgtagcacaaatctttcaagccatcagctcggtgaattttaaagctgatgcgcgctgttatgtctgttttgctggtgcacttagttcctctgcaaatccatggcaacttgtttgccgctgatcgagagggatgaacataatgttcaaaataaatctttgatttcctttcttgt

SEQ ID NO: 13035 - protein, 148 aa, Panicum virgatum
  misc_feature: Ceres CLONE 1767868
  misc_feature (2)..(129): Pfam Name: Tim17 Pfam Description: Tim17/Tim22/Tim23 family
MEEDSPLTKTVKGAVTGLAAGTIWGTVVATWYDVPRVERHVALPGLIRTLKMCGTYGATFATIGGLYIGVEQLVQSQRKKRDFVNGAVGAFVAGASVCGYRGKSIQSALIGGSCLAFTSAVLDIGGNTTRVDNGKEYYPYTTEKKPAH

SEQ ID NO: 13036 - DNA, 852 bp, Panicum virgatum
  misc_feature: Ceres CLONE 1767889
  misc_feature: Encodes the peptide sequence at SEQ ID NO. 13037
gaaacctcacccaaatccaaagcgaagccaagacacgtttcatttcatcatttggctcactcgctcactcacctgtctgtccatcgctctagctcagctcccagtgatagctgcaccaagagctgggagaggaaggttgtagacgatggggaagctctggacgatccttactcacctccactccctcgcagggccaacggtcatgctcctgtaccccctgtacgcgtcggtgcaggcgatggagagcccgtcgaagcttgacgacgagcagtggctcgcctactggatcctctactccttcatcacgctcatggagatggtgctcgagtccctcatctactggatcccgatttggtacgagctgaagctgctgttcatcgcgtggctggtgctccccaacttcaggggcgcggccttcatctacgacaagttcgtcagggagcagctccggaagcacggcctcaccgccggcggcggcaaggtcaagaaggacgacaagtcgccctcgtcttctcccaaggacaaggagaagcccaagagcaagttccttgccttcgtcacccccaagaaggatcacgaagcttactgaagcatgccggacggtgcggtgacctcatcccggcggcttgtcgatgcagagcctcctgtagtgtttctggtgtctagttgagtttgttcatgctcgtcacttaaaatagagccgatcgatgtatatggtgatcctgtatgtgtgaacatctagcagaaatattgaatggagaccagagcaaactttccgtgttgatcatgtgaatgtgactcgagatctgacaaaaagtcaatacaatgttctgggacaggttttcctgtctg

SEQ ID NO: 13037 - protein, 147 aa, Panicum virgatum
  misc_feature: Ceres CLONE 1767889
  misc_feature (4)..(101): Pfam Name: TB2_DP1_HVA22 Pfam Description: TB2/DP1, HVA22 family
MGKLWTILTHLHSLAGPTVMLLYPLYASVQAMESPSKLDDEQWLAYWILYSFITLMEMVLESLIYWIPIWYELKLLFIAWLVLPNFRGAAFIYDKFVREQLRKHGLTAGGGKVKKDDKSPSSSPKDKEKPKSKFLAFVTPKKDHEAY

SEQ ID NO: 13038 - DNA, 822 bp, Panicum virgatum
  misc_feature: Ceres CLONE 1767898
  misc_feature: Encodes the peptide sequence at SEQ ID NO. 13039
atcctccacttcacacctgctcgctatcacacagccaattgctctcgacaccaaccacttcttcttcttcaccatgtcgaacggcaccgagacgcaagcccaggcggcgacggcggcccagcagcagcagaggcccccggcggtgtccgcggagatgcagaaggtgttctcccgcttcgacgcggacggcgacggccggatctccccctcggagctggccgcggtctcgcgcgccatctccccgccgccgagctcctcgcacggcggccgcgaggtggccgccatgatggacgagctcgacgccgaccgcgacggctacgtggacctcggcgagttcgcggcgttccacgcgcgcgccgccggccgcggggacggcgagctcgaggccgagctccgcgccgccttcgacgtctacgacgtcgacggcgacggccgcatcacggccgccgagctcggcaaggtgctcgcgcagatcggggagggctgcagcgccgaggagtgcgagcggatgatcgccagcgtcgacggcgacggcgacgggtgcgtcgggttcgaggagttcaagaagatgatggcgccccaaccccaaggcagcgccgccgacgccgccgcgcccggcggcggcctccctgacaaggccaagaaggagtgagcagttacatatgtagccagggggaagtgctggagtgcctctagaattattttcacctagagtaaacgctcccccgtaatgttattaggaataaaaatcctccatgacttatatgtgttataactcccgttatatattgtggtgtacatttatctgcatcgattgatttt

SEQ ID NO: 13039 - protein, 192 aa, Panicum virgatum
  misc_feature: Ceres CLONE 1767898
  misc_feature (106)..(134): Pfam Name: efhand Pfam Description: EF hand
  misc_feature (27)..(55): Pfam Name: efhand Pfam Description: EF hand
  misc_feature (142)..(170): Pfam Name: efhand Pfam Description: EF hand
  misc_feature: SWISSPROT Homolog: EC 2.7.11.1 Non-specific serine/threonine protein kinase
MSNGTETQAQAATAAQQQQRPPAVSAEMQKVFSRFDADGDGRISPSELAAVSRAISPPPSSSHGGREVAAMMDELDADRDGYVDLGEFAAFHARAAGRGDGELEAELRAAFDVYDVDGDGRITAAELGKVLAQIGEGCSAEECERMIASVDGDGDGCVGFEEFKKMMAPQPQGSAADAAAPGGGLPDKAKKE

SEQ ID NO: 13040 - DNA, 716 bp, Panicum virgatum
  misc_feature: Ceres CLONE 1767924
  misc_feature: Encodes the peptide sequence at SEQ ID NO. 13041
accagcgcttgcaacaactcatccatccagcaccgtatcgtgccctcatcacattcacgcacaatggctcgcgctcagcaggtcgtggcgatcgccgtcgttgccgccgtcgtgctgctcgccgccgcggccacctccgaggccgccgtgacctgcgggcaggtcaactccgccatcggcccctgcatcgcctacgcccgcgggtccggctccggcccctcctcagcctgctgcagcggagtcaggagcctcaactccgccgccaggagcaccgccgacaggcgcgccgcatgcaactgcctcaagtccgccgcaggcagggtgagcggcctcaacgccggcaacgccgccagcatcccgtccaagtgcggagtcagcatcccctacaccatcagcccatccgtcgactgctccaaggtggcttaatatcgtgatgagttggttggagcctgcatgctgccaagcacatccaccgagatatatatatctagctatcgtctatatatgatcgatcgagttctcgctagctcgctgatgaataaaatctctccgccgtcgctcatcatgtgagagacacggccggatcggatgtgtcagtccctgctacgttttgtacgtgtctgctgcatgtacaccttcatttctgtaccttgtccactaccttttaatacatacaccactttttggtatgtatatatgctccgatccatgagttt

SEQ ID NO: 13041 - protein, 120 aa, Panicum virgatum; identical to SEQ ID NO: 10108
  misc_feature: Ceres CLONE 1767924
  misc_feature (31)..(116): Pfam Name: Tryp_alpha_amyl Pfam Description: Protease inhibitor/seed storage/LTP family

SEQ ID NO: 13042 - DNA, 900 bp, Panicum virgatum
  misc_feature: Ceres CLONE 1767934
  misc_feature: Encodes the peptide sequence at SEQ ID NO. 13043
agtcgccactcgcccacctctccagccatccgctcgcttccgccatggcggccttcccctccgcctccccgtcgccggcgatctccgcctcgacctggcgcatggcgtccctccgggcggcccttcccacgctccgcccttccccggcgggcaggctccggtcgtccttctcgcccgcggcggcggccaccgcggcgtcggtcggctgcctcgggtcattctccggcctcgcgcccgtctcgaatcttctatcccttggtgccgagaactcaagctttgagcatcggttgttcagtgttgatgctcgtggaaggatagttgcaatgcgacacgggagacgtgttccaaaacttaacaggcctccagatcagaggaaagcacttctgcgtggtcttaccacacagctgctgaagcatggaaggataaagactacaaagccgagggcaaaggcaatgaggaagtatgttgagaagatgatcacgttggcaaaggatggatctcttcacaagaggagacaggctctggcattcatatatgagaagcatatcgtccatgcattgtttgctgaggttgcagacaggtatggagacagagagggtggttacacaaggatcatcccaacatttccaagacggggagacaatgcacctatggcgtacattgaacttgtctaggatcttccatcagatgcagtgatttcatgggcgatgtgcaggttgtgtgctcatgtctgcaaattgccctttgggggcctctttttttcttctgaagttcttttgtaacaaagtgtagatcatgtgtgaaattttgagctgtcaaatgttgccctgtaaactcaaattgacaaaacactatgctatattttggaaagagttgctggcatcgtatcgtgtcttctct

SEQ ID NO: 13043 - protein, 209 aa, Panicum virgatum
  misc_feature: Ceres CLONE 1767934
  misc_feature (113)..(209): Pfam Name: Ribosomal_L17 Pfam Description: Ribosomal protein L17
MAAFPSASPSPAISASTWRMASLRAALPTLRPSPAGRLRSSFSPAAAATAASVGCLGSFSGLAPVSNLLSLGAENSSFEHRLFSVDARGRIVAMRHGRRVPKLNRPPDQRKALLRGLTTQLLKHGRIKTTKPRAKAMRKYVEKMITLAKDGSLHKRRQALAFIYEKHIVHALFAEVADRYGDREGGYTRIIPTFPRRGDNAPMAYIELV

SEQ ID NO: 13044 - DNA, 744 bp, Panicum virgatum
  misc_feature: Ceres CLONE 1768000
  misc_feature: Encodes the peptide sequence at SEQ ID NO. 13045
aaccctagcgccgcacccgcacactcccgccgccgcgcagccgcaggaaggaggaggaggagaaggagcaggaggaggaagatgccggcggggcacgggctgcggtcgcggacccgcgacctgttcgcgcggccgttccgcaagaaggggtacatcccgctcacgacctacctccgcaccttcaagatcggcgactacgtcgacgtcaaggtgaacggcgccgtgcacaagggcatgccgcacaagttctaccacggccgcacagggcgcgtctggaacgtcacaaagcgcgccatcggcgtcgagatcaacaagcaggttaatggccgcatcatcagcaagcggatccatgtccatgtggagcatatgcagccatcacgttgcacggaagagttccgcctgcggaaagccaagaacgaccagctcaaggctgatgccaaggcccgtggtgaggtgatcagcaccaagaggcagcccttgggtccgaagcctggcttcatggtcgagggtgctacaattgagacagtcactcctattccatatgatgtggtcaatgacctcaagggtggttactagagagaatgtttgtatcttgatcagttcaagcgacctagcatcaatgcttatctgaatcttttttagtactggctagttctttttttgtttgctggtgttaggaacctatgtggttattactggttaacattaaagattttgctatggttgattgcgtccggttaccac

SEQ ID NO: 13045 - protein, 164 aa, Panicum virgatum
  misc_feature: Ceres CLONE 1768000
  misc_feature (2)..(100): Pfam Name: Ribosomal_L21e Pfam Description: Ribosomal protein L21e
  misc_feature: Useful for making plants with modulated flowering time
MPAGHGLRSRTRDLFARPFRKKGYIPLTTYLRTFKIGDYVDVKVNGAVHKGMPHKFYHGRTGRVWNVTKRAIGVEINKQVNGRIISKRIHVHVEHMQPSRCTEEFRLRKAKNDQLKADAKARGEVISTKRQPLGPKPGFMVEGATIETVTPIPYDVVNDLKGGY

SEQ ID NO: 13046 - DNA, 922 bp, Panicum virgatum
  misc_feature: Ceres CLONE 1768025
  misc_feature: Encodes the peptide sequence at SEQ ID NO. 13047
aactcacagcgtcgcgcgctcctctacctttcgtttccccctgcttctatcctccctgctctcctgggctcctggcctctcccgcgcgcaccacctgttcgacccaactcccccatcctccacctgtccgccctcccgcccgccgcacccccctcgccgctcccaatggcgccacccgccgccgcgtccgtggcgccgccctccacctccgccgcctcctcggtgctcctgctccgccgcttcccgtccccgtgccccgcctccggccgccgccccgctcagcagccccgccgcgcgcgcctgctcctccaggtcgcgctcaccagcgaggtgtcctcggacgacgtggcggccgaggaggccgcggcggcgcccaagatcggccggcgggtgcgcgtcacggcgccgctccgcgtccaccacatcgtcaaggcgcccgacctggatatccagggcatggagggcgtcgtcaagcagtacgtcggcgtctggaagggcaagcgcatcacggccaatctccccttcaaggtcgagttccagatcgccgtcgaggggcagcccaagcccgtccgcttcttcgcccacctccgggaggacgagttcgagttcgtcgacgaggagtaacggcctcgagatgcggttctcgcgcctgtgccctgtggacgagtaagcggtagcgccgttcttatagaataataatcatggccgcggcggtggcttgtgtatattgttgacggcgtgcggtgacagggatgcaagagggtcgtaggaatttggaaggcatggcaagttgtttgcttgcttgctggttgctgctgcgctgtttcttcctcctcctgttcgacgtctatttttcagatgtggggaattgttcggacgttgatgatgatcgatagttataatagtgataatttttgttgcc

SEQ ID NO: 13047 - protein, 152 aa, Panicum virgatum
  misc_feature: Ceres CLONE 1768025
  misc_feature (72)..(145): Pfam Name: FeThRed_A Pfam Description: Ferredoxin thioredoxin reductase variable alpha chain
MAPPAAASVAPPSTSAASSVLLLRRFPSPCPASGRRPAQQPRRARLLLQVALTSEVSSDDVAAEEAAAAPKIGRRVRVTAPLRVHHIVKAPDLDIQGMEGVVKQYVGVWKGKRITANLPFKVEFQIAVEGQPKPVRFFAHLREDEFEFVDEE

SEQ ID NO: 13048 - DNA, 536 bp, Panicum virgatum
  misc_feature: Ceres CLONE 1768034
  misc_feature: Encodes the peptide sequence at SEQ ID NO. 13049
acccaactccactaaccaagcagcacgttagatcaaggacaccgccgcccgagcccctccccgatccccaagagcagctgagcccatcgctggtgatcagcctcagcacgggcgtctcgctcttcctgggccgcttcgtcttcttcaacttccagcgggagaacgtggcgaagcaggtgcccgagcagaacggcaagacgcacttcgaggccggcgacgagcgcgccaaggagttcgccgccctgctcaagtccaacgaccccgtcgggttcaacctcgtcgacctcctcgcctggggctcgctcggccacatcgtcgcctactacatcctcgccacctccagcaacggatacgaccccaacttcttctgagcgccggggcggtgttcctgacaggcctgctgtaatctacgactcggtcactgtgttggtgttgctgctgcgttttggtgatgtatctggtgccgcggaaagattggttaaatttggacaagtagtgcaactgcgtgtgtacattgccgcatgaatttgatcttc

SEQ ID NO: 13049 - protein, 122 aa, Panicum virgatum
  misc_feature: Ceres CLONE 1768034
  misc_feature (25)..(119): Pfam Name: PSI_PSAK Pfam Description: Photosystem I psaG / psaK
  misc_feature: Useful for making plants with modulated nitrogen use efficiency
  misc_feature: Useful for biocontainment applications
PTPLTKQHVRSRTPPPEPLPDPQEQLSPSLVISLSTGVSLFLGRFVFFNFQRENVAKQVPEQNGKTHFEAGDERAKEFAALLKSNDPVGFNLVDLLAWGSLGHIVAYYILATSSNGYDPNFF

SEQ ID NO: 13050 - DNA, 767 bp, Panicum virgatum
  misc_feature: Ceres CLONE 1768054
  misc_feature: Encodes the peptide sequence at SEQ ID NO. 13051
aaggactccactcatcacattcatatccaacaacaaactacatactagcatgaagatgttcatgactgggaggctcatcttgctgctggctaccctcgccctcgccggggcggcggtcgcggaagccgcggagtgcggcaacgaagccggcgggatgctgtgcccgagcaacctgtgctgcagcagctcggggtactgcggcctgggccggcagcactgcagcaacgggtgccagagcggcgcgtgctaccccaacaagaggtgcggcgccgcggccggcggcgccacctgcgacgccaaccagtgctgcagctcgctggggtactgcggcttcggcgtctactactgcggcgacagatgccagagcggggcgtgccgcgccgacgccgagtgcggcggcggcaaggtgtgcggcgacaacctgtgctgcagcagctgggggtactgcgggctgggccccgagttctgcggcaccggctgccagaccggcgcctgctacgacatgccctcggcctctcgcgcggcgcgcatggccgaagcagccatcatcctgtcctcctgagcgctgcctccgaccacatatatgcgtgtcccttctagtgtatataaataaataatgtctcgatcagggatgctagctgatcgatcgtcgtcgatcgacgtacaacatccatgcagatgaacatgtgtggtttgataagttcccagcagctactgtagttctgctctcgtgctttttgagaaaaataatataaagtcctgcttgt

SEQ ID NO: 13051 - protein, 170 aa, Panicum virgatum
  misc_feature: Ceres CLONE 1768054
  misc_feature (26)..(66): Pfam Name: Chitin_bind_1 Pfam Description: Chitin recognition protein
  misc_feature (112)..(149): Pfam Name: Chitin_bind_1 Pfam Description: Chitin recognition protein
  misc_feature (69)..(109): Pfam Name: Chitin_bind_1 Pfam Description: Chitin recognition protein
  misc_feature: SWISSPROT Homolog: EC 3.2.1.14 Chitinase
MKMFMTGRLILLLATLALAGAAVAEAAECGNEAGGMLCPSNLCCSSSGYCGLGRQHCSNGCQSGACYPNKRCGAAAGGATCDANQCCSSLGYCGFGVYYCGDRCQSGACRADAECGGGKVCGDNLCCSSWGYCGLGPEFCGTGCQTGACYDMPSASRAARMAEAAIILSS

SEQ ID NO: 13052 - DNA, 459 bp, Panicum virgatum
  misc_feature: Ceres CLONE 1768056
  misc_feature: Encodes the peptide sequence at SEQ ID NO. 13053
acgcagttagggttttcgcgccgccgccgccgccgccgcttcttcgtctccaccgcaaagatgccgtcgcacaagaccttccggatcaagaagaagctggccaagaagatgcgccagaaccgccccatcccctactggatccgcatgcgcaccgacaacaccatcaggtacaacgcgaagcgcaggcactggcgccgcaccaagcttggcttctgagcgaggggatggacctgctactgcgtcggaaggctagggtttaagagctatcttccttatgttttatgggtgattcagtgtttctgaaagctaggaagtgattccaggatgcttttattaagattttggtgatgttaagagagttggtagtactctggtgtaatctggatacctttcattgctatgctaagtaaagaacccttgttaccttatatttgtagtgatgcagttatttcttgaatc

SEQ ID NO: 13053 - protein, 51 aa, Panicum virgatum
  misc_feature: Ceres CLONE 1768056
  misc_feature (9)..(51): Pfam Name: Ribosomal_L39 Pfam Description: Ribosomal L39 protein
MPSHKTFRIKKKLAKKMRQNRPIPYWIRMRTDNTIRYNAKRRHWRRTKLGF

SEQ ID NO: 13054 - DNA, 727 bp, Panicum virgatum
  misc_feature: Ceres CLONE 1768073
  misc_feature: Encodes the peptide sequence at SEQ ID NO. 13055
aaaatccgcaggccacgaactcacgaagcggcagcgagagccgagagaagccatggcgctgtccctctccctcgcgcgcgccgcgcccctcgccgtctccgcgggcgccggggccaggaggatccccgccgccagcctcgccttccctcccaagtccttcttcggcgcgccgctggccgccaccgccgcctccgtcgcgtcgccgctcccgcgcaggccggctacctccacctcgctcgaggtcgtcgcggcggggaagaaggggtacaagatgaagacccacaaggcgtcggcgaagcggttcagggtgacggggaggggcaagatcgtgcgccggtgcgccgggaagcagcacctgctcggcaagaagaacaccaagcgcaagaagaggctctccaagatggtccaagtaaacaagagtgactacgacaatgtgacaggcgcactgccctacctcaaagtgaataggaaagtagactgagttcttcttggtcttcaaaagccattctgtttcattccaccaacctgtaattttgtgtattttccgctgtattacctttcgaatatggaggctgtaattcatttcaagaaagcataaaaaactcttcgtaccaaaaaaaaatagtacgataccgtagttcatactccattctcatacagagatgattggtgaattagtgatgctttcttgtaacatatggtataaatggattgaggattatgcaag

SEQ ID NO: 13055 - protein, 142 aa, Panicum virgatum; identical to SEQ ID NO: 10252
  misc_feature: Ceres CLONE 1768073
  misc_feature (74)..(132): Pfam Name: Ribosomal_L35p Pfam Description: Ribosomal protein L35

SEQ ID NO: 13056 - DNA, 656 bp, Panicum virgatum
  misc_feature: Ceres CLONE 1768087
  misc_feature: Encodes the peptide sequence at SEQ ID NO. 13057
agaaaatccctcacgcgtgctccgccgcctctgtcgtgtgtcctgtcctccgtcctgagcctccgccgcaggcttcggcttcgcgcgatcgagcggccgagccgtcggaccctggagggttggatgttttggcggggggcggggactatgtggacttcctcttcaaggtggtgctcatcggtcactccgcattcggcgtgtcgcagatcctggtccgcttcgcccgccccctgttcttcctccactcctgggcctccatcggggtctagttccatatgcggacgctcttcatcgatcctacgttcgtgatggtgcaaatctgggacaccgccggtctcgaggggtatagtgctgttccccgcgcgtactacagaggtgctctaggagctgtggtggtctgtgatatctctcaacgccagagcttcgacctcattcctcgttgggtggatgagctccgtggccatgctgacgagaacattgtcatcttgctggttggctacaagagtgacctctaggaggatcgtgctgtgagctccgaggacgccggggagtttgcctagaacgagaacctcttcttcctggagacctccgcgctgcaagccaccaatgtcgagaacgtctttcagactgtcttgacagagatcttcaagattcac

SEQ ID NO: 13057 - protein, 79 aa, Panicum virgatum
  misc_feature: Ceres CLONE 1768087
  misc_feature (1)..(79): Pfam Name: Ras Pfam Description: Ras family
  misc_feature: Useful for making plants with altered lignin content
  misc_feature: Useful for making plants with altered alkaloid content
MRTLFIDPTFVMVQIWDTAGLEGYSAVPRAYYRGALGAVVVCDISQRQSFDLIPRWVDELRGHADENIVILLVGYKSDL

SEQ ID NO: 13058 - DNA, 930 bp, Panicum virgatum
  misc_feature: Ceres CLONE 1768093
  misc_feature: Encodes the peptide sequence at SEQ ID NO. 13059
atggcgccggttaaggtattcgggtccgcggtgttcgcgaacgccgcgcgtgtgatggcgtgcctcgaggaggtgggcgtcgagtacgacgtcgtcgaggtcgactacatggccaaggagcacaagggcctcgagcatctggcgagaaacccgttcggccaaatcccagcgtttcaggatggggacatcatgctcttcggtattcttacagccttataacaactactgtacttccacagaaatagttgctctcgaatcctgatctacagagtactcccttcgtctcaaaagtcaaaacgactaataatttaatacggagggagtactatgttattatttgtaattctcaacgaatttcttccagagtcccgagcaatctcaaagtatgtgctccgaaaatatgccaagtcagcccaagatgacctgctgcgagagggcaacccggaggaagctgcgatggtggatgtgtggacagaagtggaggcacaccactacctaccggccatggcacccatcttctacgagtgcgtcgtgtaccccgcgaggctcggcaccacgcccaaccagaaggttgtggacgagagtgtcgagaagttcaagaaggtgctcgacgtctacgaggtctgcctgtccaagagcaagtacctcgccggggacttctttagctttgcggacctcaaccatttcccctttaccttccatatcatgacgacgccgcacgcgtcggtcttcgactcgtacccgcacgtcaaggcgtggtgggagagagttatggagaggccgtcgctgaagaagatcagcgcccatatggagatcaagccctgatcgctcaagcaaatatagttatagctgcgttgcatgatctactttgagttttattgcaaaccatttggtcctgtacctgcaatataacgttgctatttccgccgc

SEQ ID NO: 13059 - protein, 165 aa, Panicum virgatum
  misc_feature: Ceres CLONE 1768093
  misc_feature (56)..(152): Pfam Name: GST_C Pfam Description: Glutathione S-transferase, C-terminal domain
  misc_feature: SWISSPROT Homolog: EC 2.5.1.18 Glutathione transferase
MLLFVILNEFLPESRAISKYVLRKYAKSAQDDLLREGNPEEAAMVDVWTEVEAHHYLPAMAPIFYECVVYPARLGTTPNQKVVDESVEKFKKVLDVYEVCLSKSKYLAGDFFSFADLNHFPFTFHIMTTPHASVFDSYPHVKAWWERVMERPSLKKISAHMEIKP

SEQ ID NO: 13060 - DNA, 805 bp, Panicum virgatum
  misc_feature: Ceres CLONE 1768109
  misc_feature: Encodes the peptide sequence at SEQ ID NO. 13061
gagatgatacaccggccgcgccgaaccgccgagcgagagaaggtagctgctgcgtgcgcgaggaggaggacgagatgcagggcggcggcggcggcgtggagcagcagccgatgcagatggtgctgcgggtgaagcacccgacgtcgtcgtcgctgggcgacgaggaggaggcaggcgagggctcgtcgaggtcggcgctctcggtgttcaaggccaaggaggagcagattgcgaggcgcaagatggaggtccgggagaaggtgttcgcgcacctcgggcgcgtcgaggaggagtccaagcggctcgccttcatcaggcaggagctggaaggcatggcggatccgacgcggaaggaggtggagtcgatacggaagaggattgacacggtgaaccgtcagctcaagcctctcggcaagagctgcgtcaagaaggagaaggaatacaaggaggtcctggaggcgtacaacgagaagagcaaagagaaagcgctgctagtcaacaggctaatcgagctggtgagcgagagcgagaggatgcggatgaagaagcttgaggagctcaacaagacagtagactcactctactagacgccagctgatgctcacctccaccgagagctcgctcgccgcctccctgtaatctcagtgtgccataaggactcgggacttgttcaaggtgttgcttgtaactgatgtttctcattgagtgattcttccttcttctttctgttccttttgtttcttttctttcatcagctggtttgagtctcgttgtactgtcactgtcgagtaaaactgacgtattt

SEQ ID NO: 13061 - protein, 170 aa, Panicum virgatum
  misc_feature: Ceres CLONE 1768109
  misc_feature: Useful for making plants with modulated biomass
MQGGGGGVEQQPMQMVLRVKHPTSSSLGDEEEAGEGSSRSALSVFKAKEEQIARRKMEVREKVFAHLGRVEEESKRLAFIRQELEGMADPTRKEVESIRKRIDTVNRQLKPLGKSCVKKEKEYKEVLEAYNEKSKEKALLVNRLIELVSESERMRMKKLEELNKTVDSLY

SEQ ID NO: 13062 - DNA, 772 bp, Panicum virgatum
  misc_feature: Ceres CLONE 1768115
  misc_feature: Encodes the peptide sequence at SEQ ID NO. 13063
acttctcctccaatctcaccgccaccagcgccaccgccgcaccggttccggcgatcttgggcccccctcggaaggaaggaaggaagggaagggaagggacgagaggatgagttccggcggcggcaggggcagggccaagggcaccaagtcggtgtcgcggtcctccaaggccggcctgcagttccccgtcggccgcgtcgcgcgcttcctcaagacgggcaagtacgccgagcgcgtcggcggcggcgcgcccgtctacctcgccgccgtcctcgagtacctcgccgcggaggtgctggagctcgccggcaacgcggcgcgcgacaacaagaagaaccggatcgtgccgcgccacatccagctcgccgtgcgcaacgacgaggagctcagcaagctgctgggggccgtcaccatcgccgccggaggggtgctgcccaacatccaccagacgctgctgcccaagaaggccggcggcaagggcaaggccgacatcggctccgcctcccaggagttctagccggcgccgccgccagcgcgggtggcctccccctccctccttcggggcgcggccttagtcgcagccgccgatgctgcggcttcttcttggctccaccagaagtagttctagtatctcgcctaggctaggttaggttttgcaatggatggcttaccatgggaagtttgctgtatctatcaatcaatcttgctggaatggatgaaatggtcggttgctatgaatggatgaaatggttctgtgatgtttcttttgtgc

SEQ ID NO: 13063 - protein, 136 aa, Panicum virgatum
  misc_feature: Ceres CLONE 1768115
  misc_feature (18)..(91): Pfam Name: Histone Pfam Description: Core histone H2A/H2B/H3/H4
MSSGGGRGRAKGTKSVSRSSKAGLQFPVGRVARFLKTGKYAERVGGGAPVYLAAVLEYLAAEVLELAGNAARDNKKNRIVPRHIQLAVRNDEELSKLLGAVTIAAGGVLPNIHQTLLPKKAGGKGKADIGSASQEF

SEQ ID NO: 13064 - DNA, 655 bp, Panicum virgatum
  misc_feature: Ceres CLONE 1768124
  misc_feature: Encodes the peptide sequence at SEQ ID NO. 13065
ggtagcagccggttcacttctccctttaaggtaaagggttgggactcatggcgcccacccagcccaagtccggcctcttcgtgggcatcaacaagggtcatgtcgtgaccaagcgcgagctgccgccccgcccatcccaccgcaaggggaaagcaacgaagcgggtgaccatggtcaggggcctgatcagggaggttgctgggtttgctccttatgagaagcgaatcactgagcttctgaaggttggcaaggacaagcgtgctctgaaggttgctaaaagaaagctcggaactcacaagagggcaaagaagaagagagaggagatggccaatgtcctcaggaagatgagatctgctggtacccacactgataagaagaaatagagcatctcaagtccgtgaagctggtggcaacattctcctgtgtcggttttccctacctgtagaacctaatagacccacactgataagaagaaatagagcatctcaagtccgtgaagctggtggcaacattctcctgtgtcggttttccctacctgtagaacctaatagacttgtcaaagtacctgccagcgaaacatcgtgttgttagttatgtgttgaaccaccccatgagtttttgatccaactttgaatgcatctatggtttgtctatc

SEQ ID NO: 13065 - protein, 111 aa, Panicum virgatum; identical to SEQ ID NO: 12334
  misc_feature: Ceres CLONE 1768124
  misc_feature (5)..(103): Pfam Name: Ribosomal_L36e Pfam Description: Ribosomal protein L36e

SEQ ID NO: 13066 - DNA, 624 bp, Panicum virgatum
  misc_feature: Ceres CLONE 1768140
  misc_feature: Encodes the peptide sequence at SEQ ID NO. 13067
gccaacgatggcccttgagacgtgcttcagagcgtgggcgctgcacgccgcccctgccggcggcaaggacaggctcgccgtcggcggcggcggcagcagcagcagcagcagcagcttcgcgccgtccaagcgggccgccgccgccgccgcgccgctgtccgtcggccgcgtcgccacgcggcggccccggcacgtctgccagtccaagaacgccgtcgacgaagtgctggtggcggatgagaagaactgggacgggatggtgatggcgtgcgagacgccggtgctggtggagttctgggcgccgtggtgcgggccctgccggatgatcgcgccggtgatcgacgagctggccaaggactacgccggcaagatcaagtgctgcaaggtgaacacggacgactgccccaacgtcgcctccacctacggcatccgcagcatccccaccgtgctcatcttcaaggccggcgagaagaaggagagcgtcatcggcgccgtgcccaagaccacgctcaccaccatcatcgacaagtacatcggcagctcgtgatcgagccaactggggttgatgggtgatgttgttgttggggatgaactaaatacatacgtgtccgtgctcgcgcatac

SEQ ID NO: 13067 - protein, 179 aa, Panicum virgatum
  misc_feature: Ceres CLONE 1768140
  misc_feature (72)..(175): Pfam Name: Thioredoxin Pfam Description: Thioredoxin
  misc_feature: SWISSPROT Homolog: EC 1.8.1.8 Protein-disulfide reductase
  misc_feature: Useful for making plants with modulated heat sensitivity
MALETCFRAWALHAAPAGGKDRLAVGGGGSSSSSSSFAPSKRAAAAAAPLSVGRVATRRPRHVCQSKNAVDEVLVADEKNWDGMVMACETPVLVEFWAPWCGPCRMIAPVIDELAKDYAGKIKCCKVNTDDCPNVASTYGIRSIPTVLIFKAGEKKESVIGAVPKTTLTTIIDKYIGSS

SEQ ID NO: 13068 - DNA, 887 bp, Panicum virgatum
  misc_feature: Ceres CLONE 1768151
  misc_feature: Encodes the peptide sequence at SEQ ID NO. 13069
atattccagccgcacctctctctctcacacacacacactctctcccgaacgcactggcggcggcggatccgaccagccggccggcgcggcggcaggctcggcggtgcgctctgcggggcgcgccagccttgcccagcgcggcggggcatttaatttatgcagggcgcacacccaactccgataggctgaacttgcaagctgcaggtgtcgaggttgaccagattggagccatcaaggttgacgaatattctcgtacatctgctcctagtgtatgggctgtaggtgatgtaacaaaccggatcaatctaacacctgtcgcattgatggaggctacttgcttttccaaaactgtgtttggtggccagcaagttaagcctgattacagagatgttccttgtgctgttttctccattccaccgctctctgtagtgggcctcagcgaacagcaggccttggaggaagccaagggtgatattcttgttttcacttcatcattcaacccaatgaagaacagcatatccaagcggcaggagaagactgtgatgaaactggtagttgatgctgaaactgatagagtacttggtgcgtccatgtgtggatcagatgcacctgaaattatccagggcattgctgttgcacttaaatgtggagccaccaaagcaagcttcgacagcacggtcggaattcacccttcggctgccgaagagtttgtgaccatgcggaccttgaccaggcgcgtgagcccgtccaagccaaagacgaatttgtaagcaacatcggtgttttggggactacacatgttgtttgtacgcagactgtttccatttttgtgattttacatcattcgaactggagcactatattataaaggaataagatttttgcgt

SEQ ID NO: 13069 - protein, 255 aa, Panicum virgatum
  misc_feature: Ceres CLONE 1768151
  misc_feature (130)..(240): Pfam Name: Pyr_redox_dim Pfam Description: Pyridine nucleotide-disulphide oxidoreductase, dimerisation domain
  misc_feature: SWISSPROT Homolog: EC 1.8.1.7 Glutathione-disulfide reductase
IPAAPLSLTHTHSLPNALAAADPTSRPARRQARRCALRGAPALPSAAGHLIYAGRTPNSDRLNLQAAGVEVDQIGAIKVDEYSRTSAPSVWAVGDVTNRINLTPVALMEATCFSKTVFGGQQVKPDYRDVPCAVFSIPPLSVVGLSEQQALEEAKGDILVFTSSFNPMKNSISKRQEKTVMKLVVDAETDRVLGASMCGSDAPEIIQGIAVALKCGATKASFDSTVGIHPSAAEEFVTMRTLTRRVSPSKPKTNL

SEQ ID NO: 13070 - DNA, 614 bp, Panicum virgatum
  misc_feature: Ceres CLONE 1768167
  misc_feature: Encodes the peptide sequence at SEQ ID NO. 13071
gcaagtgccaagccagccaggaacagccaggaaccgcggcccgcaaagactccaaagaacagccaccgacggacaactggacaagccgcctccgggtctagctagggtttccgttccgcttcctctccccgcacgcgaagcagggcgcagcgttgatggcaacggcaccggcgccggcggacccgaaggcggaggcggccaagatggacctcctggaggacgacgacgagttcgaggagttcgagatcgaccaagaatgggacgacaaggaagaaggcaatgaagctgtccagcagtgggaggacgactgggatgatgatgacgttaatgatgatttctcgcagcagctgaggaaagaactggagggagcccagaagagctgaagtgttttcttccgtagtataaatgttactcttgtatggccgttactttctgaaccgctgtgtgcttcagacagttatgggtgcgcgtctgggagcaccacctaatttgcggaatatttctacagggaagtttatggtcgtgctgtagtttccatattatcagtgaatttctatatgaacggcatgagtatgataccagaaagtttataaatatgcggcaatttgcccctc

SEQ ID NO: 13071 - protein, 75 aa, Panicum virgatum
  misc_feature: Ceres CLONE 1768167
  misc_feature (10)..(72): Pfam Name: DSS1_SEM1 Pfam Description: DSS1/SEM1 family
MATAPAPADPKAEAAKMDLLEDDDEFEEFEIDQEWDDKEEGNEAVQQWEDDWDDDDVNDDFSQQLRKELEGAQKS

SEQ ID NO: 13072 - DNA, 523 bp, Panicum virgatum
  misc_feature: Ceres CLONE 1768178
  misc_feature: Encodes the peptide sequence at SEQ ID NO. 13073
attcctctgcctatcgctcggatccacctccacctctccctctcgcgcacgccgccgccgccgcgatgggcctcttcgacgcgctctaccgcgtggtgatgcgccgcaacgccgtctacgtcaccttcgtcgtcgccggcgccttcgcgggcgagagggcggtggattacggagtccacaagctctgggagatgaacaacgtcgggaaaaggtatgaagatataccagttctggggcaaaggccagccgaagaatgagagcattggagctcagactacccaggatgtcgctttccatgaaattaaattccatttaagcaatggttttatcattcctttttgacataataacaaccaatgtaaaatccaaactctttccgggagttgcaacccgttcaattactcagcaggctgttggagtttcctgatgcatggttagaacctgttatctagccaggcatcggcatgtttggcatgtttggtcgaaaacttgaaatgccatgaatgagaaatgttttgttggc

SEQ ID NO: 13073 - protein, 63 aa, Panicum virgatum
  misc_feature: Ceres CLONE 1768178
  misc_feature (4)..(58): Pfam Name: UCR_UQCRX_QCR9 Pfam Description: Ubiquinol-cytochrome C reductase, UQCRX/QCR9 like
MGLFDALYRVVMRRNAVYVTFVVAGAFAGERAVDYGVHKLWEMNNVGKRYEDIPVLGQRPAEE

SEQ ID NO: 13074 - DNA, 789 bp, Panicum virgatum
  misc_feature: Ceres CLONE 1768191
  misc_feature: Encodes the peptide sequence at SEQ ID NO. 13075
gaccagcagtccaacaacaaaactcctcggtccggcggcggcgggacgccatcttcttcttcctccccaagaagctcaccgccacctagcgcgcgcacagatcgcaccaaagccaatggcgtcccccgagcccgccgcgcagtccagccccgcgcaagagccctccacacccgccgcagctggccgtggccgagacgaggcgccgcgagaaccggtcccggaatcagccgcgtccggagcggcggcggcggaggcggagaagggggagcaggaggaggaaggggagtgcgggttctgcctcttcatgaaggccgggggctgcaaggacgccttcgtggcgtgggaggactgcgtcgaggctgcgcagaaggagggcgccgacatggtcgagcgctgccacgaggccaccgccaacctcaagtcgtgcatggatgcgcacgccgactactacgcgcccgttctccaggccgagcaggccgtcaacgagcgcgccgaggccgaggccgccgccgccgccgccgccgccgctgcggagaagggagaggccgcgccgcagcaggctgctcccgcatcgacggtccccggcgaggggaagaagggagaagcagttgccgagaaggtttgagtaactaacaattggcggattggttattaggttcatacttcctgaggttaattttggttccctttgtgggggaaataaggctgttccacgcttaattgttgggacgacgcttaattgctgggacgttgcttccaatttacggaataaattttgatactgtgctg

SEQ ID NO: 13075 - protein, 169 aa, Panicum virgatum
  misc_feature: Ceres CLONE 1768191
  misc_feature (56)..(130): Pfam Name: GCK Pfam Description: GCK domain
MASPEPAAQSSPAQEPSTPAAAGRGRDEAPREPVPESAASGAAAAEAEKGEQEEEGECGFCLFMKAGGCKDAFVAWEDCVEAAQKEGADMVERCHEATANLKSCMDAHADYYAPVLQAEQAVNERAEAEAAAAAAAAAAEKGEAAPQQAAPASTVPGEGKKGEAVAEKV

SEQ ID NO: 13076 - DNA, 719 bp, Panicum virgatum
  misc_feature: Ceres CLONE 1768209
  misc_feature: Encodes the peptide sequence at SEQ ID NO. 13077
aacgtatattggaaagatgtgaagaattggagaaaacagccatagaacaagcaacagataacgcaatccttgatcaactcggaaagttggttgaagttgttgttccacgtgccttgtttcaagaacaaggccaacaactttatggagccaaacttctgcagcttcaggcagaaaggaagctagataaagaccagctagcatccctatcgagccagaggtcagttcaggcatatctagaagaggaaaaggagaacattactagaatcattaaacaaatgctggctgttggtgacattttcaagtccgaaaatttgcagtactcaactgaacagctcatcaaggaagttgaaaactctgtggcagagttcaaacagtacaatcaagactatgatgaggacaacatcaagcagcaggtccaggatgttctagaggcagcgaaggtgcttgaatggctcaaggagaactgcatgatcgagtacgtcagaagatgactctaatgttccagggttcagactattgttaaagagatggctggtgcagcaggtgggcaaattttgcaagatatcttggtccttgccaaccaacccaaccccaacaaatgaagggtttttgcccactcatgagatgaaatttgtttcatatatagcatgagaaagaagtatatatttttaagtagaatgcgagttcactctatgttcattctttacgaggctgtaatc

SEQ ID NO: 13077 - protein, 162 aa, Panicum virgatum
  misc_feature: Ceres CLONE 1768209
  misc_feature (1)..(152): Pfam Name: Trigger_C Pfam Description: Bacterial trigger factor protein (TF) C-terminus
RILERCEELEKTAIEQATDNAILDQLGKLVEVVVPRALFQEQGQQLYGAKLLQLQAERKLDKDQLASLSSQRSVQAYLEEEKENITRIIKQMLAVGDIFKSENLQYSTEQLIKEVENSVAEFKQYNQDYDEDNIKQQVQDVLEAAKVLEWLKENCMIEYVRR

SEQ ID NO: 13078 - DNA, 738 bp, Panicum virgatum
  misc_feature: Ceres CLONE 1768214
  misc_feature: Encodes the peptide sequence at SEQ ID NO. 13079
aactaagcgcagactgaggataacatcagcgaggtgataagaggaaggcagaaccgagacggcagccgaagcgaccgtccgtccgtccggagctgcgcgcgaggaggcatgacgctctccctctccacctccttcctccccacccccgccgccgcgagggccactgcccgcaccctccgctctgtcgtcccgtcacaggggatgcgctgctcgatgcgcaagaaggggctgcacccgcagatctacgaggacgctaaggtgtactgcaacggcgagctggtgctggtgacggggggcaccaagccggagtacacggtggacgtgtggtccgggaaccacccctactacgtcggcgacacctcggcgctggtggtgatggacagccagatcgagaagttccgcaagaagtggggccacatcaaggagtactggcccgaggaccagtggagggagatgcaccccgacggcgacccggagttcgagcccgagggggacaactgatcgacggcggctcccccattcatcgtcttcctcctcctcctcttcttctccccgccctcacccggtgcgtggtcacggctcctgtttaccttgctctcttggttagaatttgagactttggcacggtcgcaatgctctccaggtgttcgattaatgttcgcaatgtaatggtaccagtatgtgatggtgtcttgcttgtgcagtgcactctaatcctagtactcatatgatcctatc

SEQ ID NO: 13079 - protein, 99 aa, Panicum virgatum
  misc_feature: Ceres CLONE 1768214
  misc_feature (5)..(73): Pfam Name: Ribosomal_L31 Pfam Description: Ribosomal protein L31
MRCSMRKKGLHPQIYEDAKVYCNGELVLVTGGTKPEYTVDVWSGNHPYYVGDTSALVVMDSQIEKFRKKWGHIKEYWPEDQWREMHPDGDPEFEPEGDN

SEQ ID NO: 13080 - DNA, 618 bp, Panicum virgatum
  misc_feature: Ceres CLONE 1768240
  misc_feature: Encodes the peptide sequence at SEQ ID NO. 13081
acacgccgacgccgatcgatcgattttgctcccacttgcagtcctccgtcccgcccgccgcgcgcgcttcagcttgggttggagatccgtgatccatggctgctgagactgttgtcctcaaggtgactatgtcatgcgagggttgcgccggggcggtcaggagagtgctctcaaagatggaaggagttgagacctttgacatagacctcaaggagcagaacgtgacagtcaaaggcaatgtcaagcctgaagatgtcttccagacggtttccaagtcggggaagaagacctcctactgggagggcgaagccacagcatcgtctgctccggctccagtagcagaagcagctctcagcaccgaggcagaagcgcctgccgcggaggctgcaccagagatcaccccagtcaagcctgacgcttgatcatcacatgagatgctgtgacccctaaaccttactctagaactagctgggaaaaccgagtcttgtgcgatttgcatcatgttattgccactctagcaagtgattgcgaattatagaataaatgatgaaacccagtatgtccgtacgtttgtgtgatttcaagatgaacacatcccttgcgagattcttgttcact

SEQ ID NO: 13081 - protein, 108 aa, Panicum virgatum
  misc_feature: Ceres CLONE 1768240
  misc_feature (6)..(67): Pfam Name: HMA Pfam Description: Heavy-metal-associated domain
  misc_feature: SWISSPROT Homolog: EC 3.6.3.4 Copper-exporting ATPase
MAAETVVLKVTMSCEGCAGAVRRVLSKMEGVETFDIDLKEQNVTVKGNVKPEDVFQTVSKSGKKTSYWEGEATASSAPAPVAEAALSTEAEAPAAEAAPEITPVKPDA

SEQ ID NO: 13082 - DNA, 472 bp, Panicum virgatum
  misc_feature: Ceres CLONE 1768247
  misc_feature: Encodes the peptide sequence at SEQ ID NO. 13083
gaaaccctagctttctttacgctgcgccgccgacggtgactaggagcaggagccgccgagccggaagagggatctgcgatggccaagtcaaagaaccacacggcgcacaaccagtcgttcaaggcgcacaagaacggcatcaagaagcccaagcgccaccgccagacctccaccaaggggatggacccaaagttcctgaggaacctgaggtactccaggaaaaacaacaagaagagcggtgaggctgaggctgaggagtaaactggtggaatttcagatgatgaattcctgttttgtatcgctagggtctactgcagtcttgaaattaatgctctgttctgtatgatctaaggagattccttagttggtactaaagttttttttttgtcttgctgcctggctggattttgaattaaaatcgttatttgcagcgttatgagaattggtaacctgagcccgtcgttctagtttc

SEQ ID NO: 13083 - protein, 60 aa, Panicum virgatum; identical to SEQ ID NO: 12725
  misc_feature: Ceres CLONE 1768247
  misc_feature (3)..(42): Pfam Name: Ribosomal_L29e Pfam Description: Ribosomal L29e protein family

SEQ ID NO: 13084 - DNA, 532 bp, Panicum virgatum
  misc_feature: Ceres CLONE 1768268
  misc_feature: Encodes the peptide sequence at SEQ ID NO. 13085
aaaacccgcagcgcccgtccatcgattagacgacgtccccggcgagagagaaggggagacagtgacagatggaggcggcggcggcagcggccggcgtgcagctcggctcctccaagccccagatcgccacgcaggaggagatggcggaggcccgggtgccgctcgcctaccgcgaccagtgcgcgcacctcctcatcccgctcaacaagtgccgcgtctccgagttctacctcccatggaagtgcgagcccgagcgccacgcctacgagaagtgccagtacgagctcgtcatggagcggatgctccagatgcagaggatccgcgaggcgcatgaggccaaggtcaagggcggcgcctccataggcctcatcccggccaccgccaagctcgcctgatccggccccgctccgatccggttgatttaggtctgctggttatcacagcgtgcagaggcattgtgcaagaatcctgaatgtttgttgtatgaacaaacatctgttgaatttggcataaagttaactgttgtcttctc

SEQ ID NO: 13085 - protein, 108 aa, Panicum virgatum
  misc_feature: Ceres CLONE 1768268
  misc_feature (1)..(89): Pfam Name: NDUF_B7 Pfam Description: NADH-ubiquinone oxidoreductase B18 subunit (NDUFB7)
MEAAAAAAGVQLGSSKPQIATQEEMAEARVPLAYRDQCAHLLIPLNKCRVSEFYLPWKCEPERHAYEKCQYELVMERMLQMQRIREAHEAKVKGGASIGLIPATAKLA

SEQ ID NO: 13086 - DNA, 509 bp, Panicum virgatum
  misc_feature: Ceres CLONE 1768270
  misc_feature: Encodes the peptide sequence at SEQ ID NO. 13087
  misc_feature (145)..(145): n is a, c, t, g, unknown, or other
  misc_feature (154)..(154): n is a, c, t, g, unknown, or other
gcggatttgaagcaccaccaccacccccgccaccacaagagggacgaggaggagcagcccgccggcgggcacggcggcgaggccgccaccgccgagaacacggagaccaccgggacggaggcggagcccaccggcgaggacgagnacgagaagnacaagaaggaggagaaggagcacaagcacaagcagcaccccggcgagacaggcgccaacgccgccggcgccctttttttgtacgagaagcacgaggcgaagaaggaccccgagcacgcgcaccggcacaagatcgaggaggagatcgcggcggcggcggccgtgggctccgacggctaccccttccacgagcaccacgagaagaagaaggaccacaaggacgccgaggaggccggcggcgagaagaagcaccaccacctcttcggctgatgtgtccagtcgtcgactcagtacatacgtgtgcggcggccccaccacatgtatatgatgatctgtctatatacgtatatatgctg

SEQ ID NO: 13087 - protein, 140 aa, Panicum virgatum
  misc_feature: Ceres CLONE 1768270
  misc_feature (50)..(129): Pfam Name: ABA_WDS Pfam Description: ABA/WDS induced protein
  misc_feature (49)..(49): Xaa is any aa, unknown, or other
  misc_feature (52)..(52): Xaa is any aa, unknown, or other
ADLKHHHHPRHHKRDEEEQPAGGHGGEAATAENTETTGTEAEPTGEDEXEKXKKEEKEHKHKQHPGETGANAAGALFLYEKHEAKKDPEHAHRHKIEEEIAAAAAVGSDGYPFHEHHEKKKDHKDAEEAGGEKKHHHLFG

SEQ ID NO: 13088 - DNA, 180 bp, Panicum virgatum
  misc_feature: Ceres CLONE 1768278
  misc_feature: Encodes the peptide sequence at SEQ ID NO. 13089
aagcgagggcgccgccgaatttctacggacgggccaccccgccgttcgtgtcgcgcgcgctggtggcgctcgaggaggccggcgttgactacgagctcgcccccatgagcccccaggacggcgaccaccgccgcccggagcacctcgccagaaaccctttggggccggtgcccggtagtg

SEQ ID NO: 13089 - protein, 59 aa, Panicum virgatum
  misc_feature: Ceres CLONE 1768278
  misc_feature: SWISSPROT Homolog: EC 2.5.1.18 Glutathione transferase
ARAPPNFYGRATPPFVSRALVALEEAGVDYELAPMSPQDGDHRRPEHLARNPLGPVPGS

SEQ ID NO: 13090 - DNA, 729 bp, Panicum virgatum
  misc_feature: Ceres CLONE 1768291
  misc_feature: Encodes the peptide sequence at SEQ ID NO. 13091
agggagagaggcgaagcggataaggtttgccccagaaccccccatggcggccttcaaccccgccgcggcgctgacgccgccggctccgggccggccctccgcccgcgccgtgcgtctgccggcggctcggtctctgccgctccgctgctcgccgctagccctgggcctcaggcgtcggaccgggcattctcggcggggttcagccgcgctccgggtggaagctaagaagcaaacattctcttcatttgatgagttgctggagaagtctgagaagcctttactagttgacttctatgcaacttggtgtggcccatgcctttacatggttcccatacttcaagaagtgagtgaaaagttaagcgagaaggttcaagttgtgaaaattgatactgagaagtacgcagccattgcaagtcgttacagaattgaagcattgccaacttttatcatcttcaagaacaggaaaccttgctatcgttttgagggagcgttgcctgctaaccagatgattgaacaaattgagaatgctttggctgtctcagagtagcacacatggtgagcagagcagaaaagttttctgaaaaatatgtgctgctactgctaccccgtaacatgtgcctctgcatgctaatgcttcattattgatcaaaacatcctcaatttttcccatatcattacagcctgaaacaacgacattgaaaaccttgtaatgatttgctacctgacctt

SEQ ID NO: 13091 - protein, 167 aa, Panicum virgatum
  misc_feature: Ceres CLONE 1768291
  misc_feature (59)..(162): Pfam Name: Thioredoxin Pfam Description: Thioredoxin
  misc_feature: SWISSPROT Homolog: EC 1.8.1.8 Protein-disulfide reductase
MAAFNPAAALTPPAPGRPSARAVRLPAARSLPLRCSPLALGLRRRTGHSRRGSAALRVEAKKQTFSSFDELLEKSEKPLLVDFYATWCGPCLYMVPILQEVSEKLSEKVQVVKIDTEKYAAIASRYRIEALPTFIIFKNRKPCYRFEGALPANQMIEQIENALAVSE

SEQ ID NO: 13092 - DNA, 548 bp, Panicum virgatum; identical to SEQ ID NO: 12237
  misc_feature: Ceres CLONE 1768302
  misc_feature: Encodes the peptide sequence at SEQ ID NO. 13093

SEQ ID NO: 13093 - protein, 74 aa, Panicum virgatum; identical to SEQ ID NO: 12238
  misc_feature: Ceres CLONE 1768302
  misc_feature: Useful for making plants with modulated cold sensitivity

SEQ ID NO: 13094 - DNA, 772 bp, Panicum virgatum
  misc_feature: Ceres CLONE 1768305
  misc_feature: Encodes the peptide sequence at SEQ ID NO. 13095
atgcacagacgacagcgagccaagtgtactactcccagtgaagccgcactagctagccacaccagcagcttgacaagctagctagctagctaggccgcagccatgtcggaggagaagcaccaccacttcttccaccaccacaagaaggacgaagaggagcagcccgccggcgggtactcggaggtggtggccgccggcgagagcgagtacgagaggtacaagaaggaggagaaggagcacaagcacaagcagcacctcagcgaggccggcgccgtcgccgccggcgccttcgcgctctacgagaagcacgaggcgaagaaggacccggagcacgcgcaccggcacaagatcacggaggagatcgccgccacggcggccgtcggcgccggcggctacgccttccacgagcaccacgagaagaagaaggaccacaaggacgccgaggagaccagcggcgagaagaagcaccaccacctcttcggctgacccgccggcgagcgagctccggcccggccgccgcgcacccgcctgcttgctccaataattgtggccatgatttcgcaataagtcccttccggacccttagcttgcttgcttgtgtgagactgagaggtggggcccgcgcgtcgaggtgtgttccggcctgtacgtgcttgatttttctttgcgtccgtaattgcgttgaataaccgggagcgatgcacgtgtggctcccagtctgtctgtctgtggttgagtgtctgtatcctgatgatcaactcgtagaagtttt

SEQ ID NO: 13095 - protein, 127 aa, Panicum virgatum
  misc_feature: Ceres CLONE 1768305
  misc_feature (37)..(116): Pfam Name: ABA_WDS Pfam Description: ABA/WDS induced protein
MSEEKHHHFFHHHKKDEEEQPAGGYSEVVAAGESEYERYKKEEKEHKHKQHLSEAGAVAAGAFALYEKHEAKKDPEHAHRHKITEEIAATAAVGAGGYAFHEHHEKKKDHKDAEETSGEKKHHHLFG

SEQ ID NO: 13096 - DNA, 726 bp, Panicum virgatum
  misc_feature: Ceres CLONE 1768309
  misc_feature: Encodes the peptide sequence at SEQ ID NO. 13097
cttgctccagtcctcgtcccgccgccgccgccgccgccgccgccgccccctgcaccagcaccagccgccgcctagcagcagccgtcgccggagaagaaggggagggagccatgggtcgcgtccgcaccaagaccgtgaagaagacctccaggcaggtgatcgagaagtactactcccgcatgaccctcgacttccacaccaacaagaaggtgctggaggaggtctcgatcctgccctcgaagcgcctccgcaacaaggtggccggcttcaccacccacctgatgcgccgcatccagcgcggccccgtccgcggcatctcgctcaagctccaggaggaggagcgcgagcgccgcatggacttcgtcccggagaagtcggcgctcgaggtggaggagatccgcgtcgacaaggagaccatggagatgctcgcgtccctcggcatggccgatctccccggcgtcgagcgccaggctgaggtgtccagcgcccccacctacggccgcccgcagtacggtggcccccgccgcgaccgcgtctaggcttctagtcggttgcagtggttggatcttgatcgcttcacttatcgtcgttattatgctactatgtcaaacttgttttaggtcattggttgctttgtggcgattaagtcttgaacctatctgttttgctctgaattctgcactgttttgatctgcgtgtgatggacaagatctaaattctagcgcc

SEQ ID NO: 13097 - protein, 142 aa, Panicum virgatum; identical to SEQ ID NO: 10208
  misc_feature: Ceres CLONE 1768309
  misc_feature (1)..(122): Pfam Name: Ribosomal_S17e Pfam Description: Ribosomal S17

SEQ ID NO: 13098 - DNA, 947 bp, Panicum virgatum
  misc_feature: Ceres CLONE 1768333
  misc_feature: Encodes the peptide sequence at SEQ ID NO. 13099
atctgttcctcgtcttgcttggcttcccttctccagttgacttgcttttccatcgcctctccacgactagatgagatgtctgaggtggtggcgatggcggggcaggcgtacatgaggcagctgctggcccacccgctgcgcaccaaggccatcacctccggcatcctggccggctgcagcgacgccgtcgcccagaagatctccggcgtccccaagctccaactcaggaggctcctcctcatcgcgctatacggatttgcatacgcgggaccgtttggacatttcctccacaagctcatggataggtttttcaagggcaagaaaggaaaagaaacgacagccaagaaggtcttagtagaacagctgaccgcatctccatggaacaacatgatgtttatgatgtattatggtctggtcgttgaagggagaccattcgaacaagtgaagagcaaggtgaagaaggactatgcatctgttcagctgacatcttggaagttctggccaattgtaagttggatcaaccatgagtacatgccgctccaactccgagttcttttccatagcttcgtcgcatcctgctgggcggtgtttttaaacctcaaggcagcaagatccatcgcaaatactcctactaagaaggcataaacaaaggcagctatcgacggaataaatgccatgatctgaactgccgcctgaaagcaaaaccaacatgtgtatcaactgggcggctaggcctgaattttcttttacagagggagaggaacaatggaattgaattatattgtttgctacgactagtttgcgcgcattggtctcctgccttttcatttcgtaaattgttgtttgctcttcccatcctatcaacgacgtccgtagtatgtatctatttttaagtagaatcaaagttggtttacaggcaaaaaaatatatggactcttgtttctctg

SEQ ID NO: 13099 - protein, 189 aa, Panicum virgatum
  misc_feature: Ceres CLONE 1768333
  misc_feature (114)..(182): Pfam Name: Mpv17_PMP22 Pfam Description: Mpv17 / PMP22 family
MSEVVAMAGQAYMRQLLAHPLRTKAITSGILAGCSDAVAQKISGVPKLQLRRLLLIALYGFAYAGPFGHFLHKLMDRFFKGKKGKETTAKKVLVEQLTASPWNNMMFMMYYGLVVEGRPFEQVKSKVKKDYASVQLTSWKFWPIVSWINHEYMPLQLRVLFHSFVASCWAVFLNLKAARSIANTPTKKA

SEQ ID NO: 13100 - DNA, 609 bp, Panicum virgatum
  misc_feature: Ceres CLONE 1768343
  misc_feature: Encodes the peptide sequence at SEQ ID NO. 13101
attcagctgagtgtgctcgatcatcaagcaatcaacaaagcctcccaattatcctttcatcagatcatcttccttcttccaaattgtcttgcagctgcggatcaagctgcaactgcggctccaactgcaagtgcggcaagatgtaccctgaccttgaggagaagagcagcggcggcgctcaggccaccatcgtcctcggcgtggccccggagaagaaggccggccagttcgaggcggcggcggagtccggcgagaccgcccacgcctgcaagtgcggtaacagctgcagctgcgacccctgcaactgctgatttcgatggggaacgtcagaacacacctgcatgcatgctagctactacctactactctgcttgtgtgtgacttgatgattgaacaagaataaggatgagcctgagccatcatgtctcatgtatcgatttggctccggcctcatcaagcatgcatgcgtcgtctgcccctctgtgtgctttgcgtccgtcctgtctgtatgtgttgatcattgcaaagaaaccatgcaggcatacatctctgcatgtgtctctgtaatgatcggtccagagtgatgaatatataaaactggtttgcttt

SEQ ID NO: 13101 - protein, 102 aa, Panicum virgatum; identical to SEQ ID NO: 11990
  misc_feature: Ceres CLONE 1768343
  misc_feature (28)..(102): Pfam Name: Metallothio_2 Pfam Description: Metallothionein

SEQ ID NO: 13102 - DNA, 293 bp, Panicum virgatum
  misc_feature: Ceres CLONE 1768349
  misc_feature: Encodes the peptide sequence at SEQ ID NO. 13103
ggggggggccgccggcgagagcgagaacgagaggcacaagaaggaggagaagaagcacaagcacaagcagcaccccggcgaggccggcgccgacgccgccggcgccaacgcgcccaacgagaagcacgaggcgtttttttttccggagcacgcgcaccggcacaagatcacggaggagaacgccgccacggcggccggcggcgccggaggcaacgcccaccacgagcaccacgagaagaagaaggaccacaaggacgccgaggagaccagcggcgagaagaagcaccacccac

SEQ ID NO: 13103 - protein, 97 aa, Panicum virgatum
  misc_feature: Ceres CLONE 1768349
  misc_feature (10)..(89): Pfam Name: ABA_WDS Pfam Description: ABA/WDS induced protein
GGAAGESENERHKKEEKKHKHKQHPGEAGADAAGANAPNEKHEAFFFPEHAHRHKITEENAATAAGGAGGNAHHEHHEKKKDHKDAEETSGEKKHHP

SEQ ID NO: 13104 - DNA, 382 bp, Panicum virgatum
  misc_feature: Ceres CLONE 1768352
  misc_feature: Encodes the peptide sequence at SEQ ID NO. 13105
ggcatccgcggatttcagctcctccggaacatcaccgggaacccgaaagtcaggggaaacgaggcagggagggccgctggggtgctcgagaaccatgaggaggggaggcgttacgcaatgcacagccccagaagctttgcgcatgacaagacccccgaaatcacgccggcctttttcaagtgcttcaccgagccaaagcgaagcgatttgctcgggcgctgctgctggagtcgctactgtcgagtgcacccatttaaggcattcaatatgcaatgccctccccaaattggaggacagcggacacctcttattaaaagtaccgcgtgagtgatcggtgatggccagctatgtgaatgatggcttatgagtgctgcaccccccc

SEQ ID NO: 13105 - protein, 108 aa, Panicum virgatum
  misc_feature: Ceres CLONE 1768352
  misc_feature (1)..(67): Pfam Name: B12D Pfam Description: B12D protein
GIRGFQLLRNITGNPKVRGNEAGRAAGVLENHEEGRRYAMHSPRSFAHDKTPEITPAFFKCFTEPKRSDLLGRCCWSRYCRVHPFKAFNMQCPPQIGGQRTPLIKSTA

SEQ ID NO: 13106 - DNA, 467 bp, Panicum virgatum
  misc_feature: Ceres CLONE 1768361
  misc_feature: Encodes the peptide sequence at SEQ ID NO. 13107
attcagctgagtgtgctcgatcatcaagcaatcaacaaagcctcccaattatcctttcatcagatcatcttccttcttccaagatgtcttgcagctgcggatcaagctgcaactgcggctccaactgcaagtgcggcaagatgtaccctgaccttgaggagaagagcagcggcggcgctcaggccaccatcgtcctcggcgtggccccggagaagaagactggccagttcgaggcggcagcggagtccggcgagaccgcccacgcctgcaagtgcggtaacagctgcagctgcgacccctgcaactgctgatttcgatgggggaacgtcagaacacacctgcatgcatgcatgctagctactacctactactctgcttgtgtgtgacttgatgattgaacaagaataaggatgagcctgagccatcatgtctcatgtatcggtttggctccggcctcatcaagcata

SEQ ID NO: 13107 - protein, 75 aa, Panicum virgatum; identical to SEQ ID NO: 12252
  misc_feature: Ceres CLONE 1768361
  misc_feature (1)..(75): Pfam Name: Metallothio_2 Pfam Description: Metallothionein

SEQ ID NO: 13108 - DNA, 718 bp, Panicum virgatum
  misc_feature: Ceres CLONE 1768373
  misc_feature: Encodes the peptide sequence at SEQ ID NO. 13109
gatcctctccttcctcatcacgccgtgacgcctccttgtcctctctctctctctctctctctccacaacccggagctcgaaaccctaggcgcgtgcggcggaggcggcgaggcatggccatggacccggacgcggtggccaaggccttcgtggagcactactaccggaccttcgacaccaaccgcgccgcgctggtgtcgctgtaccaggagacctcaatgctcaccttcgagggccagaagctccagggcccggccgccatcgccggcaagctcggctcgctccccttccagcactgcgagcaccagatcgtcaccgtcgactgccagccgtcggggccccagggaggcatgctcgtcttcgtctccggctccatccgcaccgcccccgacgagcaccccatgaagttctcccaggcattccatttgatgcctgctggaaattccttctacgtgcagaatgacatgttccgcctgaactatggttaaagacagtcaagagttgccggaagcgaagtgattaagggtttcatgttgaattgattaatatgaatgatgctgctactcttgcccgttggttggctgctgttgtttgctgcaagaaaattgctagacttgatatgcttgttggataatttcttattttggatcatgtactctggttgcatgggcaccggttctgtggattgtgaatgaaaacggtccagatctattcatgt

SEQ ID NO: 13109 - protein, 124 aa, Panicum virgatum
  misc_feature: Ceres CLONE 1768373
  misc_feature (8)..(121): Pfam Name: NTF2 Pfam Description: Nuclear transport factor 2 (NTF2) domain
MAMDPDAVAKAFVEHYYRTFDTNRAALVSLYQETSMLTFEGQKLQGPAAIAGKLGSLPFQHCEHQIVTVDCQPSGPQGGMLVFVSGSIRTAPDEHPMKFSQAFHLMPAGNSFYVQNDMFRLNYG

SEQ ID NO: 13110 - DNA, 806 bp, Panicum virgatum
  misc_feature: Ceres CLONE 1768375
  misc_feature: Encodes the peptide sequence at SEQ ID NO. 13111
aacgaagcaagcgccatggggaacaagcggcagctgatctgcctcgccgccgtcgccgccgcggccatcctcctgacagcgtcggcaaagaagaccggcgacgtcaccgagcttcagatcggcgtcaagtacaagccagagtcatgcaccctgcaagcgcacaaaggtgataaaattaaggtccattatcgtgggacactcactgatggatcagtatttgattctagctatgacagaggtgacccatttgaatttactcttggaaatggccaagtgataaaaggttgggaccaaggattactaggtatgtgcgtcggtgaaaagcggaagctaaagatacctgcaaagatgggttatggtgagcgaggctccccaccgaagattccaggtggagcaactctgatcttcgacacggagcttatcgctgtcaatggaaagacatctggtgatgcaaaggcagaaagcaatagcgagctttaacacattgaagagtttcatcttgaacgtgtagcagcttcactaatagtggctcgcgcgagttcacttgatgaaagggttgttgtgttatgatttagatgttacaaatgcaagtctggttaagctctatgatctatgtcagcgactgttcatatactgtggaaacttttttcgcttggttggatgagaattcgatttgcgttgttgccacggtcttcgacacaacctgctccttcttgcattactgttgctgtcgacgcaggtcgacgccttctaaatctcaaatgtaaccagtgttagaaattcaaaccagatatttttcacatgag

SEQ ID NO: 13111 - protein, 154 aa, Panicum virgatum
  misc_feature: Ceres CLONE 1768375
  misc_feature (42)..(136): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MGNKRQLICLAAVAAAAILLTASAKKTGDVTELQIGVKYKPESCTLQAHKGDKIKVHYRGTLTDGSVFDSSYDRGDPFEFTLGNGQVIKGWDQGLLGMCVGEKRKLKIPAKMGYGERGSPPKIPGGATLIFDTELIAVNGKTSGDAKAESNSEL

SEQ ID NO: 13112 - DNA, 777 bp, Panicum virgatum
  misc_feature: Ceres CLONE 1768398
  misc_feature: Encodes the peptide sequence at SEQ ID NO. 13113
acttttcgcctttccgcactcgtctttggtcgtcgccttcttcgagttcccccagcctccaaatccccgccgagaaggaagccaggagcagcaagtcgccgagaagaggagagatggcccgtacgaagcagaccgcccgcaagtccaccggagggaaggccccccgcaagcagctcgccaccaaggcggcgaggaagtcggcgccgacgaccggcggcgtgaagaagccccaccgctacaggcccgggaccgtggcgctccgcgagatccgcaagtaccagaagagcacggagctcctgatccgcaagctccccttccagcgcctggtccgcgagatcgcgcaggacttcaagacggacctccggttccagagccacgccgtgctggcgctccaggaggccgccgaggcctacctcgtcgggctcttcgaggacaccaacctctgcgccatccacgccaagcgcgtcaccatcatgcccaaggacatccagctcgcccgccgcatccgcggcgagcgcgcctaagccgccgccgccgccgtaccagtaggggagagggaggaggtcaaagatggaatcggcttgttgatctgccccccgccgcgcgtagtggatcttgctagttgttgtcggtctctgtttggttagtgtaaaagcaggtttacaagtttatttacggctccgctcctattttcgcttcgcttcgagatgaagccagcttgttaaagacttgattcgtgatgttactggcaagcagtaaaaaaattacattgttctt

SEQ ID NO: 13113 - protein, 136 aa, Panicum virgatum; identical to SEQ ID NO: 9871
  misc_feature: Ceres CLONE 1768398
  misc_feature (58)..(132): Pfam Name: Histone Pfam Description: Core histone H2A/H2B/H3/H4

SEQ ID NO: 13114 - DNA, 863 bp, Panicum virgatum
  misc_feature: Ceres CLONE 1768404
  misc_feature: Encodes the peptide sequence at SEQ ID NO. 13115
aagcagctcggcggccatggacatcctgggcgccctcaagctcgccccgtctccgcccgccctagccggcgccgcgccgccggcgacgcctgcgcgctcctcatccgtgcacttccacctcgccaatgccggcgccgccgccctcgtcgccgcctcgctcctcgtcgccgacccgtccctcgcattcataggaggaggcccgtacgggaagcaggtgacgcgggggcaggacctcaccggcaaggacttcagcggcctgaccctcgtcaagcaggacttcaagacgtctatactgaggcaggctaacttcaaaggcgcgaacctgctcggcgcgagcttcttcgatgcagacctcacaagtgctgatctctctgattctgatcttaggggcgccgatttctcgctggcaaatttatcaaaggcaaatttaacaaatgccaacttggaaggggcactggtcacaggaaacacttctttcaaaggcgctaaaataactgggacagattttacggacgtccctctgcgagacgaccaacgggaatacctctgcaaaatcgctgatggagtgaactcaaccactgggaacgacacaaaggagaccctgttctgcagctgatcggcgaggctactgcgctagtggctgggactgattttagcggttgtttcgtacgcgtatcgatttttgcgagcacacgaggattgtaaattgggctatagagaagagatgctgctgcaagtatttgctggtgattacatcaaatcaacgaaaataaagtccgcgtcacttgatgtaatctgtgcaagtgaccatgtactacttcgtatcgtgtattgacaacacaggtgctgacgcttttttttcc

SEQ ID NO: 13115 - protein, 199 aa, Panicum virgatum
  misc_feature: Ceres CLONE 1768404
  misc_feature (111)..(150): Pfam Name: Pentapeptide Pfam Description: Pentapeptide repeats (8 copies)
  misc_feature: SWISSPROT Homolog: EC 2.7.11.1 Non-specific serine/threonine protein kinase
MDILGALKLAPSPPALAGAAPPATPARSSSVHFHLANAGAAALVAASLLVADPSLAFIGGGPYGKQVTRGQDLTGKDFSGLTLVKQDFKTSILRQANFKGANLLGASFFDADLTSADLSDSDLRGADFSLANLSKANLTNANLEGALVTGNTSFKGAKITGTDFTDVPLRDDQREYLCKIADGVNSTTGNDTKETLFCS

SEQ ID NO: 13116 - DNA, 486 bp, Panicum virgatum
  misc_feature: Ceres CLONE 1768427
  misc_feature: Encodes the peptide sequence at SEQ ID NO. 13117
attgtgtcgtccttacgcatagctagggtttgcgactgcagcgctcgtagcctctcccaagcgcagcaagcatgggtagatcgacgagcatttttaggattcaagagccgaagcaaatccatgagatcaaggacttccttctcacagcgagaaggaaggatgcccgctccgtgaggatcaagaggagcaaggatgccgtcaagttcaaggttcgctgctccaagtacctctacacactgtgtgtctatgacactgagaaggccatcaagctgaagcagtctctgcctcctggcttgagcgtgcaggaggtttaagctttggaaatagtgactacagcaccgatgctggttgcttcaaagatttgccaatctaccttaaatttagtttctgtatgtgacctccgactgttttaaatgaattgctgtgattgagacgaaatgttatgtggaagtaatgtgatggctggcgagcctcgaatgactcgtt

SEQ ID NO: 13117 - protein, 80 aa, Panicum virgatum
  misc_feature: Ceres CLONE 1768427
  misc_feature (13)..(80): Pfam Name: Ribosomal_L38e Pfam Description: Ribosomal L38e protein family
MGRSTSIFRIQEPKQIHEIKDFLLTARRKDARSVRIKRSKDAVKFKVRCSKYLYTLCVYDTEKAIKLKQSLPPGLSVQEV

SEQ ID NO: 13118 - DNA, 782 bp, Panicum virgatum
  misc_feature: Ceres CLONE 1768431
  misc_feature: Encodes the peptide sequence at SEQ ID NO. 13119
ctcagcaaaacgagtccgccagccatggcgctcgtgctggcctctccaatggcgcccctctccttccgctcggggaggatctccgcggcggctatcggcggcgtcgcccgcgctggcagggcggccccggtgggcgcctccgccgcctccccgttcctcaggagctccttcgtctcgtcctcctccacgtcgtccgcctccgcctcccccgcctcgctgtcggcggcggtctcggcgtcgctggccttcacgtcctcttcctcgttcgccggttcatctttgggaattgagttcagctacaacagaatgacaacacgaagatcgcgtggtctgcagattagggctggaaaggctgccctctgcatgaccaagaggtcaaaatctaggaagtcacttgcccggacacatggtttccgcaggcggatgcggactacttctggaaggaaggtactgaagcgcaggcgtgccaaaggcaggaaggttctgtgcacaagaacaaactcacccactgggaagaaaagaatattctaattccactgcaatatgacgtgcatgcaacttcaagtatgctttctacatccaatcttctgagcctccttctatctgtaacaatcatgtagcatcctatttctgttttttcggttaatacatctgaatcaccttgtccacacaatttcaagttaccttttttggatgtccctgttgctttggtggaacgtgtattatgctttcggcttccaagttttatttggtgtttgaatgagatttcattatgagtgttc

SEQ ID NO: 13119 - protein, 168 aa, Panicum virgatum
  misc_feature: Ceres CLONE 1768431
  misc_feature (115)..(156): Pfam Name: Ribosomal_L34 Pfam Description: Ribosomal protein L34
MALVLASPMAPLSFRSGRISAAAIGGVARAGRAAPVGASAASPFLRSSFVSSSSTSSASASPASLSAAVSASLAFTSSSSFAGSSLGIEFSYNRMTTRRSRGLQIRAGKAALCMTKRSKSRKSLARTHGFRRRMRTTSGRKVLKRRRAKGRKVLCTRTNSPTGKKRIF

SEQ ID NO: 13120 - DNA, 476 bp, Panicum virgatum
  misc_feature: Ceres CLONE 1768435
  misc_feature: Encodes the peptide sequence at SEQ ID NO. 13121
gacaacagagtctcgtgacatgggcaactccacggcttagtgaagacaaagtcaggcaatgtgtcgattcaagacttggaggggaatatcctcctaaatctgttgcaaagtttgcagcagttgctgcattgtgcgtgcaatatgaagctgattttcgaccaaacatgagcattgtggtgaaggccctccagcccctgctgagtgcacgtgcatccaacaaccatggctgagtgaatgactgctcttgcttgtacttgacgccagtatctgattcagacaatcatgtagcattgtaatttgtaataagacaaaagtatggtgcttcttgaccttggatgttcatgatgtggatgaggagataactccttgcagttcctggatgttactgactagtcttctgtaccctgataagggccatagcgtatacaagtataaactgtatgccgtttatttggttgcatttcgtctggtgcctc

SEQ ID NO: 13121 - protein, 75 aa, Panicum virgatum
  misc_feature: Ceres CLONE 1768435
  misc_feature: SWISSPROT Homolog: EC 2.7.11.1 Non-specific serine/threonine protein kinase
QQSLVTWATPRLSEDKVRQCVDSRLGGEYPPKSVAKFAAVAALCVQYEADFRPNMSIVVKALQPLLSARASNNHG

SEQ ID NO: 13122 - DNA, 810 bp, Panicum virgatum
  misc_feature: Ceres CLONE 1768443
  misc_feature: Encodes the peptide sequence at SEQ ID NO. 13123
cttgtagtgcatggttcccagcaggtcgccacctctcggagagagagagacagagagagagagagagagagagagagagagagagagagggaccaataagcaggagggtctaggcgtctagctagctgagccatggccaaggcacacgtcctggtgctgccgatgccgtgccagggccacgtcacgccgctcatggagctctcccaccgcctggtcgaccacggcatcgaggtcaccttcgtcaacaccgaggtggaccacgcgatggtggtcaccgcgctgcgggcgtccggcggcgaggcggcgctgggcggcggcatccgcctggcgtccatcccggatgggctggccggcgacgaggaccgcaaggacctcaacaagctcatcgacgcctacacgcgccacatgccgggccacctggagcggctcatcgccgacctggaggccgccgggcggcccagggtcaagtggctcgtcggcgacgtcaacatgggctggtccttcgaggtcgccaggaagttcggcatccgggtcgtgtccttctggccggcggccacggcgtgcctcgccatcatgctcaagatccccgagctgatcgaggacggactcatcgacgacaagggtaactgatatttttaccctgtgcgttcacttttattcgtacctaaatcttttactaccggtcaatatatagctgagacaatctgaactaatgcaagtatgcaacttgcaactttagtggacaatagagacgttgaaaattagtcgcacgccgcttgtggactgaattctaacggacgttccttcacc

SEQ ID NO: 13123 - protein, 165 aa, Panicum virgatum
  misc_feature: Ceres CLONE 1768443
  misc_feature: SWISSPROT Homolog: EC 2.4.1.195 N-hydroxythioamide S-beta-glucosyltransferase
  misc_feature: Useful for making plants with altered carbohydrate content
MAKAHVLVLPMPCQGHVTPLMELSHRLVDHGIEVTFVNTEVDHAMVVTALRASGGEAALGGGIRLASIPDGLAGDEDRKDLNKLIDAYTRHMPGHLERLIADLEAAGRPRVKWLVGDVNMGWSFEVARKFGIRVVSFWPAATACLAIMLKIPELIEDGLIDDKGN

SEQ ID NO: 13124 - DNA, 710 bp, Panicum virgatum
  misc_feature: Ceres CLONE 1768455
  misc_feature: Encodes the peptide sequence at SEQ ID NO. 13125
aacccaagcaacaacgagccttccatccactcgtccagatcaagcgagctgcgagaagctcagctagctgcctagctcagcagtagcagcattccagcagctccggctagctcgaccgctcgctcccgatcggcatcgatcgatcgacgcatatataggtagctagatacaatacaactagctgctagattgtcgccagacaattcaacaaagagaagatcgagtagctagcagctgctaggaagatatatacaagctttctttggtcggaacagagaagagaaaagcaaatggagaagatgaaatacggcgactggagctgccggtcgtgccagtacgtcaacttctgcaagcgcgacgcgtgccagcgctgcggcgaggccaagctgggcggtgagcggacggactacgccgcgctgggcggcgactgggacgtcaagcccggcgactggtactgctgccgctgcggcgtccacaactacgcctcccgcgggagctgcttcaagtgctccgccgccaagaacgaggcggccgccgccgtcgcccaggggtgggggttcaccgtcgccggccaggccgggatgaagcccggcgactggatctgcccaagactaggttgcaacgtgcagaactacgccaaccgaaccgagtgcttcaggtgcaatatgcccagatcatacaacggttgatcaggcaactacacaacagag

SEQ ID NO: 13125 - protein, 132 aa, Panicum virgatum
  misc_feature: Ceres CLONE 1768455
  misc_feature (99)..(130): Pfam Name: zf-RanBP Pfam Description: Zn-finger in Ran binding protein and others
  misc_feature (50)..(79): Pfam Name: zf-RanBP Pfam Description: Zn-finger in Ran binding protein and others
MEKMKYGDWSCRSCQYVNFCKRDACQRCGEAKLGGERTDYAALGGDWDVKPGDWYCCRCGVHNYASRGSCFKCSAAKNEAAAAVAQGWGFTVAGQAGMKPGDWICPRLGCNVQNYANRTECFRCNMPRSYNG

SEQ ID NO: 13126 - DNA, 789 bp, Panicum virgatum
  misc_feature: Ceres CLONE 1768458
  misc_feature: Encodes the peptide sequence at SEQ ID NO. 13127
agctgctctccaccatacaacgctatcccatttccatcgagacaaaatatcccacccacttcgagcgcgagcagcagcagcagccagccagcccagcagccatggggatagccgtggtggctcccgtcgcggcggcctcctcctacctcggggcgcggccgagggcgccggcccgcgcccacgtggcggcggccgggatgtccgcgagggcgtcctccttcgtcggggcggggctcgcggtggcggccgcgtcgatagcggcgcggccgaggagggccggctccgggggcggcggggcgcttgggtgcaagtgcctcttcgggctcggggtgccggagctcgcggtaatcgccggcgtcgccgcgctggtgttcgggcccaagcagctccccgagatcggccgcaacatcggcaagaccgtcaagagcttccagcaggcggctaaggagtttgaaactgaactgaagaaagagcctggggaaggtggcgatgagcccccgcctgcaacccccacggcggtaggcgatgaggaagagaaaaagggggcttgaggcatcgtcaagtagcaaggagcacacacatgaggatctatcaagagttgtgagttagggttctgtatgtacaactgtattctgggcttctggagttcgctacaaattcctgcccgtttattttgatcaccttgcagtttcaggccacgtagcgatattgtttgtagtttttgtacccgggaagaataacttttctgtgaacgatgtcgtgttattcaatatgaggcttaccttgagc

SEQ ID NO: 13127 - protein, 149 aa, Panicum virgatum
  misc_feature: Ceres CLONE 1768458
  misc_feature (75)..(127): Pfam Name: MttA_Hcf106 Pfam Description: mttA/Hcf106 family
MGIAVVAPVAAASSYLGARPRAPARAHVAAAGMSARASSFVGAGLAVAAASIAARPRRAGSGGGGALGCKCLFGLGVPELAVIAGVAALVFGPKQLPEIGRNIGKTVKSFQQAAKEFETELKKEPGEGGDEPPPATPTAVGDEEEKKGA

SEQ ID NO: 13128 - DNA, 905 bp, Panicum virgatum
  misc_feature: Ceres CLONE 1768479
  misc_feature: Encodes the peptide sequence at SEQ ID NO. 13129
atcctctactccgatcccgcgcccgccttcgcatccggcatcccccacctcgccctctccctctcccctctgaacccacgcccgccgccgccggcgcgatggccatgcgggtggtgcggaacctggacctggagcggtacgcggggcggtggtacgagatcgcgtgcttcccgtcggcattccagcccaagacgggcaccaacacgcgcgccacctacgcgctcaacccggacggcaccgtgcgggtgctcaacgagacgtggaccgacggccgccgcggccacatcgagggcacggcgtggcgcgccgacccggccggcgacgaggccaagctccgggtccgcttcttcgtcccgcccttcctccccgtcttccccgtcaccggcgactactgggtgctccacgccgacgccgactaccagtacgcgctcgtcggccagccctccaggaagtacctctggatcctgtgcaggcagccgcacatggacgaggccgtgtacggcgagctggtgaggcgggccgaggaggaggggtacgacgtgtcgaagctccacaggacggcgcacccggacccgccgccggagagcgaggagagccccagggacggcgggatgtggtggctcaagtccctctttggcaagtagcgcggcgcgcggcccgcggctgcgccgatcgagcaggcggcgagatggccgtgccggcgttcggacttgggagtccagtgtctactgctagctcctgccgttttaccgcgtgtacattcgcagtactactgcttcgggatgaacacatcaagttcgttcctccttgttatggttgctgctgcgatccgcatatggcgtacctgtgttttgttttgaaatgaacttggacttggagtcaattgcatttctgcggtgatgtcg

SEQ ID NO: 13129 - protein, 181 aa, Panicum virgatum
  misc_feature: Ceres CLONE 1768479
  misc_feature (9)..(156): Pfam Name: Lipocalin_2 Pfam Description: Lipocalin-like domain
MAMRVVRNLDLERYAGRWYEIACFPSAFQPKTGTNTRATYALNPDGTVRVLNETWTDGRRGHIEGTAWRADPAGDEAKLRVRFFVPPFLPVFPVTGDYWVLHADADYQYALVGQPSRKYLWILCRQPHMDEAVYGELVRRAEEEGYDVSKLHRTAHPDPPPESEESPRDGGMWWLKSLFGK

SEQ ID NO: 13130 - DNA, 715 bp, Panicum virgatum
  misc_feature: Ceres CLONE 1768480
  misc_feature: Encodes the peptide sequence at SEQ ID NO. 13131
gtttcctccactccatttcaataaaaaaaaaaacatttccatccctctgaccctctcccaaaaccctcgtcttcccccactggccaccgcatcaacagctccgaaaaggcgaagggacgaggaaggagcggggatggtcgtgcggatccggctggcccggtttggatgccggaacaggcccttctaccggctgatggccgccgacagccgctccccgcgcgacggcaagcacctcgaggtgctcggatactacaacccgctccccgggaaggatggtggcaagaggatggggttaaaatttgaccgtgtgaagtattggttatcggttggggcacagccaacagatcctgttgagcgcatactctttcgtgcaggaattctacctccacctccaatgttagctatggcacacaagggcgggcctcgggacagacaacttattgatccgatgactggacaccctttggacatttatggtctcacaattgttgatgaccctaatgctccagatggtgaaaatggagcatcgattgagaagacggcttgaatgggcatgataatattatgcattagtataactatgctacatatgagttgttttagcatttatgccctgcaggttggtttggtagcttgttactgttgcacaatgtgagaactttttgccaagtgacttctgaacaataattactttatgcaactgaagtttagccct

SEQ ID NO: 13131 - protein, 137 aa, Panicum virgatum
  misc_feature: Ceres CLONE 1768480
  misc_feature (9)..(70): Pfam Name: Ribosomal_S16 Pfam Description: Ribosomal protein S16
MVVRIRLARFGCRNRPFYRLMAADSRSPRDGKHLEVLGYYNPLPGKDGGKRMGLKFDRVKYWLSVGAQPTDPVERILFRAGILPPPPMLAMAHKGGPRDRQLIDPMTGHPLDIYGLTIVDDPNAPDGENGASIEKTA

SEQ ID NO: 13132 - DNA, 719 bp, Panicum virgatum
  misc_feature: Ceres CLONE 1768482
  misc_feature: Encodes the peptide sequence at SEQ ID NO. 13133
atcacaccactcgaattctcgcgctcagattccccaattttccctcctccaaagctctcccgaagcgcggcagcggcgaccatggacgccagcggagccaccgggaaggtgaagaagggggcggccgggcgcaaggcgagtggccccaggaagaagtcggtgtcgcggtccgtgaaggccgggctccagttccccgtaggccgcatcgggcgctacctcaagaagggccggtacgcgcagcgcgtcggcaccggcgcccccatctacctcgcggccgtcctcgagtacctcgccgccgaggtgctggagctggccggcaacgcggcgagggacaacaagaagacgcgcatcatcccgcgccacgtgctccttgcgatccgtaacgacgaggagctcgggaagctgctggccggcgtcaccatcgcccacggcggcgtcctccccaacatcaacccggtgctgctgcccaagaaggccgcggagaaggcggccagcggcggcgccaaggaggccaagtcgcccaagaagggcgccaaatccccgaagaaggcttagacagtagagactccagtagcactgtggtgtaacatgttggtgtttagatttgtggatgggttgtgttctggtctaatttcgtcgtggcttgtgatctgtgttcatcagtgagattttcagaaatctgggctcgttagttactatatatgacctgtttcttgtcc

SEQ ID NO: 13133 - protein, 157 aa, Panicum virgatum
  misc_feature: Ceres CLONE 1768482
  misc_feature (29)..(102): Pfam Name: Histone Pfam Description: Core histone H2A/H2B/H3/H4
MDASGATGKVKKGAAGRKASGPRKKSVSRSVKAGLQFPVGRIGRYLKKGRYAQRVGTGAPIYLAAVLEYLAAEVLELAGNAARDNKKTRIIPRHVLLAIRNDEELGKLLAGVTIAHGGVLPNINPVLLPKKAAEKAASGGAKEAKSPKKGAKSPKKA

SEQ ID NO: 13134 - DNA, 618 bp, Panicum virgatum
  misc_feature: Ceres CLONE 1768498
  misc_feature: Encodes the peptide sequence at SEQ ID NO. 13135
acacccccgaccaaccaagcgaaccacacaaccacgagagcggagcgccgagcccaggcaggatcccatggccgccaccgccgtcgcggcgtctctgtccgtggcccgggggctcgggaagcccctccgcgccggcggcagcagcagcgcgtcgtccctccgcgtctcgccccgtggcaggccggccagcagcagggtggccgtcgtccgggcgtcgtcgtccgcgcagaacccggccaaggagtgggcggccgcggcggccgtcgcggcggcgctggtgctgccggaggtcgcggaggccgcgcagccggggatctcgccgtcgctcaagaacttcctcctcagcatcgtctccggcggggtcgtactcgtcgccatcgtcggcgccgtcgtcgccgtctccaacttcgaccccgtcaagcggggctgagctccaccgcgagcacggccgcgccatggctgtgcgtatacctatgtactgagactgagagcggtcgtcgatctctttctccgtgtgcttccggacgaacagtactgtctgatctgatgctcaatcttttgccgtgtaaatctcattaatttcctctctccccaaagcttctggagacatctaggctc

SEQ ID NO: 13135 - protein, 120 aa, Panicum virgatum
  misc_feature: Ceres CLONE 1768498
  misc_feature (83)..(120): Pfam Name: PsbX Pfam Description: Photosystem II reaction centre X protein (PsbX)
  misc_feature: Useful for making plants with modulated nitrogen use efficiency
MAATAVAASLSVARGLGKPLRAGGSSSASSLRVSPRGRPASSRVAVVRASSSAQNPAKEWAAAAAVAAALVLPEVAEAAQPGISPSLKNFLLSIVSGGVVLVAIVGAVVAVSNFDPVKRG

SEQ ID NO: 13136 - DNA, 793 bp, Panicum virgatum
  misc_feature: Ceres CLONE 1768504
  misc_feature: Encodes the peptide sequence at SEQ ID NO. 13137
aacgccgctcgcgtcccctctcgccctcgcgccgccgccgccgccgcagccgcagctgctgcagcaagaccccaccccgccgtcaccggagacaaacccccagccgccgccatggggcgtatgcacagccgcgggaagggtatctcgtcgtcggcgctgccgtacaagaggactcccccgacttggctcaagactgccgcctccgatgtggaggagatgatcaccaaggccgcgaagaagggccagatgccgtcgcaaattggcgtcctcctccgtgaccagcacggtatcccgctagtcaagagcgtcactggtagcaagattctccgcatcctcaaggcccatgggctcgcaccggagatcccggaggacctttacttcctgatcaagaaggcggtggcgattaggaagcatctggagaggaacaggaaggacaaggactccaaattcaggctcattcttgttgagagcaggatccaccgccttgcccgttactacaagcgcaccaagaagctcccgcccacctggaagtatgagtcgaccactgccagcactctggtggcttaagtgatctcttcagatggtgtggtctttagcttctttgagattgccttgttctagatatgaatttatgtaatgcttaatgagtctggagcgagttagatggacaaggaacctcaactttttctatgtttacttggagaatcccataaaccatttttggtttctcgaatctgtctgttaaacgtaacatgcatccatgttttgtcccagatagccccctttttgtcgc

SEQ ID NO: 13137 - protein, 151 aa, Panicum virgatum
  misc_feature: Ceres CLONE 1768504
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
  misc_feature: Useful for making plants with modulated nitrogen use efficiency
MGRMHSRGKGISSSALPYKRTPPTWLKTAASDVEEMITKAAKKGQMPSQIGVLLRDQHGIPLVKSVTGSKILRILKAHGLAPEIPEDLYFLIKKAVAIRKHLERNRKDKDSKFRLILVESRIHRLARYYKRTKKLPPTWKYESTTASTLVA

SEQ ID NO: 13138 - DNA, 682 bp, Panicum virgatum
  misc_feature: Ceres CLONE 1768507
  misc_feature: Encodes the peptide sequence at SEQ ID NO. 13139
tctcgcggaggacggacgagcagcgcggagagaggggaggcgatggtgaagaagatgcagggaggcggcggcggagggggcgagaaggggcttctctggaagctgccggagatcacgtccaatgagctcggcaagatcggccccggcttcggcatcggcatcggctgcggcgccggcgccggcgtcggattcttcggcggtgcaggactagggtttggatttcctggactcactttaggctttggtgttggagctggttgtggtgttggaatgggttttggttatggcatgggcaaaggaattgcatatgatgagcacaaaagatactcaaatattggaaaaatgttccaggaagctccacatttgcctacggacactgttgttgctttatttgacgagctggttataaacaccaagaagcttgtgacggcaacatcaaaagggatcgaaaaatggcgttgagctgcacccacagcatcattgttgatattagctgccttcaactgtgtatcaagtgaagattagaagcagtgtttatcttgaaaggcagtagcacttagatctagaatccagactgttgcatcgcatggctttctctttctcatcagtcagtaggtttgtatctaagtaggatcctgaaacaaggccggtgatttcttgtcaataatattagttgcatgcc

SEQ ID NO: 13139 - protein, 139 aa, Panicum virgatum
  misc_feature: Ceres CLONE 1768507
  misc_feature: Useful for making plants with altered alkaloid content
MVKKMQGGGGGGGEKGLLWKLPEITSNELGKIGPGFGIGIGCGAGAGVGFFGGAGLGFGFPGLTLGFGVGAGCGVGMGFGYGMGKGIAYDEHKRYSNIGKMFQEAPHLPTDTVVALFDELVINTKKLVTATSKGIEKWR

SEQ ID NO: 13140 - DNA, 637 bp, Panicum virgatum
  misc_feature: Ceres CLONE 1768518
  misc_feature: Encodes the peptide sequence at SEQ ID NO. 13141
  misc_feature (261)..(261): n is a, c, t, g, unknown, or other
  misc_feature (274)..(274): n is a, c, t, g, unknown, or other
  misc_feature (286)..(286): n is a, c, t, g, unknown, or other
aaccacccccccaaccgcacaaacaccgccgcgccgcgagccccaaagcagccgcagcaccaccgatggccccaaggggggagaagaagccggcggcgaagaagcccgcggaggaggagcccgcggccgagaaggcggagaaggccccggcggggaagaagcccaaggcggagaagcgcccccccgcgggcaaggccggcgccggcaaggacggcgagggcaagaagggcaagaagaaggcaaagaagagcgacgagaccnacaagacccacancggcaaggggcncaagcaggttttcccggacatcggcatctcctccaaggccatgtccatcatgaactccttcatcaacgacatcttcgacaagctcgccgccgaggctgccaagctcgctcgctacaacaagaagcccaccatcacctcccgcgagatccagacgtccgtccgcctcgtcctccccggggagctcgccaagcacgccgtctccgagggcaccaaggccgtcaccaagttcacctcggcctagttaggtttgccgcgtctggtggtgccagtactggttcggttgggtgctgctgctagtcctggctccctcggtttaatttatctggtagcagtagtattgccatcagcact

SEQ ID NO: 13141 - protein, 153 aa, Panicum virgatum
  misc_feature: Ceres CLONE 1768518
  misc_feature (60)..(130): Pfam Name: Histone Pfam Description: Core histone H2A/H2B/H3/H4
  misc_feature: Useful for biocontainment applications
  misc_feature: Useful for making plants with modulated flowering time
  misc_feature (66)..(66): Xaa is any aa, unknown, or other
  misc_feature (70)..(70): Xaa is any aa, unknown, or other
  misc_feature (74)..(74): Xaa is any aa, unknown, or other
MAPRGEKKPAAKKPAEEEPAAEKAEKAPAGKKPKAEKRPPAGKAGAGKDGEGKKGKKKAKKSDETXKTHXGKGXKQVFPDIGISSKAMSIMNSFINDIFDKLAAEAAKLARYNKKPTITSREIQTSVRLVLPGELAKHAVSEGTKAVTKFTSA

SEQ ID NO: 13142 - DNA, 580 bp, Panicum virgatum
  misc_feature: Ceres CLONE 1768519
  misc_feature: Encodes the peptide sequence at SEQ ID NO. 13143
acaagtcgttgcatttccctacaacctttcagcgcccaccccgctcgtgcaaacctacctctgttagcttcacaccttcacagcgtcatggcctccaagttcttgtacgtcgccctcgtcgcggccgtcgccgtgtcctccttcgccggcgtcgccttcgcggccgacgccccggcgccgagccccacctccggggcggcggccgtctcctcgtcgctcgtggccgccgtcctctgcccggccgtggcgctcctcctcggcaacctgcgccactgagccctcggcggatcgtcgtggacggaagctgctgccaatacatgttttttttgcgtcgcatgatatcttttacctgcttgctttgtttcctgaccagcgtttcttactaccgatcgaaccgcatggaattttattcattcagagattcacaccatttctgtatcgaaccgcatggaattttatttcagagattcagaccatttctgtagcagcgttgattccgtgtgtcaattatcatgtgtgcccagattctgatgacatttttcgagcatttgagagactgaattgtcgtctgatgatgtgg

SEQ ID NO: 13143 - protein, 62 aa, Panicum virgatum
  misc_feature: Ceres CLONE 1768519
  misc_feature: Useful for making plants with altered carbohydrate content
MASKFLYVALVAAVAVSSFAGVAFAADAPAPSPTSGAAAVSSSLVAAVLCPAVALLLGNLRH

SEQ ID NO: 13144 - DNA, 960 bp, Panicum virgatum
  misc_feature: Ceres CLONE 1768592
  misc_feature: Encodes the peptide sequence at SEQ ID NO. 13145
aaagtcgcaacaaaaagaaaccaggctccgctcgagagagatcgcctgcctgcccaccttcccttcccttcctccccaccccaccccggcgacgcggccgccccgagaccgagcaacccctccgagagggagaggagcagaggaacagggagagcaagatgtcgtcggcgttcagcggcgatgagacggcccccttcttcggcttcctcggcgccgctgccgccctcatcttctcatgcatgggtgcggcgtacgggacggcgaagagcggcgtcggcgtggcgtccatgggtgtgatgcggccggagctcgtgatgaagtccatcgtgcccgtggtcatggctggtgtgctcggtatctacggcctcatcatcgccgtcatcatcagtaccgggatcaaccccaaggccaagccctactacctcttcgatgggtacgcccatctctcgtccgggcttgcttgtggcctcgctgggcttgccgctggcatggccattggcatcgttggtgatgctggtgtcagggcaaatgcacaacagccaaagctctttgtgggcatgatcctcattctcattttcgcagaagcgcttgctctctatggtctcatcgtcggcatcatcctctcatcccgtgccggccaatcccgcgcggattaggcacttgctgctaccattctataaccactgctgtgtttattacgtgctgttttgagagaaacttgaactcgaggttcttgtctagtttattcatgttaccatgtatcaatgaaacatttgtagctgagggaaggtgacacttccagtcatgttcgatttggtggtgtcaagaggttattttttgggttaaggctggatggatgctcctgggctaagtggatttaattttatccttggtgaataaagaacacggaattgtagccaaataataacgtgataattgatatatatatttcttcgcccc

SEQ ID NO: 13145 - protein, 165 aa, Panicum virgatum; identical to SEQ ID NO: 10269
  misc_feature: Ceres CLONE 1768592
  misc_feature (93)..(158): Pfam Name: ATP-synt_C Pfam Description: ATP synthase subunit C
  misc_feature (14)..(79): Pfam Name: ATP-synt_C Pfam Description: ATP synthase subunit C
  misc_feature: SWISSPROT Homolog: EC 3.6.3.14 H(+)-transporting two-sector ATPase

SEQ ID NO: 13146 - DNA, 978 bp, Panicum virgatum
  misc_feature: Ceres CLONE 1768600
  misc_feature: Encodes the peptide sequence at SEQ ID NO. 13147
tctttctcccctccgcgcgacggctcccaccgcttcgcctcgcctcccgacgccgacgccgacgccgacgccttctgcctccgccgcgcccatcgaacgccgtatccaggaacagtaggcagagaggaggagggtcgggcgagatggggatgcgggataagaagcggaaccagaagcgggtcctcgcgcggcgcaccgcggccccgcgctccggcgagggcaaggacttcctgccgttggaagacgggtccgggaagaggacccggaagcagctgcagcagcagcccgaggagccggagaacaccgccacggttgtctacatcgggcacatcccccacggcttctacgaggaccagatgaaagggttctttaagcagtttggggatattaagcgtcttaggattgctcggaaccgcaagacaggaaagtccaagcattacggattcattgagtttgagagccctgttgtggcgaaggttgtagccgatgagatgaataactatctcttgtttgagcacactttgcgagtttcacttgtcccaccagagaaagttcatccaaaactatggaaaggagtgcgacggggatttataccaattgatcgggtaacaatcgaacggaagaggcacaacaaggacaaatcagtagcagaacacaaaaaaatggttgaaggaattgtaaaacgagacgaaaagagacacaaaagaatccaggctgctggaattgattacgagtgtccagcccttatagggatcagtcagcctacagccaagaagatcaagtttgatgagaactagtatttacatgagtcgagagggatcctctgtaagatgttagttaagatggctggcttgttttttgcgttaaggggatggctgctgggaacaatttcccctgttaagttacctaccagtattcagtggctgtatgattgacccagatgataaagtatgaaattgacacttctgttgatctatc

SEQ ID NO: 13147 - protein, 217 aa, Panicum virgatum
  misc_feature: Ceres CLONE 1768600
  misc_feature (58)..(129): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGMRDKKRNQKRVLARRTAAPRSGEGKDFLPLEDGSGKRTRKQLQQQPEEPENTATVVYIGHIPHGFYEDQMKGFFKQFGDIKRLRIARNRKTGKSKHYGFIEFESPVVAKVVADEMNNYLLFEHTLRVSLVPPEKVHPKLWKGVRRGFIPIDRVTIERKRHNKDKSVAEHKKMVEGIVKRDEKRHKRIQAAGIDYECPALIGISQPTAKKIKFDEN

SEQ ID NO: 13148 - DNA, 912 bp, Panicum virgatum
  misc_feature: Ceres CLONE 1768605
  misc_feature: Encodes the peptide sequence at SEQ ID NO. 13149
actgcacagcacctcgctcgctcgctcactcagcaggttcagctcagagccccagacacccacccgccactgcacagccagcagccagcagccagcagccatgaacaagggggagaagcaccaccggcacgagcaccacctgcgccgctgctgcggctgcatggcctcggtcctgctggcgctggtcctcgtggtggccttcgtcgcgctggtcgtctacctcgcgctgcgcccctccaagccgtccttctacctgcaggacctgcagctccgccggcccatccacgtcggcgacccctccctctcggcgtccgcgcaggtcacgctcgcctcccgcaaccccaacgaccgcgtcggcgtcctctacaagcgcctcgacgtcttcctcacctaccgcgaccagcccgtcacggcgcccgtctccctcccgccgcagtaccagggccaccgggacgtcatcgtctggtcccccgtgctggccgccgagtccgtgcccgtggccggctacgtcgcggacgccatgaagcaggacatcgccgccgggttcgtcgcgctgcaggtcaaggtcgacggccgcgtcaagtggaaggtcgggagctgggtctccgggagctaccacctcttcgtcagctgccccgccgtgctctccgccggcggcttcttcggaggctccaacgccacggtgctcaagttcgcgcagcccacggggtgcagcgtcgaggtgtaggccgcccggccggtgaaatgtatgtgtagcgcgttggtactccgacgaaattaaatgttactccgttaattaattagttttcttggggccgggacgggttttatcgttaattattaattaagctgttaatttttgttaatgtctcatattcagatcatgtgggggaataaatctatgttttgtac

SEQ ID NO: 13149 - protein, 208 aa, Panicum virgatum
  misc_feature: Ceres CLONE 1768605
  misc_feature (40)..(178): Pfam Name: Hin1 Pfam Description: Harpin-induced protein 1 (Hin1)
MNKGEKHHRHEHHLRRCCGCMASVLLALVLVVAFVALVVYLALRPSKPSFYLQDLQLRRPIHVGDPSLSASAQVTLASRNPNDRVGVLYKRLDVFLTYRDQPVTAPVSLPPQYQGHRDVIVWSPVLAAESVPVAGYVADAMKQDIAAGFVALQVKVDGRVKWKVGSWVSGSYHLFVSCPAVLSAGGFFGGSNATVLKFAQPTGCSVEV

SEQ ID NO: 13150 - DNA, 844 bp, Panicum virgatum
  misc_feature: Ceres CLONE 1768658
  misc_feature: Encodes the peptide sequence at SEQ ID NO. 13151
aaagaacaagaacgtcaccgtagatgcgtaagcaaattcaggctcaaatgtcattactacagttactgttgatgagattgctacaccaggactgaagactatcttgagctttgctgttcctgatcagagatctggaaagtttgagcttcagtacttgcatgatcatgctggggttaacgcaagcattggtctgactgccaatcctgtagtcaacctctctggctcctttggaaccaaggctctggcaattggcgcagatttctcacttgatactgcatctgggaacttaatcaaatacaatgctggactgagcatcactcattattaccttatcgcatccctgaacctgaacaacaagggagacagcctaaccgcagcttactaccacaatgttaaccaattgactagcacagctgttggggcagagctgacccactgcttctccaccaacgagaacaccctcaccttcggcacccagcatgctttggatccactgaccgtcatgaaggcccgcttcaacaactccggtaaggccagcgcgctgatccagcatgagtggaggccaaagtcactggtgaccatctcagctgaggtcgacaccaagaccattgagaagagctcgaaggttgggatagccgtggccctcaagccctgattgttcaccaagtcctttttttctctctcttaagctcccagcctgtacttccttcccagctgaaattgggaccaggtcagcttggggagacaaaacagtttgggttcccggcatcttttggtcgttgcagtctgtctattgatttcatgaactgcgatgtttccttgagttttttttttcagtcgccgg

SEQ ID NO: 13151 - protein, 50 aa, Panicum virgatum
  misc_feature: Ceres CLONE 1768658
  misc_feature: Useful for making plants with modulated drought sensitivity
MKARFNNSGKASALIQHEWRPKSLVTISAEVDTKTIEKSSKVGIAVALKP

SEQ ID NO: 13152 - DNA, 701 bp, Panicum virgatum
  misc_feature: Ceres CLONE 1768685
  misc_feature: Encodes the peptide sequence at SEQ ID NO. 13153
agtacaccctcgggtcgcgtacacggtacacctcagtgacctcaccctctctcactctctctccatccagcgcgagagggggcagcaggtcggcagcagagcgagagcgcgcgtgcccgcccatggcgagcaccaacatggcgtcggccacctcgcggttcatgctggccgcgggcgtgcccgcggcggcgggcagcggcggccgcgtcggcttcgcgtcgccgcccggcagggtgcagggcaggaggctcgtggcgcgcgccgaggaggaggccgcgcccgcggcggaaggggagggcgccgtggccaccaagcccaaggccgacaagccgccgccgatcgggcccaagaggggcgccaaggtgaagatcctgaggagggagtcctactggtacaacgggattggcaacgtcgtcacagttgatcaggaccccaacacccgctacccggtggtggtgcggttcaacaaggtgaactacgccggcgtgtccaccaacaactacgccttggacgagatccaggaggtgaaatgaaaatgagccaggctgcctcaagggccgccgtgcccccgtgttgtcactgtagcctgtgaaacgagggtgttaaagctgctgtgctagcgcgtcacgacatcttgtgtgtaatagcttaatctctgtaatcattgtgtaattgcttgcttgctacaccatggacggctc

SEQ ID NO: 13153 - protein, 136 aa, Panicum virgatum; identical to SEQ ID NO: 12793
  misc_feature: Ceres CLONE 1768685
  misc_feature (75)..(136): Pfam Name: PSI_PsaE Pfam Description: Photosystem I reaction centre subunit IV / PsaE

SEQ ID NO: 13154 - DNA, 697 bp, Panicum virgatum
  misc_feature: Ceres CLONE 1768689
  misc_feature: Encodes the peptide sequence at SEQ ID NO. 13155
acgtctcaccaagtcctcggctctagggttttagtgggaagggagatggcggcggcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgttttttttttttcagtcccgcggcggcggcggcggcggctacggcggcggtcgtcagggtggctacggcggcggcggcggcggctacggaggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgcaatg

SEQ ID NO: 13155 - protein, 120 aa, Panicum virgatum
  misc_feature: Ceres CLONE 1768689
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 22 in US patent 7244875
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAAADVEYRCFVGGLAWATDNASLQQAFASYGDVLDSKVITDRETGRSRGFGFVTFSSEQSMLDAIEAMNGKDLDGRNITVFFFSVPRRRRRRLRRRSSGWLRRRRRRLRRRWWLRRWSP

SEQ ID NO: 13156 - DNA, 980 bp, Panicum virgatum
  misc_feature: Ceres CLONE 1768702
  misc_feature: Encodes the peptide sequence at SEQ ID NO. 13157
tcccttcctctcctcccgactcccgttgaccagcaactccagccagcgaggcagccgcaagctctccccggcagtcctcctcctgcccgccatgtccggcagccgcggcaactcccgcgagaagacgtgctgctgcggcagctgctgcaccctgctcatctccctgggcctcgccgtgctcatctactgggccatcttccagccgcaccagatacgcgccaccgtcgagtacgccgagctctccaacctcgccgtctccaacgcctcctccccggtcgccgtcacctaccacgtcgccgtcaacctgagcctctacaaccccagcaagcgcgtcaacatctactacgatgccatcgacgccgagctcctcttccgcggcgccgtcctcagcgcggccgccgccgccgccgcgtcccccgccgagttctaccagcgcaggaagaccgccgagacggtccgcctggagttcgacggcaagggcgtcgccgtccccgagggcgtctcggcggagctggagagcgaggtgaaggccgcggcgtcgctgggcctggagctgagcgtcagggtgcgggtgagatacgtgttcgcgagcatcaagatacggcagaagcccaaggtgtggtgcgcggtgagcatcccggtcccgcgggcgccgggcggcctcggcgttcttggctccggcgaccggtgctgggtcaagtactgatgattggagtggaggagtttccttctcttggtggcttcttggacggagattgatggccggttttggtttggttcgcggagagattgctattgtttggcttaattgtttctgcttttgtatcaatgttagaaatttacatactgcgctattggattatttgtttgccaggtgagtggttagaattcacaataacacatgtgtgattatagcttttcatgatgagcatgttttggcatgctgtctttcttttgattagaggcttggtttgaggagc

SEQ ID NO: 13157 - protein, 204 aa, Panicum virgatum
  misc_feature: Ceres CLONE 1768702
  misc_feature (33)..(178): Pfam Name: Hin1 Pfam Description: Harpin-induced protein 1 (Hin1)
MSGSRGNSREKTCCCGSCCTLLISLGLAVLIYWAIFQPHQIRATVEYAELSNLAVSNASSPVAVTYHVAVNLSLYNPSKRVNIYYDAIDAELLFRGAVLSAAAAAAASPAEFYQRRKTAETVRLEFDGKGVAVPEGVSAELESEVKAAASLGLELSVRVRVRYVFASIKIRQKPKVWCAVSIPVPRAPGGLGVLGSGDRCWVKY

SEQ ID NO: 13158 - DNA, 765 bp, Panicum virgatum
  misc_feature: Ceres CLONE 1768706
  misc_feature: Encodes the peptide sequence at SEQ ID NO. 13159
ggcagcaatcgaggaagacagagtgctactgattcgagaagcttctacgtacggccacaagccagcaacccgccgaggcatctctgcaagcgaagcaggtccgatcgagagcatgctggttgtcgcgtcgccggcggcgtcgggcgagctcggctcgctgttcgcggcgttcgacaaggacgccgacggcaggatctccgcggcggagctgcggctctgcatgcgggcggcgctgggcgaggacgtggcgcccgaggacgccgaggcgctggtggcctcggcggacgcggacggcgacgggctgctggacgagggcgagttcgcgcggctggtgcgctcggaggcggcaggcggcggcgaggaggaggagcggcggcggcgcgggggactcgaggcggcgttcggcatgtacgcggcggagggcgaggggcgcatcacgcccgccagcctggggcggatgctcagcaggctcggcgcgcgccgggaggtcgacgactgccgcgccatgatccgcaggttcgacctcgacggcgacggggtgctcagcttccacgagttcgagatcaagatgatgaacgcctgaacaagatgcgtcctgctgcaggacagattgtgattgtggtttctctttctggctttgtacagttttttttcttttacaatgggctctctgtacagtccgtagctgctgtgaacatacactcggacggagggaatccatagttcattcatcttttttatttttaataagaatatggttcattc

SEQ ID NO: 13159 - protein, 156 aa, Panicum virgatum
  misc_feature: Ceres CLONE 1768706
  misc_feature (12)..(40): Pfam Name: efhand Pfam Description: EF hand
  misc_feature (128)..(156): Pfam Name: efhand Pfam Description: EF hand
MLVVASPAASGELGSLFAAFDKDADGRISAAELRLCMRAALGEDVAPEDAEALVASADADGDGLLDEGEFARLVRSEAAGGGEEEERRRRGGLEAAFGMYAAEGEGRITPASLGRMLSRLGARREVDDCRAMIRRFDLDGDGVLSFHEFEIKMMNA

SEQ ID NO: 13160 - DNA, 922 bp, Panicum virgatum
  misc_feature: Ceres CLONE 1768718
  misc_feature: Encodes the peptide sequence at SEQ ID NO. 13161
agtacccgcacactgctcgccagcggtctcccactgctagagcgagcaccgagcagcaacacacagcagcatcggcgaggggagaggaagtgagctccagcccactcgctctctccggccggcgcctcgtttccttgccgctgcgtgcgcgcctcggctacggctagtgccatgggtggtggcgcggcgaggagggtggccgtggcggcgctggcggtggcggtgctggccggcgtggcgtcggcggccgtgtacgaggtgggcgacaaggccgggtggaccgtcatgggcaaccccaactacgccgcctgggccagctccaagaagttccgtggcaatgacgtcgtcgtgttcacgtacaacaagcagttccacaacgtgctggcggtgagcaaggcggactacaagaactgcgacgccagcaagccgatcgccacctggtccacgggcaacgactccgtcgtcctcaagaccgcgggccaccactacttcctctgcggcttcccgggccactgcgccgccggccagaaggtggacatccgcatcgccacctcctctgatgccccttccgcggcgcccacccccgagccctccgccggcggcgccacgaccgcgccggcgccgcaccccaacgccgcgcccaaggcgctccccgcaggcagctccgtcgccgccaccgtcgccgcgtcactgctctccctggccgcggccgtgctcgcgtgaccaggggctccgtagtgtcggttaggagattggcgccattgtgaaatgaattgtgagcactgctatgtctgttgccgtttgagcaggagcgcctggacctgcgttcgttttgctgttttgcccttgtggttctgtggatcctggcctgccttggggatttcttcctgttgtcaattagtttcctcatgctttgagctag

SEQ ID NO: 13161 - protein, 183 aa, Panicum virgatum
  misc_feature: Ceres CLONE 1768718
  misc_feature (36)..(119): Pfam Name: Cu_bind_like Pfam Description: Plastocyanin-like domain
MGGGAARRVAVAALAVAVLAGVASAAVYEVGDKAGWTVMGNPNYAAWASSKKFRGNDVVVFTYNKQFHNVLAVSKADYKNCDASKPIATWSTGNDSVVLKTAGHHYFLCGFPGHCAAGQKVDIRIATSSDAPSAAPTPEPSAGGATTAPAPHPNAAPKALPAGSSVAATVAASLLSLAAAVLA

SEQ ID NO: 13162 - DNA, 341 bp, Panicum virgatum
  misc_feature: Ceres CLONE 1768726
  misc_feature: Encodes the peptide sequence at SEQ ID NO. 13163
caacggcgcgacactcgcacgcggccccggccacggccacgcaccacgccgcggcggcggcgcaggccccggccgccaccccgacgccggcgcccagggcgccccccccgccggcgacaccaccgccgaccccggcgccggcgacgccgcccgcgcaggcccccgccggcccgcccccggccccggcgcccgagaccccggcccccgcccccgaggccgccgccccggcgccggccgaggcccccacccccgaggcgagccccccgccggcgcccgcccccaggggccccgccccgccgcccaccagcgacgcgcccccggcccccagcgccgccgccggc

SEQ ID NO: 13163 - protein, 112 aa, Panicum virgatum
  misc_feature: Ceres CLONE 1768726
  misc_feature: Useful for making plants with altered carbohydrate content
  misc_feature: Useful for making plants with altered cell wall content and/or composition
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
TARHSHAAPATATHHAAAAAQAPAATPTPAPRAPPPPATPPPTPAPATPPAQAPAGPPPAPAPETPAPAPEAAAPAPAEAPTPEASPPPAPAPRGPAPPPTSDAPPAPSAAA

SEQ ID NO: 13164 - DNA, 773 bp, Panicum virgatum
  misc_feature: Ceres CLONE 1768732
  misc_feature: Encodes the peptide sequence at SEQ ID NO. 13165
attccccaccccaccattgctctcctcctcgagcttcaaatctctcgagggcaccaaccctcggcaaaattttccctccttttcgttcctgttcttgcatcatgcgcaggtgctgacgcttcgattcattgcgtcagcgtctgcatcaggcgcctgctcctctgcatcctctcggcggccttgctgctctgcttcttgaattgaggcggaggaggaggagggaggcgggcggggatgccggactcggacaacgactccggcgggccgagcaacgccggcggcgaactgtcgtcgccgcgggagcaggaccggttcctgcccatcgcgaacgtgagccggatcatgaagaaggcgctcccggcgaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctctgggccatgaccacgctcggcttcgaggactacgtcgagccgctcaagcactacctccacaagttccgcgagatcgagggcgagagggcggccgcctcctcgggcgcctcgggctccgccgccgcgcagcagcagcagggcgacgtggccaggggtgccgccaatgccgccgggtacggcgcgcccggcgccggcggcatgatgatgatgatggggcagccgatgtacggctcgccgcagcagcagccgccgccgcagcagcagcagcagcagca

SEQ ID NO: 13165 - protein, 179 aa, Panicum virgatum
  misc_feature: Ceres CLONE 1768732
  misc_feature (26)..(91): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 66 in the 10/675,852 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 64 in the 10/675,852 US patent application
  misc_feature: The sequence is a functional homolog of SEQ ID NO 42 in the 10/675,852 US patent application
  misc_feature: The sequence is a functional homolog of SEQ ID NO 791 in the 10/374,780 US patent application
  misc_feature: The sequence is a functional homolog of SEQ ID NO 12 in the 10/675,852 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: Useful for making plants with modulated biomass
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 60 in the 10/675,852 US patent application
  misc_feature: The sequence is a functional homolog of SEQ ID NO 14 in the 10/675,852 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 36 in the 10/675,852 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 44 in the 10/675,852 US patent application
  misc_feature: Useful for making plants with modulated drought sensitivity
  misc_feature: Useful for making plants with altered alkaloid content
  misc_feature: Useful for making plants with altered terpenoid content
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 803 in the 10/374,780 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 795 in the 10/374,780 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO 793 in the 10/374,780 US patent application
  misc_feature: The sequence is a functional homolog of SEQ ID NO 2382 in the 10/374,780 US patent application
  misc_feature: The sequence is a functional homolog of SEQ ID NO 540 in the 10/225,066 US patent application
  misc_feature: The sequence is a functional homolog of SEQ ID NO 72 in the 10/286,264 US patent application
  misc_feature: The sequence is a functional homolog of SEQ ID NO 788 in the 10/374,780 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASSGASGSAAAQQQQGDVARGAANAAGYGAPGAGGMMMMMGQPMYGSPQQQPPPQQQQQQ

SEQ ID NO: 13166 - DNA, 813 bp, Panicum virgatum
  misc_feature: Ceres CLONE 1768769
  misc_feature: Encodes the peptide sequence at SEQ ID NO. 13167
aagttcaagtaaactgcagcctcccaggccttgggagtcaaatcaggtcctatcatttgttccccctgatgggcagttcaagctcatgagttacagggttaagaaattgaagaagacacccatttatgtgaaaccacagctgacatcagattctgggaattgccgtgttagtgtgatggtggggatccgaaatgatcctgggaaacccattgattctataacagtgcagtttcaattgccccctcttatagtttctgcagatttgactgcaaactatggcacagtcgacatccttgctgacaagacttgtctctggacaattgggcagataccaaaagataaagcaccagtgctctctggaaatttacgtcttgaagaaggacttgctcagttgcatacactgccaacatttcaggtgaagtttaagattatgggagttgctctatctggtcttcaaattgataagctggacgtgaaaaacatgcctagtgctccatacaaaggttttagagcacagacccaagctggaaaatatgaggtcagatcataggtgtgctttcagagggcatctgttagttttgccctcaaagcaaacgataccgtgggcctggtgcatgggctgtcaacgcatttttggttatcagttgatgatcaatactcccatagccagcttgattgcgtcactttaccctgtactgggcccatcactacatttcaaggagcctgccattcttccaatcaatatgtcctatgcctgaatcagattctcctgcctggtgagagagcaacaaaatattgccactctggcttgtc

SEQ ID NO: 13167 - protein, 182 aa, Panicum virgatum
  misc_feature: Ceres CLONE 1768769
  misc_feature (3)..(182): Pfam Name: Adap_comp_sub Pfam Description: Adaptor complexes medium subunit family
SSSKLQPPRPWESNQVLSFVPPDGQFKLMSYRVKKLKKTPIYVKPQLTSDSGNCRVSVMVGIRNDPGKPIDSITVQFQLPPLIVSADLTANYGTVDILADKTCLWTIGQIPKDKAPVLSGNLRLEEGLAQLHTLPTFQVKFKIMGVALSGLQIDKLDVKNMPSAPYKGFRAQTQAGKYEVRS

SEQ ID NO: 13168 - DNA, 814 bp, Panicum virgatum
  misc_feature: Ceres CLONE 1768770
  misc_feature: Encodes the peptide sequence at SEQ ID NO. 13169
caccgtcatcagcgtggggaagaagggcaacgcctacttcatgcgccgcccctacatcccgctggagcgggagctggaggtgaacggcgtgcccacggtgaaggactcgcaggccatctgcgacctggtctactccctcttcgtgtcggaggaggtggacaaggtggagctgctctactccaagttcgtgtcgctggtgcgctccgaccccatcatccagacgctgctgcccatgtcccccaagggcgagatctgcgacgtcaacggcgtctgcgtggacgccaccgaggacgagctcttccgcctcaccaccaaggaggggaagctcaccgtcgagcgcgagaaggtgaagatcgagacgcagcccttctcccccgtcgtgcagttcgagcacgaccccgtgcagatcctcgacgcgctgctcccgctctacctcaacagccagatcctccgcgccctgcaggagtcgctcgccagcgagctcgccgcccggatgagcgccatgagcagcgccaccgacaacgccatcgagctccgcaagaacctctccattgcttacaaccgccagcgccaggccaagatcacgggggagatccttgagatcgtcgccggtgccgacgccctcgccggctgagctgaagccgccgtccccctcgctctacttaacactgagccgagctgagccggtggtggcgtacgttcttcgtgcggtgctcctgctatatataattctaattctttttctcatccttcttgctgttcagtcttctgtctgtaattcctgatagcacaaacacgagggagttctgtgttc

SEQ ID NO: 13169 - protein, 210 aa, Panicum virgatum
  misc_feature: Ceres CLONE 1768770
  misc_feature (1)..(208): Pfam Name: ATP-synt Pfam Description: ATP synthase
  misc_feature: SWISSPROT Homolog: EC 3.6.3.14 H(+)-transporting two-sector ATPase
TVISVGKKGNAYFMRRPYIPLERELEVNGVPTVKDSQAICDLVYSLFVSEEVDKVELLYSKFVSLVRSDPIIQTLLPMSPKGEICDVNGVCVDATEDELFRLTTKEGKLTVEREKVKIETQPFSPVVQFEHDPVQILDALLPLYLNSQILRALQESLASELAARMSAMSSATDNAIELRKNLSIAYNRQRQAKITGEILEIVAGADALAG

SEQ ID NO: 13170 - DNA, 840 bp, Panicum virgatum
  misc_feature: Ceres CLONE 1768819
  misc_feature: Encodes the peptide sequence at SEQ ID NO. 13171
aggccgatcagcactcgccacctcgcgttccccgattcgacgcatacacccattcctctgctccgccgtccacgcgaacgccgaaaaagccccatccctgagtcctgcccgcaaccgcaagcggaaccaatggcgctcctcgcgccgagcccgcgcgcgctctgcgtgcgggaggccgcgacggcggcggcgccgcccccgcactcgccagccgcttgctcgaccgtcggcggcggggcggccgggcgggccctgtgggtgtggaacggcggcgggatggggatggggaggaggagggagcgcggggagagggtcagggcggaggcatacttctgggacgtttccaagccggtggagatggaggagatcgacagcatggagaagctcgacgaggcactcaggtggtccgtcgagaacaaccaggccgtcgtcattgactggatggctagttggtgtcggaaatgtatttacctgaagcctagaattgagaagatagcaggagaatatccaggagtcaggttttactttgttgatgtcaataaagttccacaagcggtggtaaaacgagggaatataactaaaatgcccactattcagttatggaaggatggagaatggaaagcagaggtaataggaggccataaagcctggcttgtgatggatgaggttagagaaatgatccagaagaacaagtaactaaacacccaaggctcaagcagtgcaattgatattgtactgcaaaatgtatatatagagatggcagctgatctcttcagacgctaagtcagcgatcaaatcaataaatctatatttcagctccttatcacagcagagctggtc

SEQ ID NO: 13171 - protein, 188 aa, Panicum virgatum
  misc_feature: Ceres CLONE 1768819
  misc_feature (81)..(180): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MALLAPSPRALCVREAATAAAPPPHSPAACSTVGGGAAGRALWVWNGGGMGMGRRRERGERVRAEAYFWDVSKPVEMEEIDSMEKLDEALRWSVENNQAVVIDWMASWCRKCIYLKPRIEKIAGEYPGVRFYFVDVNKVPQAVVKRGNITKMPTIQLWKDGEWKAEVIGGHKAWLVMDEVREMIQKNK

SEQ ID NO: 13172 - DNA, 610 bp, Panicum virgatum
  misc_feature: Ceres CLONE 1768831
  misc_feature: Encodes the peptide sequence at SEQ ID NO. 13173
aacacccggagcacctctccgtccacttttacagcagttgcctcccccgtctccgggtgcaccgcccgccgtctcaccgcgcatcggaggctataaggctagagggaagacaaggggctccccttcacctagttgtgcacccggttgttctccaagagggagatgcggatgcgcgtgggggggctcgacgccaccagaagcaccaccatcctcgactatctgctgctcggctagatcgtgaccaccatccccacgatgccattgatggttgaccctgtgtagtaccagaacatcctgttccctgtctggcatgcccggcggcacgcacacatcctgcctctgtgcaggcattacttccagaacctgcacggccttatcttgtttgtgaacctcaaccattatgaccgcgttgtgcaaatcttcgatgagctccaccgcatgctcaccaacgatgactcacgtgatgctgtgttgcttgtgttagctaagatccataatcttccgaatgctctgaacactgctgagattcctgatcaacttggactgccctcgcttccccagcgtcactgctacattcaaagcacctctgctccctctggacgagggattg

SEQ ID NO: 13173 - protein, 57 aa, Panicum virgatum
  misc_feature: Ceres CLONE 1768831
  misc_feature: Useful for making plants with altered alkaloid content
  misc_feature: Useful for making plants with altered lignin content
MLTNDDSRDAVLLVLAKIHNLPNALNTAEIPDQLGLPSLPQRHCYIQSTSAPSGRGI

SEQ ID NO: 13174 - DNA, 761 bp, Panicum virgatum
  misc_feature: Ceres CLONE 1768851
  misc_feature: Encodes the peptide sequence at SEQ ID NO. 13175
taagctgccaatgctgggcgagctccacgggcaccatgctctcttgatgaggaggagttagccgccgccgccgccgcggcagccgaaacgagcaggccgatcccggcgcaccggagggtgaagagcatgggcatcagcagcagcagccggtcggcgcggcacccgttcgaccggcaggcgagcaagacctcgtcgtcgggcaccttcaagctgcgctccagcaggagcaccaggacgccggtcatgtcggcggaggaggagaagccagcggggccgaggtcccggaggggcgaggacgcttcgtcggggagcgccggcagaggcatccagctcaggatcaggagcctccggcggcggggcgtcggtgggtctggcggcgccggcgccggcttcgtggtgccggcggtggcgctgaggcaccagaagacgctggagaagaagaggagccagaggctgtacaacaacctgatcgaggagacggcgagcaagctcgtgaaggcgaggaagagtagggtgaaggccctggtgggggcctttgagtccgtcatctccaagatcgccaagtagctaggaagcagcagcaggcatgtctagtaacacatggtgcagagtttaattttgtcttgcatttttgttgatctggagtgagtttgtcctccttgttggttcactcagggctcaactggggactctctgagtctctgtagggatgtgtttgaaagttttgtgataaagcaatcagacatcaacctgtttgtgac

SEQ ID NO: 13175 - protein, 146 aa, Panicum virgatum
  misc_feature: Ceres CLONE 1768851
  misc_feature (43)..(142): Pfam Name: CaM_binding Pfam Description: Plant calmodulin-binding domain
MGISSSSRSARHPFDRQASKTSSSGTFKLRSSRSTRTPVMSAEEEKPAGPRSRRGEDASSGSAGRGIQLRIRSLRRRGVGGSGGAGAGFVVPAVALRHQKTLEKKRSQRLYNNLIEETASKLVKARKSRVKALVGAFESVISKIAK

SEQ ID NO: 13176 - DNA, 804 bp, Panicum virgatum
  misc_feature: Ceres CLONE 1768907
  misc_feature: Encodes the peptide sequence at SEQ ID NO. 13177
tcatatcccttgtgcataaccttatatgtcagctgctgcactacttctcagccccgaaggaaagactgtgtatcaaagagcgggtagtgcttgatctccttgtttgccttcagaaccagaagcaatgacatctgctactctcaagtcatctttccttcccaagaaggccgaatggggtgccacgcgccaggttgctgctcccaagccggtgactgtctccatggttgtccgtgctagcgcctacgctgatgagcttgtccaaaccgtgaaaaccatcgcatcaccaggaaggggtatccttgccatggatgagtcgaacgctacctgcggcaagaggcttgcctccattggccttgagaacaccgaggccaaccgccaggcttacaggaccctcctcatcagtgctccaggcctgggacagtacatctctggtgctatcctcttcgaggagaccctctaccagtcaactgttgatggcaagaagattgtagacattcttgttgagcagggaatcgtgcccggtatcaaggtcgacaagggtcttgtgccacttgctggctccaacgacgagtcatggtgccaaggtcttgatggccttgcttcacgtgaagcagcctactaccaggctggtgcccgcttcgccaaatggcgcactgttgtcggcatccccaacggtccatctgaacttgccgtgaaggaagctgcctggggccttgcccgctacgccgccatttctcaggaaaacggcctggtgccaattgtggagcctgaaatccttcttgacggtgagcacggcatcgagag

SEQ ID NO: 13177 - protein, 226 aa, Panicum virgatum
  misc_feature: Ceres CLONE 1768907
  misc_feature (43)..(226): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
MTSATLKSSFLPKKAEWGATRQVAAPKPVTVSMVVRASAYADELVQTVKTIASPGRGILAMDESNATCGKRLASIGLENTEANRQAYRTLLISAPGLGQYISGAILFEETLYQSTVDGKKIVDILVEQGIVPGIKVDKGLVPLAGSNDESWCQGLDGLASREAAYYQAGARFAKWRTVVGIPNGPSELAVKEAAWGLARYAAISQENGLVPIVEPEILLDGEHGIE

SEQ ID NO: 13178 - DNA, 642 bp, Panicum virgatum
  misc_feature: Ceres CLONE 1768907-R
  misc_feature: Encodes the peptide sequence at SEQ ID NO. 13179
tcaagcccagcatggtcacccctggtgctgagtgcgaggacagggccacccctgagcaagtcgccgactacaccctcaagctcctccacagaaggatccctcctgccgtccctggcatcatgttcctgtctggtgggcagtctgaggttgaggcgaccaagaacctgaacgccatgaaccagggccccaacccgtggcatgtgtccttctcctactccagggctctccagaacacctgcctcaagacatggggcggccggcctgagaacgtgaaggcggcgcaggacgccctgctcctccgcgccaaggccaactccctggcgcagctcggcaagtacaccagcgacggcgaggctgccgaggtcagcgagggcatgttcgtcaagaactacgtctactaagtagacgacgatgctcgctgctagtacctgctacctcgagggcaccgtaggcagtgtgccattacaggttcagacaatgaaaaaaaatgtacactgcagttttactatcctagctagggtgtgcggaatggttattgtattttcgcatgcttttctagagcgttgtgaccttgcctgcctctgtattttatcgacaatctcgagtagccaaatctttgtgacctgtggatttggttactgc

SEQ ID NO: 13179 - protein, 132 aa, Panicum virgatum
  misc_feature: Ceres CLONE 1768907-R
  misc_feature (1)..(132): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
KPSMVTPGAECEDRATPEQVADYTLKLLHRRIPPAVPGIMFLSGGQSEVEATKNLNAMNQGPNPWHVSFSYSRALQNTCLKTWGGRPENVKAAQDALLLRAKANSLAQLGKYTSDGEAAEVSEGMFVKNYVY

SEQ ID NO: 13180 - DNA, 1186 bp, Panicum virgatum
  misc_feature: Ceres CLONE 1768911
  misc_feature: Encodes the peptide sequence at SEQ ID NO. 13181
gcgcgtgctctgctcctgcgccaccaccacccccgctgctcgcccggccgcttcgagcaggtgcgtgcgggtccgctagatcgccgcggagcttccatttccgattaggaaggaaggaatcggggggcggagatgcacgccaagtcggagtcggacgtgacgagcctggcggcgtcgtcgccgccgcggtcgccgaagcgggccggcggggtcggcgggggcaacaactactacgtgcagagtccgtcgcgggagtcgcacgacggcgggtacaagtcctcgtcgatgcaggccacgccggtgttcaacagccccaacgagtcgccgtcgcacccatcctacggccgccactcgcgctcctcctccgtcagccgcttctcggggaacctccggaagggcgccggcggggagcgcaaggcgctcaacgacaagagctggcccgagtgcaacgtcatcgaggaggaggggccctacgaggacctcgccggcgacagcggcctctcccgccgctgccagatcatcctgggcttcctcaccttcgtcctgctcttcaccgtcttctgcctcgtcatctggggtgccgcgcggccgtacgagcccgaggtcatcgtcaagagcttggtgatggacgacttctatgcgggtgaaggcacggaccacagtggggttccaaccaaattggtcacgacgaactgttctctgcatatatctgtgtacaaccctgctacaatgtttggaattcatgtcacctctggccccattcatctgatctattcagagatctcaatcgccgtcggccagcttcgcaggtactaccaaccgaggaagagccaccgtgtggtgacggccgtcatccacggcgagaaggtgcccctctacggtgctggcggcagcctgatgctgtcgagcacaggcggggctgtgcccctgaagctggactttgacctgacctcccggggctacgtgatcggcaagctcgtccgggtcacgcacaaggtgcacgtgacgtgccccgtcgtcgtcgacgccaagaagaccaagcccatcaggttctccaagaaggcctgcgccgtgtacaaggcctgagcttgagctttttcatgcgtcgtgatcgacggacatgtgtgcgttcgtgcaaagatgtctgtatttagctattgtgttgatgaagaagaacaataagcac

SEQ ID NO: 13181 - protein, 317 aa, Panicum virgatum
  misc_feature: Ceres CLONE 1768911
  misc_feature (148)..(293): Pfam Name: Hin1 Pfam Description: Harpin-induced protein 1 (Hin1)
MHAKSESDVTSLAASSPPRSPKRAGGVGGGNNYYVQSPSRESHDGGYKSSSMQATPVFNSPNESPSHPSYGRHSRSSSVSRFSGNLRKGAGGERKALNDKSWPECNVIEEEGPYEDLAGDSGLSRRCQIILGFLTFVLLFTVFCLVIWGAARPYEPEVIVKSLVMDDFYAGEGTDHSGVPTKLVTTNCSLHISVYNPATMFGIHVTSGPIHLIYSEISIAVGQLRRYYQPRKSHRVVTAVIHGEKVPLYGAGGSLMLSSTGGAVPLKLDFDLTSRGYVIGKLVRVTHKVHVTCPVVVDAKKTKPIRFSKKACAVYKA

SEQ ID NO: 13182 - DNA, 610 bp, Panicum virgatum
  misc_feature: Ceres CLONE 1768923
  misc_feature: Encodes the peptide sequence at SEQ ID NO. 13183
cgacccccagaagcacaagggcaaccgcgccgccgaggagaaggacacggcaccccccaccgaacaccagaagagcacccagaagccgcgcggcccgacgcgcgcggggcgggcgcaggccgcggcgacggcgcccgcggccaccccgggggccagcaccagcacgtttttcaacaagaagacgctgcggcagggggtggtggtgatcacgggcgcgtcctcggggctgggcctggcggcggccaaggcgctggcggagacgggcaagtggcacgtcgtcatggcgtgccgcgacttcctcaaggcggccaaggcggccaagggcgccggcatggcggagggcagctacaccatcatgcacctggacctggcctccctcgacagcgtccgccagttcgtcgacaacttccgccgcgccggcatgccgctcgacgccctcgtctgcaacgccgccatctaccgccccacggcgcggacgccgacgttctcggcggacgggtacgagatgagcgtgggcgtcaaccacctgggccccttcctcctcgcgcgcctcctcctcgacgacctccgcaagtccgactacccgtcgcggcggctcgtcatcctcggc

SEQ ID NO: 13183 - protein, 202 aa, Panicum virgatum
  misc_feature: Ceres CLONE 1768923
  misc_feature (65)..(202): Pfam Name: adh_short Pfam Description: short chain dehydrogenase
  misc_feature: SWISSPROT Homolog: EC 1.3.1.33 Protochlorophyllide reductase
DPQKHKGNRAAEEKDTAPPTEHQKSTQKPRGPTRAGRAQAAATAPAATPGASTSTFFNKKTLRQGVVVITGASSGLGLAAAKALAETGKWHVVMACRDFLKAAKAAKGAGMAEGSYTIMHLDLASLDSVRQFVDNFRRAGMPLDALVCNAAIYRPTARTPTFSADGYEMSVGVNHLGPFLLARLLLDDLRKSDYPSRRLVIL

SEQ ID NO: 13184 - DNA, 592 bp, Panicum virgatum
  misc_feature: Ceres CLONE 1768924-R
  misc_feature: Encodes the peptide sequence at SEQ ID NO. 13185
gagttcaaattcccacagatcaaagcacacccatggcacaaggtatttcacaaaaggatgccaccggaagctgttgatctggtgtcccgactgctccagtactcccccaatctaagatgcactgctgttgaggcacttgttcacccattctttgatgagctccgagatcctaatacccgtcttccaaatggacgctttctgccaccccttttcaacttcaagccgcatgaactgaaaggagtcccaacagacatttttgcgaaattgattccagaacatgcaaagaagcaatgcccctatgtgccttgaggccataacccgccactgcatctgtgcattttcccttggaatttggatgattggcggcctgcacacctgttggttgaagatgctaggtcacctgcgtgtacaagtacaacagctgtgacctgtgtagttgagtagtgtatgtcgcaatgacatgtaacggcacccccttctactaaccgactctcacctgagattgccatagctgattttgtaatatgttctagagcagtatgaatgtatttatggtagcttgatctatgtatggattcacttcgtttttcct

SEQ ID NO: 13185 - protein, 102 aa, Panicum virgatum
  misc_feature: Ceres CLONE 1768924-R
  misc_feature: SWISSPROT Homolog: EC 2.7.11.1 Non-specific serine/threonine protein kinase
  misc_feature: Useful for making plants with modulated water use efficiency
  misc_feature: Useful for making plants with modulated biomass
EFKFPQIKAHPWHKVFHKRMPPEAVDLVSRLLQYSPNLRCTAVEALVHPFFDELRDPNTRLPNGRFLPPLFNFKPHELKGVPTDIFAKLIPEHAKKQCPYVP

SEQ ID NO: 13186 - DNA, 752 bp, Panicum virgatum
  misc_feature: Ceres CLONE 1768924
aaatcatttcggccgctgcgtcgcgttgggacttgggagcagtactcctccgttttgcttgcgtcccgacaagcggaaagaagaggcgagggaggtagaaagggggaggaaagaggaggcggagagggggaggaagggggaagcaaatctttgaggggagtcgagagatccctgtggtggaggaggagaagcgcgagcggagcgtagggaggcagctcaatagatctacgacagcttatgtgagttgatgcaaagctgagttggcattggtgtagccctgtcttcttgagcgatggcctcagcaggtgtagctccggctgggtttttgatcagcagcagcacaagcattggtgctgataagttgcacgatcacatgaacgagctaaagattagagatgataaggaagttgaagcaaccataattaatgggaaaggtacagaaactgggcacataattgtgactactactggtggaaagaatggtcaaccaaagcagacagtgagctacatggctgaacgcattgtaggtcaaggttcttttgggattgtcttccaggctaaatgcttggagacgggtgagactgttgccataaagaaggtccttcaggataaacgttacaagaaccgtgagctgcaaaccatgcgccttcttgaccacccagatgttgtcgctttgaagcattgcttcttttcaacaactgagaaggatgaactatatctaaacttggttcttgagtatgtgcctgagactg

SEQ ID NO: 13187 - DNA, 831 bp, Panicum virgatum
  misc_feature: Ceres CLONE 1768929
  misc_feature: Encodes the peptide sequence at SEQ ID NO. 13188
gcactaccgccctgcgggcaagaagaaggaggggaatgccgcgaagtacatcacgaggaccaaggcggtcaactacctgcaagtcagccttgcaatcttcaggaagctatgcattctcaagggcgtttttcctcgtcaaccgaagaagaaggtggaaggaaaccacaagacttactaccacatgaaggatattgcctttatcgctcacgaccctttgatcgagaagttcaggcaaatcaaggtccacagaaagaaggttaagaaggctattgctaagaaaaacagggatcttgcggacagactgttgaatcgaccaccaacttacaagcttgataggctggtccttgaaagatatcctgcatttgttgatgctcttcgagacttggatgactgccttacattggttcatctgtttgcggcattacctgctgttgatggtgaacgtgttaaagtcaaacggatccatagctgccgcaggttaagccatgaatggcaagcatacatatccagaactcattccctgaggaagacatttatttctgtgaagggcatatattaccaggctgaagttcaaggacaaaagatcacttggttaactcctcatgctcttcagcaagtattaactgatgatgttgacttcaatgtgatgcttagttttttggaattctacgagactcttcttggatttgtaaacttcaagctctaccattcaattaatgtaaattatcccccaattttggatcctcgcttggaagctttaactgctgagctctatgcactatgccgatacatctccactggttctgggagagtgactggaaattcagaatt

SEQ ID NO: 13188 - protein, 276 aa, Panicum virgatum
  misc_feature: Ceres CLONE 1768929
  misc_feature (5)..(276): Pfam Name: Pescadillo_N Pfam Description: Pescadillo N-terminus
HYRPAGKKKEGNAAKYITRTKAVNYLQVSLAIFRKLCILKGVFPRQPKKKVEGNHKTYYHMKDIAFIAHDPLIEKFRQIKVHRKKVKKAIAKKNRDLADRLLNRPPTYKLDRLVLERYPAFVDALRDLDDCLTLVHLFAALPAVDGERVKVKRIHSCRRLSHEWQAYISRTHSLRKTFISVKGIYYQAEVQGQKITWLTPHALQQVLTDDVDFNVMLSFLEFYETLLGFVNFKLYHSINVNYPPILDPRLEALTAELYALCRYISTGSGRVTGNSE

SEQ ID NO: 13189 - DNA, 812 bp, Panicum virgatum
  misc_feature: Ceres CLONE 1768930
  misc_feature: Encodes the peptide sequence at SEQ ID NO. 13190
gaacagagccacgcccacgcttatatcaccagctgtccggctcgctccccgcaccacccccacctccgccggctcctgccaccgcccgctggcatagcgcgtaggccgcgagaggagcaccggcgggccgcaggtaggggccaggggtgagggagaccaggggggcgcgggggatctcggtgcgcgcgcgtttgcggcgcaggcggcatgaagctcccgctgtggccggggctggcgcccgcggcggggccgcccgacgcggcgccggagccggccaagccgtcgctgccggccgcgtggctgctgctgcacgcgctcttctgcgccacctccatggccgtgggcttccgcttctcgcgcctcatcgtctacctcctcttcctgccgacgccgcccatcaacccggccgcgcacctcgtctcgctcgtgtccccgcccgtcatgctcgccgccggcaacgccacggccacgatcaccaccaccaccaccaccaccaccaccaccgtcaccaccaccaccacggtcgccgccgagatcggggcccacccgcaccaccaccaccacggccccgtcttcgtggggcgccacccgatccgcgtccgcccgtggccgcacccggaccccaacgagctgctcaaggcccaccgcatcctcgccgccatccagaacgcgcagcgcaccagcaagcgccgcggcgccgagccgccgaggcccgtcattgccgtcaccccgaccaccacctccgcgctccaggtgccgtccctgacgtcgctggcgcacacgctccgactcgtggacgcccagctcatgtg

SEQ ID NO: 13190 - protein, 201 aa, Panicum virgatum
  misc_feature: Ceres CLONE 1768930
  misc_feature: Useful for making plants with altered carbohydrate content
MKLPLWPGLAPAAGPPDAAPEPAKPSLPAAWLLLHALFCATSMAVGFRFSRLIVYLLFLPTPPINPAAHLVSLVSPPVMLAAGNATATITTTTTTTTTTVTTTTTVAAEIGAHPHHHHHGPVFVGRHPIRVRPWPHPDPNELLKAHRILAAIQNAQRTSKRRGAEPPRPVIAVTPTTTSALQVPSLTSLAHTLRLVDAQLM

SEQ ID NO: 13191 - DNA, 2063 bp, Panicum virgatum
  misc_feature: Ceres CLONE 1768939
  misc_feature: Encodes the peptide sequence at SEQ ID NO. 13192
aaaacggtacacacaccactactccctggctcagctccctcctccctcctcccctctctctgtcctccattgcgagaggctcccggggcgcgcgagctctgaagccatggcagccgcggccgggagcccttggcgcagcgctgggcccgtcgcgtctctcgctctcctcctcctcctcgccaccgccgccgcgcccgcggcagccggcggcgggtccacggccgtgaacgggaaccgcctccgggcggagcagatccggaagcaggcctcggacgccgccgcctcggccgccgcgctcgccgcggcgtcgcgccgcctccacctcgaccgcgcgcgccacctccgcctcctctcctcgctccaccgcaacctcaccaacacgctccgcgccctctccctcgccgccgacgcggacccctccgcctccgaccccgccgccaacgcctcgtccccacgccagctcgacctccaggccaaggacctgatccgcgccgcgcgcgccgccatcgccgaatccaagccgctcttcgacccgcagctcaagatccagcgcctcaaggacgccatcttcgcgcagaacgagctgctcgcgcgcgccaagaagcgcggcgccttcgcctccctcatcgccgccaagtccatccccaagccgctccactgcctcgccgtccgcctcaccgccgagcggatcgcgacgcccgagcagtacgcggacccggtgccgccgccgcgggcgctcgaggaccccgcgctcttccactacgccatcttctccgacaacgtgctcgcggcctcatgcgtcgtgcgctccgccgtcgccaactccaacgacccctccaagcacgtcttccatgttgtcaccgaccggatgaacctcggcgccatgcaggtgataatacaccgaatggacttaaaaggtgcacactatgaggtcaaagcatttgaggattacaagtttctgaactcctcgtatgtccctgttctccggcaactggagtccgcaaaccttcaaaaattctattttgagaacaagcttgagaatgccaccaaagatgctagcaatatgaagttcaggaatccaaagtatctatctatgctcaatcacttgcgattctatttgccggagatgtacccaaagctgcaccggattcttttcttggacgatgatgttgtggtacagagggatcttacaggactgtggaagattgacatggatgggaaagtgaatggagccgtagaaacatgctttgggtcttttcatcggtattggcagtacatgaacttctcacacccccttatcaaagcaaagtttagtcctaatgcctgtggatgggcatatggcatgaacttctttgatcttgattcttggaggagggaaaagtgtactgagcagtaccattactggcagaatcagaatgagaaccggacattatggaagctaggaacgctgcccccaggcttaatcacattctactccaccacgaagcctctggacaaatcctggcatgttcttgggcttggatacaatccaagcatcagcatggaggagatcaggaatgctgctgttgtgcatttcaatggtaatatgaagccatggctggacatcggtatgaaccagttcaggcacctttggacaaagtacgtggactacgatgacgaatatatacgtcaatgcaattttgcaccaccatagaaggcttaattatctatgtatccattcttcgttggaaaacaaagaagtttggcaattagagctagagactgccactgaagggttacatgttctgtaagcacattttgtgtagagattcaaggagtttgtcagtacaactgaagggaccacaattctttcttgcttataatgtacgtcaccgattaagttatgatgaaaataatgttttccacatgaacattattttcgttatgtctgtaataatgttatgtttgtgatagcgtgtgcatgccgaactcagatatataatgttcatatgggttcaagaactaaactttcagttatgtatccacgcattattcaatgcatttagaagaggctttactagacc

SEQ ID NO: 13192 - protein, 528 aa, Panicum virgatum
  misc_feature: Ceres CLONE 1768939
  misc_feature (185)..(501): Pfam Name: Glyco_transf_8 Pfam Description: Glycosyl transferase family 8
  misc_feature: Useful for making plants with altered carbohydrate content
  misc_feature: Useful for making plants with altered cell wall content and/or composition
MAAAAGSPWRSAGPVASLALLLLLATAAAPAAAGGGSTAVNGNRLRAEQIRKQASDAAASAAALAAASRRLHLDRARHLRLLSSLHRNLTNTLRALSLAADADPSASDPAANASSPRQLDLQAKDLIRAARAAIAESKPLFDPQLKIQRLKDAIFAQNELLARAKKRGAFASLIAAKSIPKPLHCLAVRLTAERIATPEQYADPVPPPRALEDPALFHYAIFSDNVLAASCVVRSAVANSNDPSKHVFHVVTDRMNLGAMQVIIHRMDLKGAHYEVKAFEDYKFLNSSYVPVLRQLESANLQKFYFENKLENATKDASNMKFRNPKYLSMLNHLRFYLPEMYPKLHRILFLDDDVVVQRDLTGLWKIDMDGKVNGAVETCFGSFHRYWQYMNFSHPLIKAKFSPNACGWAYGMNFFDLDSWRREKCTEQYHYWQNQNENRTLWKLGTLPPGLITFYSTTKPLDKSWHVLGLGYNPSISMEEIRNAAVVHFNGNMKPWLDIGMNQFRHLWTKYVDYDDEYIRQCNFAPP

SEQ ID NO: 13193 - DNA, 851 bp, Panicum virgatum
  misc_feature: Ceres CLONE 1768940
  misc_feature: Encodes the peptide sequence at SEQ ID NO. 13194
aatgactcgaggccgccgtcgagcatcgttggagatcaccaccaccaccaggacggcagcatggcgcgcggcgcgggcggcgacgacgggccgcagcaggcgcacgacatggtgatgccgggcttccgcttccacccgacggaggaggagctcatcgacttctacctccgccggagggtggagggcaagcgcttcaacatcgagctcatcaaccttgtcgacctctaccgctacgacccgtgggatctccccgctttggcttcaattggggacaaggagtggttcttctacgtgccaagagaccgcaagtaccgcaacggcgacctttcgaaccgggtcactccatcaggctactggaaggccacaggggcagatcggatggtgcgcgttgagggcaaccggtccatcgggctgaagaagactctggtgttctatgtggggaaagcacccaagggacttaggagcagctggatcatgaacgagtaccgccttcctcacggcgaggccgaccggtaccaaaaggagatttccctttgccgagtgtataaacgtcctgggattgaagacaactttcacctcaccaccaccgcaagatcatccggctcaaaggcggcggcttcgatggaaaagaagcaccatcggacgtcggcgtcgccccgcttggcaccaatgttcgatggtgcccactcatcagctcacatgagcaaggcatacagtggaacaaacaccatcatggcatcatcagctgcagctcgagcagcaacaatggcgcctcagacatcaatggctttcctgtcaaccgcctcgcttagctccaccacgtcaacggaggaggatggtacatcactcta

SEQ ID NO: 13194 - protein, 263 aa, Panicum virgatum
  misc_feature: Ceres CLONE 1768940
  misc_feature (18)..(145): Pfam Name: NAM Pfam Description: No apical meristem (NAM) protein
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 2 in US patent 7230164
  misc_feature: The sequence is a functional homolog of SEQ ID NO 6 in US patent 7230160
MARGAGGDDGPQQAHDMVMPGFRFHPTEEELIDFYLRRRVEGKRFNIELINLVDLYRYDPWDLPALASIGDKEWFFYVPRDRKYRNGDLSNRVTPSGYWKATGADRMVRVEGNRSIGLKKTLVFYVGKAPKGLRSSWIMNEYRLPHGEADRYQKEISLCRVYKRPGIEDNFHLTTTARSSGSKAAASMEKKHHRTSASPRLAPMFDGAHSSAHMSKAYSGTNTIMASSAAARAATMAPQTSMAFLSTASLSSTTSTEEDGTSL

SEQ ID NO: 13195 - DNA, 1942 bp, Panicum virgatum
  misc_feature: Ceres CLONE 1768961
  misc_feature: Encodes the peptide sequence at SEQ ID NO. 13196
attccacgctgcttcggcgcccggcaccaacctcccccttccccacttcgccgccggcgggtggagtcgggccggagcagccgcctttttaccaaagcctgccgaactatccggcggccatggggcacggcgtcagttgcgcccgcaccggcgacgagcacgactacttccgcgcggcgcagctcggggacctcgacgccctcgccgcgctcctcgccgccgacacctccctcgcccgccgcgccacgctctacgaccgcctctccgcgctccacatcgccgccgccaatggacgcctcgaggtgctgtccatgatcttggatcacggggtgacgccggacgtagtgaatcggcacaagcagacgccgctgatgctcgcggcgatgcatggcaagattgactgcgtgctcaggctcctccaggccggcgccaatatcttgatgttcgattcggtgcacaggcggagctgcctgcaccacgctgcctacttcggccatgtcgactgcctgcaggccatcctctcggcggcgcagacgacgccggtggccgactcatggggtttcgcccggttcgtcaacgtcagggacgaccacggcgccacgccgctgcatctcgcggccaggcaggggcggccagggtgcgtgcagatgttgctggagaacggcgccattgtatccgctttgacgggctcatacggattccctggtagcacatcgttgcatctggctgctcgcagtgggaacctggattgcatccggaaactgcttgcctggggggcagatcgtcttcaaagggactctgcagggagaattccctatgctgttgcactgaagcgcaattatgaagcatgtgcggctttgctaaacccttcatcagctgagcccatggtgtggccttccccacttaagttcatcagcgagctcgatccggaagcaaaggctctcctggaagcagccctgatggaagccaacagggagagggagaagaagatcttgaagggcacaaagtactctctgccatcgccttcgcattgcgatgctgatgtcatggacgatgcatcttcagaggtgagcgacgcggagctttgctgcatctgcttcgaccaggcatgcaccatcgaggtgcaggactgcgggcaccagatgtgcgcgccgtgcacgctggcgctgtgctgccacagcaagcccaacccgacgaccctaacgctgccgtcgccagcctgcccgttctgccgcggcagcatctcgcggctgttggtggcccggacaagcacgcccagtgaccccgagaaggcagcctactccccgcagctatcccggcgtcggtctcggcggtctcacaacctcagcgacgggggcagcagcagcttcaaggggctctcgtccgccatgggatccttctccaagatcgggcgcggctcgagccggatggtcgacagcgacagtggcagtctggacaagcccgagcacgacctgtgatttgtgaagcagactggccggcgttcatgtggtaaagcggaagcagccgtcaccgccggcggctttccgagagtcagaagacgggcaatcccaatccaagcaatgtgtcgggagaggtgatcgtgagtttatatagataggagctaaataagtagtgtctcgctatgtctgtctgcctgccctatttttccggcgtgccaggattcacctggccgcgccatattccattgtcaccaccactccagctatagattcgttggcgccccattcctatgctatgcttgcttgagccacaggcatgtaccatcgatgtaactgtcgggggagctcgcctattccattcatggcatcacagacacagtcgggtactgttgctggcggactagcatgatgatctgatggaaccatggaggcagacttgtttttgtttgcaaggtgcatgttgccgcaggggtgtgatgtgg

SEQ ID NO: 13196 - protein, 452 aa, Panicum virgatum
  misc_feature: Ceres CLONE 1768961
  misc_feature (158)..(190): Pfam Name: Ank Pfam Description: Ankyrin repeat
  misc_feature (79)..(111): Pfam Name: Ank Pfam Description: Ankyrin repeat
  misc_feature (195)..(227): Pfam Name: Ank Pfam Description: Ankyrin repeat
  misc_feature (46)..(78): Pfam Name: Ank Pfam Description: Ankyrin repeat
  misc_feature: SWISSPROT Homolog: EC 2.1.1.43 Histone-lysine N-methyltransferase
MGHGVSCARTGDEHDYFRAAQLGDLDALAALLAADTSLARRATLYDRLSALHIAAANGRLEVLSMILDHGVTPDVVNRHKQTPLMLAAMHGKIDCVLRLLQAGANILMFDSVHRRSCLHHAAYFGHVDCLQAILSAAQTTPVADSWGFARFVNVRDDHGATPLHLAARQGRPGCVQMLLENGAIVSALTGSYGFPGSTSLHLAARSGNLDCIRKLLAWGADRLQRDSAGRIPYAVALKRNYEACAALLNPSSAEPMVWPSPLKFISELDPEAKALLEAALMEANREREKKILKGTKYSLPSPSHCDADVMDDASSEVSDAELCCICFDQACTIEVQDCGHQMCAPCTLALCCHSKPNPTTLTLPSPACPFCRGSISRLLVARTSTPSDPEKAAYSPQLSRRRSRRSHNLSDGGSSSFKGLSSAMGSFSKIGRGSSRMVDSDSGSLDKPEHDL

SEQ ID NO: 13197 - DNA, 592 bp, Panicum virgatum
  misc_feature: Ceres CLONE 1768966
  misc_feature: Encodes the peptide sequence at SEQ ID NO. 13198
ctctgcatttccttcttcccgtgggatttcagccgccgccgccgccgcgagaagaagagctcggcgactccccggtcgtacgagaagatgccgaagcagatccatgagatcaaggacttccttctcaccgcgaggaggaaggatgcccggtctgtgaagatcaagaggagcaaggatgttgtcaagttcaaggtgcgctgctccaagtacttgtacaccctctgcgtcttcgatgctgagaaggcaaacaagttgaagcaatcccttcccccaggtttgaccgtccaggaggtttgaagggacacaagacaacatcaagatgtgaactattaaagcttccttatcatcagcagagcattctcttcgatgtacctttggaacctaagcttttagacctgtcagtcatggatttgtagatcttggatttttggagaaataccattttaccgtattccaagatgctgcttttcagtttgattctttctgaactgcaagctgcttgagtatttgtttgtcctgcttcctttcggtttaccaatcagcaatttagatggatgtaagggagacatggttgcgtctacctttggctcag

SEQ ID NO: 13198 - protein, 69 aa, Panicum virgatum; identical to SEQ ID NO: 12286
  misc_feature: Ceres CLONE 1768966
  misc_feature (2)..(69): Pfam Name: Ribosomal_L38e Pfam Description: Ribosomal L38e protein family

SEQ ID NO: 13199 - DNA, 833 bp, Panicum virgatum
  misc_feature: Ceres CLONE 1768969
  misc_feature: Encodes the peptide sequence at SEQ ID NO. 13200
atcctctcctctcctccccgccccgcgccgaagaacccccggccaaacccccagcccgtgataacctcgcacctgccttcgccccgtcgaccatggcgctccaggcggcgacgtccttcctcccctcggccctctccgcgcgcaaggaggggtcggtgaaggactcggcgttcctgggtgttcgtctcgcggatggcctcaagctggagaccagcgctctgggccagcgcaccaagagggcgagcacgtcggtggccatccgcgcgcagacggcggcggtgtcctccccgtcggtgacgcccgcgtcgccgtcgggcaagaagaccctccgcaagggcaccgcggtcatcaccggcgcgtcgtcgggcctcggcctggccacggcgaaggccctggcggagaccggcaagtggcacgtcatcatggcgtgccgcgacttcctcaaggcgtcgcgcgcggccaaagcggcgggcatggacaaggacagctacaccatcgtgcacctggacctggcgtccctggacagcgtccgccagttcgtgaagaacgtgcggcagctggagatgcccatcgacgtggtggtctgcaacgccgccatgtaccagcccaccgccaaggagccctcctacaccgccgacggcttcgagatgagcgtcggcgtcaaccatctcggccacttcctcctcgcctgcgagctcctcagcgacctccagtcctccgactacccctccaagcgcctcatcatcgtcggctccatcaccgggaacacgaacacgctggccgggaacgtgccgccgaaggcgaacctgggcgacctgcgcgggctcgccggc

SEQ ID NO: 13200 - protein, 246 aa, Panicum virgatum
  misc_feature: Ceres CLONE 1768969
  misc_feature (82)..(230): Pfam Name: adh_short Pfam Description: short chain dehydrogenase
  misc_feature: SWISSPROT Homolog: EC 1.3.1.33 Protochlorophyllide reductase
MALQAATSFLPSALSARKEGSVKDSAFLGVRLADGLKLETSALGQRTKRASTSVAIRAQTAAVSSPSVTPASPSGKKTLRKGTAVITGASSGLGLATAKALAETGKWHVIMACRDFLKASRAAKAAGMDKDSYTIVHLDLASLDSVRQFVKNVRQLEMPIDVVVCNAAMYQPTAKEPSYTADGFEMSVGVNHLGHFLLACELLSDLQSSDYPSKRLIIVGSITGNTNTLAGNVPPKANLGDLRGLA

SEQ ID NO: 13201 - DNA, 626 bp, Panicum virgatum
  misc_feature: Ceres CLONE 1768969-R
  misc_feature: Encodes the peptide sequence at SEQ ID NO. 13202
ccaccggcggtaccacgaggagacgggcgtgaccttcgcgtcgctctacccggggtgcatcgccaccacggggctgttccgggagcacatcccgctgttccggctgctgttcccgccgttccagaagtacatcaccaaggggtacgtctccgaggaggaggccgggaagcgactggcgcaggtggtgagcgaccccagcctcaccaagtccggcgtctactggagctggaacaagaactcggcgtccttcgagaaccagctctccgaggaggccagcgacgccgacaaggccaagaagctctgggagatcagcgagaagctcgtcggcttggcatgatcgatgtacatcaccatgcccggcgccggctgccggtgacagttttttttaattcccctctaggacaagttcgttagttgatctcagacagagtgttaatgcccccgcgtcaagagtgccaagaacacaagtgtgtacacgtgtacaatatatgctactgcaccgtgatggtttttgcagtggactgtaactctagccttttgctctgcttttggtcattgattacgggtaataagaagtcactattgggctaccaaaatcaaatcagcaattgcctttcagcaacttc

SEQ ID NO: 13202 - protein, 111 aa, Panicum virgatum
  misc_feature: Ceres CLONE 1768969-R
  misc_feature: SWISSPROT Homolog: EC 1.3.1.33 Protochlorophyllide reductase
HRRYHEETGVTFASLYPGCIATTGLFREHIPLFRLLFPPFQKYITKGYVSEEEAGKRLAQVVSDPSLTKSGVYWSWNKNSASFENQLSEEASDADKAKKLWEISEKLVGLA

SEQ ID NO: 13203 - DNA, 1720 bp, Panicum virgatum
  misc_feature: Ceres CLONE 1768975
  misc_feature: Encodes the peptide sequence at SEQ ID NO. 13204
gtctggacttgctcttcttcgagaagaacaccccagcctcccttgccacgtctctttaccttgccacctcatctcactgacccccccaagtccctgagcccatccaatcccaactccatctctcttccccgcggcgcgagcaagggcgacgccggccgcgacggggctccgccagccaggaccgccacgacggcggcgtcggcgggaacccggcttccgctccatctcctcactcaccccctctgatcacttctgactcgtgaaaatggtggatgaactgcgttctatgtctgtggtccagaaggttcatgggcagtccgtgttgttgagcagaatctcttcttgttctgccatgaataaccctgtattcaacaatgcgtattctgcctacaatgtgccccggaggtcataccacaggatgaatgcaactgttggactttcctctgtcatggcaccatctcctttctttgcttctgccccaaaagagaaaggtttttcaggatttatgattgactttctaatgggtggagtttctgctgctgtttccaagacagctgctgctccaattgagcgtgtcaagcttttgattcagaaccaggatgaaatgctcaagagcggcaggctttctgaaccgtacaagggtattggggagtgctttacccggacaatcaaagatgagggttttgtctcactgtggaggggcaacacagctaatgtcatccgttacttccccacacaggcattgaactttgccttcaaggaccacttcaagcgtatgttcaactttaagaaggacaaggatggatactggaagtggtttgctggcaacctggcttctggaggagctgctggtgcttgctctctcttctttgtttattctctggactacgctcgtacgcgtttggccaatgatgccaaagctgcaaagaagggtggtgagaggcagttcaatggactcgttgatgtttacaaaaagacccttgccagtgatggtatccgcggcctctaccgtggattcaatatctcttgtgtgggaatcattgtctaccgtggtctttactttggaatgtacgattccctcaagccagtgcttcttgttggttccctgcaggataacttcttggccagcttcttgctcggctggggcataaccattggtgctggtcttgcctcgtaccctattgatactgttcgccgccgcatgatgatgacatctggtgaggctgtcaagtacaacagttccttggatgccttcaagcaaattgtcgcaaaggagggtaccaagtccctcttcaagggcgctggcgcgaacatcctccgtgctgttgctggggctggtgtccttgctgggtacgacaagctccaggtgattgtcttcggcaagaagtacgggtctgggggcggctaagagtagatgatgatgatgatgatgaacaacaaataggatgttttaggtgcctttaaataacatacacatggacggcggacaccatttttaaattcagcacttggaagaggttgttgacttggtttgtaatgcggttgtcaccgcttctctttttgcgtgggagattgaaataagttaagttagaaattacagccctgcagaccttaaatcatggtagtcccgcagtggatcgatgtttgcttgtattggttacatttggttttgcgcgtgcaaatggttgctcgaacgggacctaagtaggttccagaatcc

SEQ ID NO: 13204 - protein, 380 aa, Panicum virgatum
  misc_feature: Ceres CLONE 1768975
  misc_feature (79)..(176): Pfam Name: Mito_carr Pfam Description: Mitochondrial carrier protein
  misc_feature (184)..(280): Pfam Name: Mito_carr Pfam Description: Mitochondrial carrier protein
  misc_feature (284)..(374): Pfam Name: Mito_carr Pfam Description: Mitochondrial carrier protein
MVDELRSMSVVQKVHGQSVLLSRISSCSAMNNPVFNNAYSAYNVPRRSYHRMNATVGLSSVMAPSPFFASAPKEKGFSGFMIDFLMGGVSAAVSKTAAAPIERVKLLIQNQDEMLKSGRLSEPYKGIGECFTRTIKDEGFVSLWRGNTANVIRYFPTQALNFAFKDHFKRMFNFKKDKDGYWKWFAGNLASGGAAGACSLFFVYSLDYARTRLANDAKAAKKGGERQFNGLVDVYKKTLASDGIRGLYRGFNISCVGIIVYRGLYFGMYDSLKPVLLVGSLQDNFLASFLLGWGITIGAGLASYPIDTVRRRMMMTSGEAVKYNSSLDAFKQIVAKEGTKSLFKGAGANILRAVAGAGVLAGYDKLQVIVFGKKYGSGGG

SEQ ID NO: 13205 - DNA, 801 bp, Panicum virgatum
  misc_feature: Ceres CLONE 1768979
  misc_feature: Encodes the peptide sequence at SEQ ID NO. 13206
gacgcacgcagccaaaaagcacacggggcagagctcgactgctcgatgaggcgggaggcgatcgggatggccgctcctcttgcgtagcagagtgttgcttgcctgctgcttccgtcacttgccattgccactgcgtgagcgagaggaaggcggcgtgaagggagcagctaaggatcgaggaaatggcggcgcgcggccacgtgctggcgctgttcgtgctgctcgcgctcgccggggcggccgcggcgggcggcgggcggcaccagcaccggcaccggcacggcaggaagtcggcgcggctgaggctgatcccctccacgccgggcgcgtccctcgccgaccgcgcgcgggacgaccggcaccggcacgcgtacatccggtccacgctggcgtcgcgccgccgcgcggcggaggtgggcgcgtcggcgttcgccatgccgctctcgtcgggggcctacaccggcacgggccagtacttcgtgcggttccgcgtgggcacccccgcgcagccgttcgtgctggtggcggacaccggcagcgacctcacctgggtcaagtgccgcggcgccggatcgccgccggacgcgcagccgccggcgcgcgagttccggcccgccgcctccaagtcgtgggcgcccatcgcgtgctcctccgacacgtgcacgtcgtacgtgcccttctccctcgccaactgctcgacgccggccagcccctgcgcctacgactacaggtacaaggacggctccgcggcgcgtggcgtggtgggcacggactcggcgaccatcgcgctgtccgggaacg

SEQ ID NO: 13206 - protein, 206 aa, Panicum virgatum
  misc_feature: Ceres CLONE 1768979
  misc_feature: SWISSPROT Homolog: EC 3.4.23.12 Nepenthesin
MAARGHVLALFVLLALAGAAAAGGGRHQHRHRHGRKSARLRLIPSTPGASLADRARDDRHRHAYIRSTLASRRRAAEVGASAFAMPLSSGAYTGTGQYFVRFRVGTPAQPFVLVADTGSDLTWVKCRGAGSPPDAQPPAREFRPAASKSWAPIACSSDTCTSYVPFSLANCSTPASPCAYDYRYKDGSAARGVVGTDSATIALSGN

SEQ ID NO: 13207 - DNA, 1640 bp, Panicum virgatum
  misc_feature: Ceres CLONE 1768984
  misc_feature: Encodes the peptide sequence at SEQ ID NO. 13208
atgcatatggaagcacataggcatagcacaactatggtcgccacacgtgtgagcaaggatttaaaaacgatcgtacgtgcaagctaagtgctcactagcagtagcaaagttcacggcatggcgacaccttctgctctcatcttgctcctcgtgcccgtccttgcctccatggccgctacagggactgcttcctttgagctccgcgccgagctcaaccacccctacgccggcagcccgctttccaggtacgagatggtccgcgaggccaccagcgcgagcaaggcccggcgcgcttggaccgccgctaggctggccaaagcgtgcgggcgcggcggtagcggcggcaccacctccgcgccggacgtgccggtcacccgcgtcgccaggtccttgtacaccgtgaccgtcggcgtcggcactccgccgcagcggcacacgctcgtccacgacacgggcagcgacctcgtctgggttttctgcaagctggtgggcggcgccgccacgccgaccgaccctctctacaacccggacaagtcgtcctccttcgccgccgtcccctgcgacagcaagctgtgccgggagggcggattcgagtccaagaactgctccaggaacaggtgcctctacacctacgcgtacggcagcggccggacctacggcgagcttgcgtccgaggtcttcacgttcggcgcgcaccacaaggtcccggccaccctcaacttcgggtgcgggaggttcttgaagggcgacatcttcaacgcctccggcttcctagggctcagcccgaacaagctgtccttcgtgacgcagctgaagataccaaggttctcctactgcctcactccttacaccgaccgcaagagtggccacatgttcttcggcgccatggccgacctgtccaggtacaggaccacggggccgatccagaccacttccttactgaacaaccgggtcggcatcaacatctactacttcgtgcccctgatcggcgtctcgatcggggccaagaagctcgacgtccctgcatcgagcttcgacgacacattcgtcgactccggctacacgaccggcgccctcacggccccagcgctggacgccctcaaggaggcgctggtggatgccctgaagctgccgcggaggagctcctccgatccggactacgatttctgcttccagctgccgcgcggcgtgcccatggaggcggtgccggcgccgccgctggtgtaccacttcgagggcggcgccgcgatggtgctgccccgggagagctacctcgccgagccgagccccggggagatgtgcctagtgatcggggttgattcgcagccggtcatcggcaacttccagcagcagaacatgcacgtgctcttcgacgtgcagaaccagaagttctccttcgcgccaactcagtgtgaccaaatctgagttgtgacctacatgagcctctgctgctctacattggaatggagtagagcacggaagagttattttctgctgtagtatagtgtaagtttcagtcaggaaagaaataatccgacacgagggctgaggggtcggctacggctaaggtcatcatcatgcccacctcactgtaaggtcgttcatggatgctacctgtgtaatatagttagtttgggttc

SEQ ID NO: 13208 - protein, 435 aa, Panicum virgatum
  misc_feature: Ceres CLONE 1768984
  misc_feature (92)..(430): Pfam Name: Asp Pfam Description: Eukaryotic aspartyl protease
  misc_feature: SWISSPROT Homolog: EC 3.4.23.12 Nepenthesin
MATPSALILLLVPVLASMAATGTASFELRAELNHPYAGSPLSRYEMVREATSASKARRAWTAARLAKACGRGGSGGTTSAPDVPVTRVARSLYTVTVGVGTPPQRHTLVHDTGSDLVWVFCKLVGGAATPTDPLYNPDKSSSFAAVPCDSKLCREGGFESKNCSRNRCLYTYAYGSGRTYGELASEVFTFGAHHKVPATLNFGCGRFLKGDIFNASGFLGLSPNKLSFVTQLKIPRFSYCLTPYTDRKSGHMFFGAMADLSRYRTTGPIQTTSLLNNRVGINIYYFVPLIGVSIGAKKLDVPASSFDDTFVDSGYTTGALTAPALDALKEALVDALKLPRRSSSDPDYDFCFQLPRGVPMEAVPAPPLVYHFEGGAAMVLPRESYLAEPSPGEMCLVIGVDSQPVIGNFQQQNMHVLFDVQNQKFSFAPTQCDQI

SEQ ID NO: 13209 - DNA, 729 bp, Panicum virgatum
  misc_feature: Ceres CLONE 1769005
  misc_feature: Encodes the peptide sequence at SEQ ID NO. 13210
tcctgtgatctccttccgttcccaagctagctagcagacgcacaaggccgcggatccatgggcgtcttcacggtgaccaagctgtccgagggcccggtgcggccgtccgccgccacgccgtcggagacgctgcccatggcctgggtggaccggtacccgacgcaccgcggcctcgtcgagtccgcgcacatctaccgcaacgtcgccggcgacatctctccggcgccggcagggctagaggaggctggtggtggcgcgggcgccgatgccgccgcccccagactcgccctgcaggcgccggacaaggaggcgatggtgaacggcaagtccccggccgcggtggtgcgcggcgcgctggcggacgcgctggtgcactactacccgttcgcggggcggatcgaagaggacgtccccggccgccccgccgtgcggtgctccggcgagggcgtctacttcgtggaggccgccgccaactgcaccctcgccgacgtcaacttcctcgagcgcccgctgctgctcgccaaggagcagctcgtgccgtgcccgacgccggagctctggcccgtcgagccacacaacaccctcgccatgatacagcgtgtcttgccacgtckgctgatgagacgagtgaagaaacagttggatcggaccaaatgaaacacacaaagacggggctttaaaaccggggtctttgttatcttttactcatgtgcatactaatgtcagtac

SEQ ID NO: 13210 - protein, 199 aa, Panicum virgatum
  misc_feature: Ceres CLONE 1769005
  misc_feature: SWISSPROT Homolog: EC 2.3.1.167 10-deacetylbaccatin III 10-O-acetyltransferase
  misc_feature (186)..(186): Xaa is any aa, unknown, or other
MGVFTVTKLSEGPVRPSAATPSETLPMAWVDRYPTHRGLVESAHIYRNVAGDISPAPAGLEEAGGGAGADAAAPRLALQAPDKEAMVNGKSPAAVVRGALADALVHYYPFAGRIEEDVPGRPAVRCSGEGVYFVEAAANCTLADVNFLERPLLLAKEQLVPCPTPELWPVEPHNTLAMIQRVLPRXLMRRVKKQLDRTK

SEQ ID NO: 13211 - DNA, 215 bp, Panicum virgatum
  misc_feature: Ceres CLONE 1769005-R
gatgatatgcgcgcttgcatatgtgcatgcgtgaaggaactcgatcggccgccgtaccgtatcacatctaccgatctactacagtagatgctccgtctcaaattattaatcgttctgttttttttaattcatagattttactacgcacctctatatatatatataatattatattatatctcgatgcatagtaaaatctagggtttttttggatt

SEQ ID NO: 13212 - DNA, 2511 bp, Panicum virgatum
  misc_feature: Ceres CLONE 1769007
  misc_feature: Encodes the peptide sequence at SEQ ID NO. 13213
gtgttgagctggttcccagtcctccgtctccttgcttcagctcagcggcatcagcagcttcccccctctacccgttcctccctcctcttcttcataagctcactcgcaaacggaagtggagctgcagagtagtaagtagaagtctagaagtagcaagcattgggatttcgtgtgaaggggatagctgggtgcgccaaaggaaaaaggagacccaggattagcgtgtggcggattgggtggctattttgggagtggggaggacgagaggcgtggccttggccgggggaggcggcggcttcttggaccggccattgatggcgccgtggagcggcttgtggggcggcaaggccggcggcgacgcctaccggggcacgccggtggtggtcaagatggagaaccccaactggtccatctccgagatctcctcgccggaggatgacgacgaggacatcttggccgccgccggccgccgcaaggggggccgctccaagaacgccaagcagatcaggtgggtgctgctgctcaaggcgcaccgcgccgccggctgcctcgcctcgctcgcctccgccgccgtcgcgctgggcggcgccgccaggcgaagggtcgccgcggggaggaccgacgcggaggccggcgtcgtgaccgccacgggcgagagccccgttgtgcgctccagattctacgccttcatcaaggccgtcctcgtcgtctccctgctgctcctcgccgttgaggtcgccgcctacctcaacggctgggaccttgccgactccgcgctcgccctccccgtcatcggcctcgagtcgctgtacgcctcttggttgcgcttccgcgcggcctacgttgcgccggggatacagttcctcaccgacgcctgcgtcgtgctcttcctcatccagagcgccgaccgcttcatccagtgccttggctgcttctacatccacctcaagcgcatcaagcccaagcccaagtcccctgcattgccggatgcggagaaccctgatgctgggtactaccccatggtacttgtgcagataccgatgtgcaacgagaaggaggtgtatcagcaatcaattgcggccgtgtgcagccttgactggccaaaatccaacttcttggttcaggtgttggatgactctgacgacccgctaacacagactctgatcagagaggaggtggccaagtggcaacagcaaggtgcccgaattgtgtaccggcatcgagtgttgagggatggttacaaggctggaaacctcaagtcagccatgagctgcagctacgtgaaggattacgagtttgttgctatctttgatgcagacttccagccaaatccagacttcctgaagcgcaccgtgccacatttcaaggataacgatgaacttgggctagtccaagcaagatggtcctttgtgaatagggatgagaatctgttgactcgattgcaatatattaacctctgcttccactttgaggtggaacagcaggtaaatggggtgttcttaaacttctttgggttcaatggcactgctggggtttggagaattaaggcattggaggactctggtggatggatggaacggacaacagtggaggatatggacatcgctgttagggcacacctacatggctggaagtttatattcctgaatgatgttgagtgccagtgcgaattgcctgagtcttatgaggcttacaggaagcagcagcatcggtggcattctggtccaatgcagctattcaggctctgtttaccggacatcatcaaatgcaagattgcggtttggaagaaagccaacctaatctttctgtttttcctgctacgaaagctcatattacctttctactccttcacgctcttctgcatcatcctcccgatgacaatgtttgtgccggaagctgagcttcctgattgggttgtgtgctacattcccgccctgatgtccttgctcaacatcctcccttctccaaagtcattccctttcatcatcccgtacctgctcttcgagaacaccatgtcggtgacaaagttcaacgcgatgatctccgggctgttccagcttggaagcgcgtatgagtgggtggtgaccaagaaatcaggccgctcatcggagggcgatctcatttccctggcaccgcccaaggagctgaaacaccaaaagacggggtcggcgcctaacctcgacacggttgcaaaggagcagcttgcttcgaaaaaggacgcgaagaagaagcacaaccggatatacaagaaggagctggcgctttcgatgctcctgctaacggcggcggcccggagcttgctctcgaagcagggtatacacttctatttcctcctgttccagggcatctccttcttgttagtaggccttgacctcataggcgagcaggtcgagtaaaccgtgtaaacagcaattgatagatgtgaaaagcagtggggattgctgcagggggtgtgttactgtcatggccgcagcccctggctgagactcgaaacatgcgttgtttgtgtgc

SEQ ID NO: 13213 - protein, 693 aa, Panicum virgatum
  misc_feature: Ceres CLONE 1769007
  misc_feature (238)..(413): Pfam Name: Glycos_transf_2 Pfam Description: Glycosyl transferase family 2
  misc_feature: SWISSPROT Homolog: EC 2.4.1.12 Cellulose synthase (UDP-forming)
  misc_feature: Useful for making plants with altered carbohydrate content
  misc_feature: Useful for making plants with altered cell wall content and/or composition
MAPWSGLWGGKAGGDAYRGTPVVVKMENPNWSISEISSPEDDDEDILAAAGRRKGGRSKNAKQIRWVLLLKAHRAAGCLASLASAAVALGGAARRRVAAGRTDAEAGVVTATGESPVVRSRFYAFIKAVLVVSLLLLAVEVAAYLNGWDLADSALALPVIGLESLYASWLRFRAAYVAPGIQFLTDACVVLFLIQSADRFIQCLGCFYIHLKRIKPKPKSPALPDAENPDAGYYPMVLVQIPMCNEKEVYQQSIAAVCSLDWPKSNFLVQVLDDSDDPLTQTLIREEVAKWQQQGARIVYRHRVLRDGYKAGNLKSAMSCSYVKDYEFVAIFDADFQPNPDFLKRTVPHFKDNDELGLVQARWSFVNRDENLLTRLQYINLCFHFEVEQQVNGVFLNFFGFNGTAGVWRIKALEDSGGWMERTTVEDMDIAVRAHLHGWKFIFLNDVECQCELPESYEAYRKQQHRWHSGPMQLFRLCLPDIIKCKIAVWKKANLIFLFFLLRKLILPFYSFTLFCIILPMTMFVPEAELPDWVVCYIPALMSLLNILPSPKSFPFIIPYLLFENTMSVTKFNAMISGLFQLGSAYEWVVTKKSGRSSEGDLISLAPPKELKHQKTGSAPNLDTVAKEQLASKKDAKKKHNRIYKKELALSMLLLTAAARSLLSKQGIHFYFLLFQGISFLLVGLDLIGEQVE

SEQ ID NO: 13214 - DNA, 1765 bp, Panicum virgatum
  misc_feature: Ceres CLONE 1769012
  misc_feature: Encodes the peptide sequence at SEQ ID NO. 13215
atctcttcgccacactctcttgcatcttcttcccggcacacggttcatgctcctccgccgccgcctcctctccaccgcggcggccgccgcccgcggcccgccgccgatccgcgtggacctggcggagtccgccggccgcggcgtcttcgccacccgcccggtccccgccggcgagctactccactccgcgcagcccctcgtctgccacccctctccatcgctgctccacgaggtgtgctacagctgcctcaggaggaagcccggggaggggcgtgtctcgagcgggggctactacttctgcagcgacgcttgcagggagcaggccaaggggttccatgatgttgataagaacgcggattggtcttcattcgatgatcactgcagttcacgtggtctgaaatatccatacatggccaagcggcttgcttgcatggtaatatcaggagctgctaatgcggattgtcttaacattcttcagccagcccgcttgcaccaggggacgctcatcgagatggaggaggagttcgagttgttggagtccacttttaggaaagctgggtttcaggaagaagtcacaagctgtatccttgaatcttattttacttccttctgtagtgtcatgaatgtttacaaccaagtgttcataatttttggttttctccatatggttcttctctcaatccgtttcaaatttggttttcctgtaatcaacaacaacaacaacatagccttttgtcccaagcgagttggggtaggctagagatgaaacccaaaagacacaaaggtcatggttcaggcacattgatagctagtctccaagcgctcctatccaaagctaactcctcagagatatcccaatctttaaggtctctcttaaccgactcctcccaaatcagtttaggtctacctctacccctctttaccttatcaacacgctttagcaccccacttggttttcctgtaatctttgacaaaattagttttgaccagagagtggtacataaatgtattggcaaggatacgcataaatgcatttcgcattgaactggttgcaagctcatatgaggatcttctatcctcagcagcagcctctgtatcatgtgatgcatctgttggcaatgcagtttatatgcttccctcgttctataaccatgactgtggtatgctcttctcctactcattttggaataagtgcaatatctatcatattcttattatgattttgttttgctaacagcgattcagtcgataggctgccaaaccaaattttaggatttgtcgctgcccttttttggtagtatagtgcttgttgactgtactgtttaacatctctttactatatcagtggtctatagcatccaatagcagatgtctttgctaaactattatcagtgaaaagccactttttacatttttttatgtatacggctatatgggtaatattatggtgaaaatataagtaaaatgtttcatccaatggcagcaattttgaagctgctgaatataacctgtttttcctttcaagaccgaaggtattggccctgctttttaaagaaagcaaaagcataggttgctgtggttaccagttttacagaccaagaaaaaactggttcttataagaagcaaccagaaatcttaccatctttatcaaactaattaactttcctgcgtagatcgaccttaactccaaaagagcgactacagtctacacatcctcggttttggcaacatagtctataatcacaaccactcagttctaggtatc

SEQ ID NO: 13215 - protein, 237 aa, Panicum virgatum
  misc_feature: Ceres CLONE 1769012
  misc_feature: SWISSPROT Homolog: EC 2.1.1.43 Histone-lysine N-methyltransferase
MLLRRRLLSTAAAAARGPPPIRVDLAESAGRGVFATRPVPAGELLHSAQPLVCHPSPSLLHEVCYSCLRRKPGEGRVSSGGYYFCSDACREQAKGFHDVDKNADWSSFDDHCSSRGLKYPYMAKRLACMVISGAANADCLNILQPARLHQGTLIEMEEEFELLESTFRKAGFQEEVTSCILESYFTSFCSVMNVYNQVFIIFGFLHMVLLSIRFKFGFPVINNNNNIAFCPKRVGVG

SEQ ID NO: 13216 - DNA, 1832 bp, Panicum virgatum
  misc_feature: Ceres CLONE 1769016
  misc_feature: Encodes the peptide sequence at SEQ ID NO. 13217
acttcacaccacaagtcacgcagccctctccctcctcccttggttcccgtccctgctctcctttcttttttctcgccttccttgctgttcaggaactcgcctgctctgctcgatcgccctgcgcttggttctcggcgcgcatgagagctcagaagcgtgtccttttcgcttccgtttgatcctatcttcgccaatccagtccaagctcgttgcttgcttggtcccaaagggaggagaaattaaagatcgaggagaaacggcgccggcgtaagattccgggtcgagggcggccatggccatggttggtgctctgttcctgtccacgagcgccgccgtgccatccgcttgactgaccaatcatcgtcgtctccgtccgcgcttggtaccccagctgaactcgcgcctccctcgaccattcgccgtcggaacaagatagaggagagagagagctggtggcagaagctcttcgcggctgcggggaactggtcccggagaaatgcggcagatctcgtcgctgctgcagggcctggcccggtcgctgtcggtggggagggacaggagaggggacggcgccggcgccggcgacgggaaggccgccgcgccggcggtgctgaggacgtcggggacggtgtggggcgagggctcggagacgttcgccgccgtgtgctcgcgccgcggcgagaagggcaccaaccaggactgctccatcgtctgggagggattcgggtgccaggaggacaccatcttctgcggcatcttcgacgggcacggcccgtggggccactacgtggccaaggccgtgcgcgacgcgctgccgccgtcgctgctgtgccactggcaggaggccctcacgctggcgtcgctcatcgacggcgagaagaagctcggcgactgccggttcgacctctggaagcagtcctacgtggccgcctgcgctgccgtcgacgacgagctccgccgcagccgccgcctcgacgccgtctacagcggctccaccgcgctgtccgtcgtcaagcagggcgacctcctggtcgtcgccaacgtcggcgactcccgggccgtcctgggcaccttcacgtccgacggcggcgccctcgccgccgtccagctcaccgtcgacttcaagcccaacctgcctcaggagaaggagcgcatccggcggtgcaacggccaggtgtactgcctcgccgatgagcccggcgtgtaccgcgtgtggcagcccagccgggactcgccggggctcgccatgtcgcgcgccttcggcgactactccgttaaggactacggcgtcatctcggcgccggaggtgacgcagaggaagatcggcagccgggaccagttcgtcatcctcgccaccgacggggtctgagacgtgctgtcgaacgaggaggcggtgcagatcgtggcggcgacgccggacagggggaaggcggccaagcggctggtggagtgcgccgtccgcgcgtggaggcgccgccgccggggcatcgccgtcgacgactgctcggcgatctgcctcttcttccactcgccgccgtcgtagggggggcgggcgccgcacggcacgtagaccggcctccatcgacgtcaaggagacaccgagatgcacatctcgagaccacgatcgtcgtgcccgtcgcgttcgtggttgggagcgcacttgtcgccgtccacgattcagaacgtgcagctttgtcgcatgatcgcgacactgcagcagctggtggatgaccaaacaaaaaaaatcccggctttcacaccgggcttgtaaaaatgtacgagaacgaacaccagccaccagaaaaggggagagaaagatgcattttgtcctc

SEQ ID NO: 13217 - protein, 290 aa, Panicum virgatum
  misc_feature: Ceres CLONE 1769016
  misc_feature (52)..(290): Pfam Name: PP2C Pfam Description: Protein phosphatase 2C
  misc_feature: SWISSPROT Homolog: EC 3.1.3.16 Phosphoprotein phosphatase
MRQISSLLQGLARSLSVGRDRRGDGAGAGDGKAAAPAVLRTSGTVWGEGSETFAAVCSRRGEKGTNQDCSIVWEGFGCQEDTIFCGIFDGHGPWGHYVAKAVRDALPPSLLCHWQEALTLASLIDGEKKLGDCRFDLWKQSYVAACAAVDDELRRSRRLDAVYSGSTALSVVKQGDLLVVANVGDSRAVLGTFTSDGGALAAVQLTVDFKPNLPQEKERIRRCNGQVYCLADEPGVYRVWQPSRDSPGLAMSRAFGDYSVKDYGVISAPEVTQRKIGSRDQFVILATDGV

SEQ ID NO: 13218 - DNA, 833 bp, Panicum virgatum
  misc_feature: Ceres CLONE 1769018
  misc_feature: Encodes the peptide sequence at SEQ ID NO. 13219
ggtcacggctacagtgggtggcgcaggggccaataacgcagctcccgccgctcctcatcctcgcccagatgagcctcaccggctccagccctccgccggatcccgtagcctgcgcccacggcacctccaactgcaccatcaacaacgcatatcgcctccttcccggaccgcagaccctgccacgccgcccgggccgcctacccacgcagcgagcatgagctcgtcgcggccgtggcggccgcggtggctgccaagcgtaaggtgaaggtcgccaccaggtactcccacagcttcaccaagctggcctgccccggcggcagcgacggcgccatcatcagcacgcggtggctcaaccggaccgtgcgggtcgacgccaagaatcggctcatcacggtggagagcggcgtgctcctcagggagctcatccgtgccgccgcctcggctgggctctcgctgccatacacgccgtactggttcggcctcaccgtcggcggcctcctggcgaccggcgcgcacggcagctcgatgtggggcaaggggggcgccgtgcacgagtccgtggtggcgctgaggatcgtgacgccggcgccggcgagccggggcttcgccatggtgagggagctcggcaccggccacccggacctcgacgcggccaaagtatctctcggagtcctcggcgtcgtctctcaggttactctggctctgcagccgctgttcaagcggtcgatctcgttcctgaaacgcgacgactcggacctggcggagcaagtggcctcgtgcggccgcctccacgaattcggggacatcacgtggctgccggaggagcgcaaggt

SEQ ID NO: 13219 - protein, 102 aa, Panicum virgatum
  misc_feature: Ceres CLONE 1769018
  misc_feature: Useful for making plants with modulated nitrogen use efficiency
MWGKGGAVHESVVALRIVTPAPASRGFAMVRELGTGHPDLDAAKVSLGVLGVVSQVTLALQPLFKRSISFLKRDDSDLAEQVASCGRLHEFGDITWLPEERK

SEQ ID NO: 13220 - DNA, 983 bp, Panicum virgatum
  misc_feature: Ceres CLONE 1769029
  misc_feature: Encodes the peptide sequence at SEQ ID NO. 13221
gagcaacagcagaggagaggagagagagagaggccggcaagcgcatcttcccccgttggcccttgccgtccttcctctgctcctcccctgctctccgcctgcgccggtcggctctgctctgccgctgctgcggccgcaggcgcaggagcaaccaccccgccgatcgaccggccatgcgcgcctagccgaaccgagcctagccaccaccgtgcgcccacccayccacccccttcctccctccctcccggttggcgttggctccccctcccccgatccgcctccgctgcctgcctgactgcctgaccgcccgcctctctatacatacccccgccacccccgcctcggcgcctccgaccccgccccagaacctwccagaacccccgccccgccccgccccgcccctcccctcctctcccgagctcctcccggctccgatggccgtcgccgaggccgccgccgccgaccacgccgcgccgcgcccggaggaggcgcccggagccggctccggctccgacgccggggagcgcgagatgcgggatctggaggagctcctctccaagctcaaccccatggccgaggagttcgtcccgccctccctcgcctcccccgccgccgccctcgcgcccgcacccgcgcccgcgccgctctccccggtcgcctacggctactacccctccaacgccggcttcgcggtcgcctcgccggcccaccgcggcgtcctcggcttcccggccgtcgccgacgggcccgccgcccgcggcaggaagaaggggggagccggagggttcggcggccatggccaccccggcaggcgccggaccaacagccgcaccagcgtggcgcagcggggcgaggtcatccgccgcaccgtctacctctccgacatcgatcaccaggtcactgaagaaaacctggccgcactatttataaactgtggacaggttgtggattgtcgcatgtgtggggatccaaattcagttctt

SEQ ID NO: 13221 - protein, 182 aa, Panicum virgatum
  misc_feature: Ceres CLONE 1769029
  misc_feature (38)..(55): Pfam Name: PAM2 Pfam Description: Ataxin-2 C-terminal region
MAVAEAAAADHAAPRPEEAPGAGSGSDAGEREMRDLEELLSKLNPMAEEFVPPSLASPAAALAPAPAPAPLSPVAYGYYPSNAGFAVASPAHRGVLGFPAVADGPAARGRKKGGAGGFGGHGHPGRRRTNSRTSVAQRGEVIRRTVYLSDIDHQVTEENLAALFINCGQVVDCRMCGDPNSV

SEQ ID NO: 13222 - DNA, 612 bp, Panicum virgatum
  misc_feature: Ceres CLONE 1769029-R
ctttgagtctatatgtggagaggtctttcggcggaggttgcttggtgattaccatcattctactcgcatcgcctttgtggagtttgtaatgactgaaagtgccactgctgctctcaactgcagtggtgtgattctaggttccttgccaataagggtgagcccatcgaagactcctgtgcgtccccgcgtgcctcgccagctgatgcactagaagttgtaggtacaggaggtgctgaaggcacagttatatataatagagatagacatatatgaaaggggggaagtcgcaatatgtgtcttttctttttaagttatgggctcgacctttttttttttcttcactattaccaccttgagtgagtaaagtatctacgctcggagccagagagaggggaatttccgggttgaggttgggtcgttttaccttgcacatagcggagagcttcttagaaggaagcggggttggtctcttgtccttgatgcaacaaggcaaaactcctggacttttacctgtgttcagttgtttgctgtgtcttggttgctactctcagaaacttgggaattacttggagattatgaacgcttaccgttatgccctactttatgcttccg

SEQ ID NO: 13223 - DNA, 2117 bp, Panicum virgatum
  misc_feature: Ceres CLONE 1769030
  misc_feature: Encodes the peptide sequence at SEQ ID NO. 13224
ggcaccaagggagcagcacccgcgcatgtttacctgcttcgccgggcgcgcctcctccaccgcatcgagcatcgtcgccagcagcctcgaggcccccaccccgaccgccaacccctttgccaactccctcctcacgacccccaagccctccgcctccgccgacctccccgagggcgcgcagtggcgctacagcgagttcctctccgccgtcaagcgtggtaaggtcgagcgcgtccgcttctccaaggacggcgagctgctccagctcaccgccgtcgacggccgccgcgccaccgtcgtcgtccccaacgaccccgacctcatcgacatcctcgccactaacggcgtcgacatctccgtctccgagggcgaggccgccgggcccggggggttcctcgccttcgtcggcaacctcctattccccttcatcgccttcgcggggctcttcttcctcttccgccgcgcgcagggcgggccgggcgcgggccccggcgggctcggcgggcccatggactttggacgctccaagagcaagttccaggaggtgcctgagaccggagtaaccttcctcgacgtcgccggtgccgatcaggccaagctcgagctgcaggaggttgttgatttcctcaagaacccggacaagtacaccgctctgggtgccaagatccccaagggatgtctcctcgtcggcccgcccgggacaggtaaaaccctgctcgcgcgtgccgtcgctggtgaggccggggtacccttcttctcctgcgctgcctccgagttcgtcgagctcttcgtcggtgtcggtgcctccagggtccgcgacctcttcgagaaggccaaggccaaggcaccctgcattgtcttcatcgatgagattgatgccgtcgggaggcagcgtggtgctgggctcggtggcggtaacgacgaaagagagcagactattaaccagctcttgacagagatggatggtttcaccggcaacagcggtgtcattgtgctcgccgcgaccaacaggcctgatgtcctggactctgctcttttgcgtccaggaaggtttgatcgtcaggtcaccgttgacaggccagatgtcgccggacgcgtcaagattcttgaggtccactccagaggaaaagcattggcgaaggatgtagactttgagaagattgctagaagaacccctggtttcactggcgctgatcttcaaaacttgatgaatgaggctgccattcttgccgctcgccgtgatcttaaagaaatcagcaaggatgagatctctgatgctcttgaaaggatcattgctggccctgagaagaaaaatgcagttgtttctgaagagaagaagagacttgtggcttaccatgaggctggtcatgcccttgtcggtgcccttatgccggagtatgatcctgttgctaagatttccatcattcctcgtggtcaagctggtggactcacattctttgctccaagtgaagagaggctagagtcgggattgtacagcaggaactatcttgagaaccaaatggctgtagcccttggtggcagggttgctgaagaggtgatctttggccaagaaaacgtgacaacaggagcttccaacgacttcatgcaggtgtcacgtgtcgcaaggcaaatggttgaaagatttggattcagtaagaagattggacaagttgcgatagggggacctggtggaaaccctttcttgggacagcagatgtccagccagaaggactactccatggctacagcggatgttgtggatgctgaggtgagggagctcgtggagagggcctactcgagagcaacacagatcatcacgacgcacatcgacatcctccacaagcttgcgcagcttctgatcgagaaggagacggtggatggggaggagttcatgagcctgttcatcgatggccaggccgagctgtttgtcgcttgagccggatgctggtcttgtcgtgctgtattgatctgtgtgcttttgtacggaaacggagagcccagctgtaggaaccacatcgatgtagccaaagatgtttttgcatacttacttgtagtctgctcgttgtaaaaagcatctactgacatttgagcaagtaaaatgcttaccgttatagcac

SEQ ID NO: 13224 - protein, 636 aa, Panicum virgatum
  misc_feature: Ceres CLONE 1769030
  misc_feature (411)..(625): Pfam Name: Peptidase_M41 Pfam Description: Peptidase family M41
  misc_feature (217)..(404): Pfam Name: AAA Pfam Description: ATPase family associated with various cellular activities (AAA)
  misc_feature (51)..(191): Pfam Name: FtsH_ext Pfam Description: FtsH Extracellular
  misc_feature: SWISSPROT Homolog: EC 3.6.4.3 Microtubule-severing ATPase
  misc_feature: Useful for making plants with modulated heat sensitivity
MFTCFAGRASSTASSIVASSLEAPTPTANPFANSLLTTPKPSASADLPEGAQWRYSEFLSAVKRGKVERVRFSKDGELLQLTAVDGRRATVVVPNDPDLIDILATNGVDISVSEGEAAGPGGFLAFVGNLLFPFIAFAGLFFLFRRAQGGPGAGPGGLGGPMDFGRSKSKFQEVPETGVTFLDVAGADQAKLELQEVVDFLKNPDKYTALGAKIPKGCLLVGPPGTGKTLLARAVAGEAGVPFFSCAASEFVELFVGVGASRVRDLFEKAKAKAPCIVFIDEIDAVGRQRGAGLGGGNDEREQTINQLLTEMDGFTGNSGVIVLAATNRPDVLDSALLRPGRFDRQVTVDRPDVAGRVKILEVHSRGKALAKDVDFEKIARRTPGFTGADLQNLMNEAAILAARRDLKEISKDEISDALERIIAGPEKKNAVVSEEKKRLVAYHEAGHALVGALMPEYDPVAKISIIPRGQAGGLTFFAPSEERLESGLYSRNYLENQMAVALGGRVAEEVIFGQENVTTGASNDFMQVSRVARQMVERFGFSKKIGQVAIGGPGGNPFLGQQMSSQKDYSMATADVVDAEVRELVERAYSRATQIITTHIDILHKLAQLLIEKETVDGEEFMSLFIDGQAELFVA

SEQ ID NO: 13225 - DNA, 853 bp, Panicum virgatum
  misc_feature: Ceres CLONE 1769032
  misc_feature: Encodes the peptide sequence at SEQ ID NO. 13226
attttggcgtgccttcacctaacacatggcaggcaaggcattgcggacgcggcaggtggtcgccgctgcttcgctgctgtggcttctccttctcccatggccatgggcttcggccgtccaccggagcgacttcccggcgtccttcctcttcggcaccgccacttcctcgtaccagattgaaggcgcataccttgaggacaacaaaagtttaagcaactgggatgtgttcactcatgtgccaggaagaatcaaagacggaagcaccggggatatcgcggatgatcactaccaccgttacgaggaagacattgagcttatgcactctctgggcacggacgcatacagattctcgatatcatgggccagaattcttccaaagggaaggttcggcggagttaaccaattaggcatcgagttctacaacaaactcatcgattcactcctgttcaaagggatagagccattcgtcacgctgagccactacgacatcccccaagaactcgaagacaggtacggggcctggctcagcgccgaggtacagagagatttcggctacttcgccgacgtctgcttcgcggcgttcggcgaccgcgtcaggtactgggccaccttcaacgagcccaacgtcgccgtgctggcgggctacatgctcggcacctacccgccggcccggtgctcgccgccgttcggctcctgcgccggcggcgactccgaggccgagccctacgccgccacccacaacgtcatcctgtcccacgccaccgccgtcgagatatacaggcggaagtaccaggcacccaacaaacttaactgatcgtcgttgctgtctgtgaggcgcgtcgtgctcgtggtc

SEQ ID NO: 13226 - protein, 262 aa, Panicum virgatum
  misc_feature: Ceres CLONE 1769032
  misc_feature (32)..(262): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered carbohydrate content
  misc_feature: Useful for making plants with altered cell wall content and/or composition
MAGKALRTRQVVAAASLLWLLLLPWPWASAVHRSDFPASFLFGTATSSYQIEGAYLEDNKSLSNWDVFTHVPGRIKDGSTGDIADDHYHRYEEDIELMHSLGTDAYRFSISWARILPKGRFGGVNQLGIEFYNKLIDSLLFKGIEPFVTLSHYDIPQELEDRYGAWLSAEVQRDFGYFADVCFAAFGDRVRYWATFNEPNVAVLAGYMLGTYPPARCSPPFGSCAGGDSEAEPYAATHNVILSHATAVEIYRRKYQAPNKLN

SEQ ID NO: 13227 - DNA, 661 bp, Panicum virgatum
  misc_feature: Ceres CLONE 1769032-R
  misc_feature: Encodes the peptide sequence at SEQ ID NO. 13228
cccctgtacgccatggactgcatgttttcgtcaggctgcccactggggcagtggacccagaatgcgctagcggccggcaccggagaaagggacggagtccccatcggaccaccaacagggaggtcgatgttctacgtcgtgcctgacggcatagagaagatggtcacctacatcatgaagagatacaacaatctgccaatgttcatcaccgaaaatggctacccacaggttgaagaaggtcataccaatgcccaagaatggcttcacgaccaggctaggatacagtaccttgatggctacctcaccaaagttgccaaagttataagggacggagctgatgttcgtggctacttcgtctggtctctcctcgacaattttgaatggctatatggatacaccctccggtatgggctgtactacgttgactaccaaacactggaaagaaagcccaagtcatccgcgctgtggtacaaaaggttcctccaaagtttacatgaagatcaatagagagggagccttatttaaatcttgagaaaagtgtgtgacggctgagcatgctggctcttcaatttatgaaaatgaagagcatggttttgtataaattgattaatcctgaataaacggccaccaagtcgccaaataattaatatgacctcctgag

SEQ ID NO: 13228 - protein, 168 aa, Panicum virgatum
  misc_feature: Ceres CLONE 1769032-R
  misc_feature (3)..(166): Pfam Name: Glyco_hydro_1 Pfam Description: Glycosyl hydrolase family 1
  misc_feature: SWISSPROT Homolog: EC 3.2.1.85 6-phospho-beta-galactosidase
  misc_feature: Useful for making plants with altered carbohydrate content
  misc_feature: Useful for making plants with altered cell wall content and/or composition
PLYAMDCMFSSGCPLGQWTQNALAAGTGERDGVPIGPPTGRSMFYVVPDGIEKMVTYIMKRYNNLPMFITENGYPQVEEGHTNAQEWLHDQARIQYLDGYLTKVAKVIRDGADVRGYFVWSLLDNFEWLYGYTLRYGLYYVDYQTLERKPKSSALWYKRFLQSLHEDQ

SEQ ID NO: 13229 - DNA, 2493 bp, Panicum virgatum
  misc_feature: Ceres CLONE 1769034
  misc_feature: Encodes the peptide sequence at SEQ ID NO. 13230
acatatttcaagtccgaagcaccaacatcatcttctctgaaagcaaagcaaagcagacagtctgcacaagaacatccaaatcgctgcagctctcgccactctgcttcgactccagctcgtgctattttccacacaagttcctgcagagtgcagaagaatccaccagagtgaagatgcttcagaggcatggattcttcaagttcagattctccttgtagctgcaaatgaatgagcaaaaatctcatcggctcactcagctgcgaccagagaaataaaaatccctctgatatctctgctagcgaggcaggtctggtttctttctacacatagtcctctcaccacatctttctcatcaatctagtagcttgccttcttccaggccaggtgacaacaagggaagcctgccgaggccgattttttggttacatattctctgcaccagtaattttccatccatcgtttattcttccaattctagcttcctctctgcatctctggttgccttcttgtcagagatcgcaatcatatgctggcgctgcgcagttgcatgcgcgaaaaactgaggtgacggatcgaaagacaaaatagagttgcaattaattcgcaaagcacttcactttggaagcttggagggaggcatcctgttccatcactcaaccaatctttcttggttatcatctgcctgccacgacccttattgtggtgtcgctagtcgctaccacatataattctctccttgtcagcgtcagatgagtgcacggccctgctgcctcggcgccgcgcaccacgcgcacgcgggggtctcttcttcttcttcctcctcctcctcctggccgtccatggcgccggggatcgtcgtcgacttctccagcctcagctggctcctcttccgcgtcttcttcacctacgacatccacaacttcgccaagcccaccatctagcacacagcagcaagtcatcatcttctacttaataattagcttgttcggcacagcagcaacttgtcccttgtgtttcctgcaaccgagcgatcgagctcgagcatgtccgggccacggcggtgcggcagccggcggcaggcggtagtgggcgacaacaccaacggatacgtggagaccgatcccactggtcgctatggccggttcgaggagcttctcggcaagggcgccatgaagtcggtgtaccgtgggttcgacgaggagcgcggcgtggaggtggcgtggaaccaggcgagcctgagcgacgtgctccggacccccgacgccgtgcagcgcatgtactcggaggtgcagctgctgagcacgctccgccacgacgccatcatcggcttccacgcgtcctgggtggacctgccccgccgcaccttcaacttcatcaccgagctcttctcctccggcacgctccgctcctaccgcctccggtacccgcgcgtgagcctccgcgccgtccggtcgtgggcgcgccagatcctgcgcggcctcgcctacctccacggccacgacccgccggtcatccaccgcgacctcaagtgcgacaacctcctggtgaacgggcaccagggccaggtgaagatcggcgacctgggcctcgccgccgtgctccgggaggccggccaggcggcgcgcagcgtgatcgggacgcccgagttcatggcgcccgagatgtacgacgaggagtacaacgagctggtggacgtctactcgttcggcatgtgcatgctagagatgctcaccctcgagtacccctacagcgagtgctccaaccccgcgcagatctacaagaaggtcaccgccggcaagctgcccgacgccttctaccgagtggacgacgacgaggcccgacgcttcatcggcaggtgcctggtcgccgcctccaagaggccgtccgcggcggatctgctgctcgaccctttcctcctcgacgaccatcagccaacattgtcgccgcctgctgcttctgctgctcctccttcttcgacctgcggcagttccgatgatgatgtttcgtcgtcaatcataggcgatgatgcagatgcagaagcagaaccaccaaggactgacatgaccatcaccggcaagctgaacgccgaggaggacaccatcttcctcaaagtacagatcgccgaggagacagcagggagtaacaatgttcggaacatctacttcccgtttgacctggtgagcgacacggcgacggaggtggcggaggagatggtgaaggagctggagatcagggaccgggacccatcggagatcgcggccatgatcgagcacgagatccagaggctgcttccggggcgaaagcagcagcacgagtacactctgtacgcagcggcacaggatgatgacgacgaaaacgtggagcaccctcctcctttctactacctctcctcttcccccacctcctcccaaggctctgtctgcggagcgggacccggatgcttctctggcccacaaggcagcgcctggtctaaaggtaacaacgttatctgtt

SEQ ID NO: 13230 - protein, 483 aa, Panicum virgatum
  misc_feature: Ceres CLONE 1769034
  misc_feature (32)..(291): Pfam Name: Pkinase Pfam Description: Protein kinase domain
  misc_feature: SWISSPROT Homolog: EC 2.7.11.1 Non-specific serine/threonine protein kinase
MSGPRRCGSRRQAVVGDNTNGYVETDPTGRYGRFEELLGKGAMKSVYRGFDEERGVEVAWNQASLSDVLRTPDAVQRMYSEVQLLSTLRHDAIIGFHASWVDLPRRTFNFITELFSSGTLRSYRLRYPRVSLRAVRSWARQILRGLAYLHGHDPPVIHRDLKCDNLLVNGHQGQVKIGDLGLAAVLREAGQAARSVIGTPEFMAPEMYDEEYNELVDVYSFGMCMLEMLTLEYPYSECSNPAQIYKKVTAGKLPDAFYRVDDDEARRFIGRCLVAASKRPSAADLLLDPFLLDDHQPTLSPPAASAAPPSSTCGSSDDDVSSSIIGDDADAEAEPPRTDMTITGKLNAEEDTIFLKVQIAEETAGSNNVRNIYFPFDLVSDTATEVAEEMVKELEIRDRDPSEIAAMIEHEIQRLLPGRKQQHEYTLYAAAQDDDDENVEHPPPFYYLSSSPTSSQGSVCGAGPGCFSGPQGSAWSKGNNVIC

SEQ ID NO: 13231 - DNA, 1517 bp, Panicum virgatum
  misc_feature: Ceres CLONE 1769035
  misc_feature: Encodes the peptide sequence at SEQ ID NO. 13232
catagtacagcgccgcgcgcgcccacgcgcatcgagcgaggcgggctaggccatggcgcccgccgcgttcgacgccgaggtcggagccaccaacggccacggcgccagctacggcaccaagccggcgcccgcggccgggtccggggccggcgccggcgccgccttcgtgctcgagtccaaggggacgtggtggcacgcggggttccacctgacgacggcgatcgtggggccgacggtgctgacgctcccgtacgcgctgcgcgggatggggtggggcctcggcctcaccctgctctccgtcatggccgccgtcaccttctacgagtactccctcatgtcccgcgtcctcgaccactgcgaggcgcgcggccgccgccacatccgcttccgcgagctcgccgctgacgtcctcgggtccgggtggatgttctacttcgttgtcaccgtgcagaccgccatcaacaccggcgtcagcatcggtgccatcctgctcgccgccgactgcctcgagattatgtacacgagccttgctccccacggccccctaaaactgtaccacttcatcatcatcgtggctgtggtgctggccttcctctcccagcttccgtcgttccactcgctgcgccacatcaacttcgtctcgctgctcctgagcttgggctacaccatccttgtggctgctgcttgcattcgtgcaggcttgtccaaaaacgctcctacgaaggactactcgctaagctcctccaagtccgagaagaccttcgatgcttttctatccgtttccatccttgcctccgtcttcggcaatggcatactgcctgaaatccaggcgacgctggcgccaccggctgcggggaagatgatgaagacgctggtgctgtgctactccgtcgtcgtcttcaccttcttcctgtcgtcgatcacggggtactgggccttcggcagccgcgtccagtccaacgtgctcaagagcctgatgccggactcgggcccggccctggccccgacgtggctgctgggcgtggcggtgctcttcgtcctcctccagctcctcgccatcggcctcgtctactcccaggtggcgtacgagatcatggagaagggctccgccgacgcatcccggggccgcttctcccgccggaacctcgtcccgcggctgctgctccggacgctgtacctggccgtgtgcgcgttcgtggccgccatgctgcccttcttcggcgacatcgtgggcgtggtcggcgccgtcgggttcgtcccgctcgacttcgtgctccccgtgctcatgtacaacatggcgctcgcgccgccgaggcggtccccggtcttcctcgccaacacggccgtcatggtcctgttcgccggcgtcggagccatcggcgccttcgcctccatccgcaagctcgcgctggacgccggcaagttcaagctcttcagcaacaacgttgtcgactgatgaacagtactttaatttgaacgtaacgtgcactgtctcgaatggaagatgtcgttatagc

SEQ ID NO: 13232 - protein, 467 aa, Panicum virgatum
  misc_feature: Ceres CLONE 1769035
  misc_feature (42)..(446): Pfam Name: Aa_trans Pfam Description: Transmembrane amino acid transporter protein
MAPAAFDAEVGATNGHGASYGTKPAPAAGSGAGAGAAFVLESKGTWWHAGFHLTTAIVGPTVLTLPYALRGMGWGLGLTLLSVMAAVTFYEYSLMSRVLDHCEARGRRHIRFRELAADVLGSGWMFYFVVTVQTAINTGVSIGAILLAADCLEIMYTSLAPHGPLKLYHFIIIVAVVLAFLSQLPSFHSLRHINFVSLLLSLGYTILVAAACIRAGLSKNAPTKDYSLSSSKSEKTFDAFLSVSILASVFGNGILPEIQATLAPPAAGKMMKTLVLCYSVVVFTFFLSSITGYWAFGSRVQSNVLKSLMPDSGPALAPTWLLGVAVLFVLLQLLAIGLVYSQVAYEIMEKGSADASRGRFSRRNLVPRLLLRTLYLAVCAFVAAMLPFFGDIVGVVGAVGFVPLDFVLPVLMYNMALAPPRRSPVFLANTAVMVLFAGVGAIGAFASIRKLALDAGKFKLFSNNVVD

SEQ ID NO: 13233 - DNA, 1720 bp, Panicum virgatum
  misc_feature: Ceres CLONE 1769040
  misc_feature: Encodes the peptide sequence at SEQ ID NO. 13234
acatcctccgctcgtctgacatctcctcccgtcctttcctttcgaagcctcggggatcccggcgatggcctccgccgccaccctggtgtcggtcgacgacaagctcgaccagcttcgcgccgaggtcgccaagctcgaccagatcagcgagaacgagaagtccgggttcatcagcctcgtgtcgcgctacctcagtggggaggcggagcagatcgagtggagcaagatccagaccccgaccgatgaggtggtggtgccgtacgacaccctcgcgtcgcctcccgaagatctctttttttcgaagatgctgctggacaagctcgttgtgctcaagcttaatggagggctcgggacgaccatgggctgcactggccccaagtctgtcattgaggtccgcaacgggttcacattccttgaccttattgtgattcaaattgagtctttgaacaagaagtatggatgcagtgtccctttacttctgatgaactctttcaacactcatgatgacacacagaagattgttgagaagtatgccaactccaacattgagattcacactttcaatcagagccagtatcctcgcattgatactgaagacttctcgctacttccaatcaagaaatctgggaaggatggctggtatcctccaggccatggtgatgtgttcccctctttgaacaacagtgggaaacttgacctcttattggctcagggcaaggagtatgtctttgttgcaaactcagacaacttgggtgctatagttgacatcaaaatcctaaaccatctaatcaacaaccagaatgagtactgcatggaggttactccaaagactctggctgatgttaagggtggtaccctcatctcttacgaaggaagggttcagcttttggagattgcccaagtacctgatgagcatgtgaatgaattcaaatcaattgagaagtttaagatattcaacactaacaacttgtgggtgaacctaaaagctatcaagagacttgtagaagctgatgcacttaagatggaaattattccaaaccccaaggaagttgatggtgtgaaagttcttcaactcgaaactgcagctggcgcagctattaggttcttcgacaaagcgattggaattaatgttccccgctcaaggtttctcccagtgaaggctacatctgatttgttgcttgtgcagtctgatctttacaccttggttgatggctttgtcacccgcaacccagccagagcaaatccagctaacccttcaattgagcttggtcctgagttcaagaaggttgccaacttccttgcccggttcaagtccatccccagcattgtcgaccttgacagcttgaaggtttctggtgacgtctggttcggctctggaattacactcaagggcaaggtgaccatcaccgccaagcccggagtgaagttggagattccagatggagctgtgcttgagaacaaggacgtcaagggcccccaggatctctgagcgatgcgtaccgtcgtcaccagtttttccgaggaccttttgcaggagccgccgccctagtcaatccgctgagctttgtcttttgtaagtgtcatgtgcattaccgctgtgagggtcttgtgagcccgctacagaataattgtaatcctctttggtgcttctgtacttgtgtttttggcgcaccagggacgaatattttgctgaaatgatacatccatagcttatcatgcc

SEQ ID NO: 13234 - protein, 474 aa, Panicum virgatum
  misc_feature: Ceres CLONE 1769040
  misc_feature (31)..(442): Pfam Name: UDPGP Pfam Description: UTP--glucose-1-phosphate uridylyltransferase
  misc_feature: SWISSPROT Homolog: EC 2.7.7.9 UTP--glucose-1-phosphate uridylyltransferase
MASAATLVSVDDKLDQLRAEVAKLDQISENEKSGFISLVSRYLSGEAEQIEWSKIQTPTDEVVVPYDTLASPPEDLFFSKMLLDKLVVLKLNGGLGTTMGCTGPKSVIEVRNGFTFLDLIVIQIESLNKKYGCSVPLLLMNSFNTHDDTQKIVEKYANSNIEIHTFNQSQYPRIDTEDFSLLPIKKSGKDGWYPPGHGDVFPSLNNSGKLDLLLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEADALKMEIIPNPKEVDGVKVLQLETAAGAAIRFFDKAIGINVPRSRFLPVKATSDLLLVQSDLYTLVDGFVTRNPARANPANPSIELGPEFKKVANFLARFKSIPSIVDLDSLKVSGDVWFGSGITLKGKVTITAKPGVKLEIPDGAVLENKDVKGPQDL

SEQ ID NO: 13235 - DNA, 845 bp, Panicum virgatum
  misc_feature: Ceres CLONE 1769049
  misc_feature: Encodes the peptide sequence at SEQ ID NO. 13236
agtcttaaaccctctcccccccggtcgctcccacttccacgggctccgaaactcccgcgcccgcccgcatctcgtcgtcccacccgcatggcggcgccgtccgccaccggccccatggcctccgtctcccgggtcctccgcccgcggccccgcgcccctgcctgcccggctccccgtctagggcgcgggctgggaatcgcgtgctcgttgccaagtcatgggggcaggaacgagaagtgcgggttgggactgcccgtcgcgtctgcgctatctgctactgccgctccggttctgaggagccgccaaattttatgcaaggctgaagctaatgtatccagtaatcttccggagagcttgcctgccgcagttagccagtatgaaaaaactgtggaggtggagagcccgcccgccgaacttagcacgtatgaaaaaattgtcgagttgcttaccactcttttccctgtctgggttatactaggcactattattggcatctacaagccatctatggttacctggttggagaccgatcttttcactgttttgttaggattcctaatgctctccatgggattaacattgacatttgaagattttaggagatgcttgaggaacccatggacagttggtgtgggatttcttgcacagtatttgatcaaacctttgctaggattagctattgcgacgaccttgaacttatctgctcctcttgcaactggtcttattttggtctcatgttgccctggtggacaagcatcaaatgttgcaacttacatatcagaggggaatgttgcgctttcagttcttatgaccacctgttcaactattggtgctattataatgac

SEQ ID NO: 13236 - protein, 252 aa, Panicum virgatum
  misc_feature: Ceres CLONE 1769049
  misc_feature (151)..(252): Pfam Name: SBF Pfam Description: Sodium Bile acid symporter family
MAAPSATGPMASVSRVLRPRPRAPACPAPRLGRGLGIACSLPSHGGRNEKCGLGLPVASALSATAAPVLRSRQILCKAEANVSSNLPESLPAAVSQYEKTVEVESPPAELSTYEKIVELLTTLFPVWVILGTIIGIYKPSMVTWLETDLFTVLLGFLMLSMGLTLTFEDFRRCLRNPWTVGVGFLAQYLIKPLLGLAIATTLNLSAPLATGLILVSCCPGGQASNVATYISEGNVALSVLMTTCSTIGAIIM

SEQ ID NO: 13237 - DNA, 2064 bp, Panicum virgatum
  misc_feature: Ceres CLONE 1769055
  misc_feature: Encodes the peptide sequence at SEQ ID NO. 13238
cctctcttttcccctccctcttcccggtccgaggagcgacctccgccgccgccgccatgccgaagcactaccgccctgcgggcaagaagaaggaggggaatgccgcgaagtacatcacgaggaccaaggcggtcaactacctgcaagtcagccttgcaattttcaggaagctatgtattctcaagggtgtttttcctcgtcaaccgaagaagaaggtggaaggaaaccacaagacatactaccacatgaaggatattgccttcatcgctcatgaccctttgatcgagaagttcaggcaaatcaaggtccacagaaagaaggttaagaaggctattgctaagaaaaacagggatcttgcggacagactgttgaatcggccaccaacatacaagcttgataagctggtccttgaaagatatcctacatttgttgatgctcttcgagacttggatgactgccttacattggttcatctgtttgcggcattacctgctgttgatggtgaacgtgttgaagtcaatcggatccataactgccgcaggttaagccatgaatggcaagcatacatatccagaactcattccctgaggaagacatttatttctgtgaagggcatatattaccaggctgaagttcaaagacaaaagatcacttggttaactcctcatgctcttcagcaagtattaactgatgatgttgacttcaatgtgatgcttagttttttggaattctacgagactcttcttggatttgtaaacttcaagctctaccattcaattaatgtaaattatcccccaattctggatcctcgattggaagctttagctgctgagctctatgcactgtgccgatacatctctactggttctgggagagtgactggaaattcagaatctggtggagcaatcaaggaaaaagaggataaaaacaaaaaagaaagctcaaaagctgatgagtctgaactcagattggcacagcttcaacatcagctcccagctaatgaacctggtacactaatgcatcttgtagaagaatcgactgctgttgacacagatgatgacgagaccaaagaatgtaaaagtttatttaagaacttaaaattctacttgagtcgggaggtgcctagggagtcccttctatttattatcccggcatttggtggaactgtttcatgggaaggagaaggagctccattcaacgaagtagatgaagacatcactcatcagattgttgataggccaacacaaagccatgttttcctctctagggcgtatgtccaaccacagtgggtatttgattgtgtaaatgctcgcatcattttgccgacagaggggtatcttgtgggaagagtacctccaccacatttgtctccttttgtggataacgacacagagggttacgttcctgagtatgctgagacaataaagaggctgcaagctgctgctcgcaatgagatcttgcctctgccaggtgatgaagatctggacaattcgttggtagctgcaatgatggatcgaacagaatcaaatgaagctgctgaaaagaagatgaagcttgagatgctagagaagcaataccacgatgagctgaaaatagaaatagatggcattactttctctaatctgtcaaataagaaagcagataagtcactggacaccacggacaaggatgattcaaagtcagatcacgaggatgatgagaagaagcaagctgagaaggatagtgctgacatttctacggctctcatgtctcggaagcagagaggcctttataaggcaattgagattggcaaggaaaggaaacgcgacaaagttgagctactgaagaagagaaaaaagaacgctgagtctagtgcttttgctaagcgacgctgagtcaagttcatcagcgcggcatgtatcagtttggtgtagcatttcatgtagcggcgctgccgtgatcagcattgtgtgatgccttttgatagctatgttgtttttctatgtttgacttagagatatctattcaaagtgggctttaaccttgtgcaccaggaatacaggatacttgaaatacaattttgat

SEQ ID NO: 13238 - protein, 605 aa, Panicum virgatum
  misc_feature: Ceres CLONE 1769055
  misc_feature (8)..(294): Pfam Name: Pescadillo_N Pfam Description: Pescadillo N-terminus
  misc_feature (339)..(416): Pfam Name: BRCT Pfam Description: BRCA1 C Terminus (BRCT) domain
MPKHYRPAGKKKEGNAAKYITRTKAVNYLQVSLAIFRKLCILKGVFPRQPKKKVEGNHKTYYHMKDIAFIAHDPLIEKFRQIKVHRKKVKKAIAKKNRDLADRLLNRPPTYKLDKLVLERYPTFVDALRDLDDCLTLVHLFAALPAVDGERVEVNRIHNCRRLSHEWQAYISRTHSLRKTFISVKGIYYQAEVQRQKITWLTPHALQQVLTDDVDFNVMLSFLEFYETLLGFVNFKLYHSINVNYPPILDPRLEALAAELYALCRYISTGSGRVTGNSESGGAIKEKEDKNKKESSKADESELRLAQLQHQLPANEPGTLMHLVEESTAVDTDDDETKECKSLFKNLKFYLSREVPRESLLFIIPAFGGTVSWEGEGAPFNEVDEDITHQIVDRPTQSHVFLSRAYVQPQWVFDCVNARIILPTEGYLVGRVPPPHLSPFVDNDTEGYVPEYAETIKRLQAAARNEILPLPGDEDLDNSLVAAMMDRTESNEAAEKKMKLEMLEKQYHDELKIEIDGITFSNLSNKKADKSLDTTDKDDSKSDHEDDEKKQAEKDSADISTALMSRKQRGLYKAIEIGKERKRDKVELLKKRKKNAESSAFAKRR

SEQ ID NO: 13239 - DNA, 776 bp, Panicum virgatum
  misc_feature: Ceres CLONE 1769060
  misc_feature: Encodes the peptide sequence at SEQ ID NO. 13240
ctttaaaagaaggggggcaattggggagggaggcctgcaaagaaaaggggaatactgcccttaagcctaccagtgccttcctccaaatcctgatatctgtaggcaagagttgctgccgttctcccacaagttccactctatcagacaccactatatgagcccatataagcagttcgtccacaataatcccacccttgagccataaaccgctgagaggtgttcttagacccggaggattacctgcagagttctgtgctgctcctcaaggtgtgagctgtgcagattgcagagctcagtttcagcttctgcattgctttcaatggggaggcactcctgctgctacaagcagaagctgaggaaggggctctggtctcctgaggaagatgagaagctcatgaaccacataaccaaacatgggcatggctgctggagcactgtcccaaagcttgcagggcttcagagatgtggcaagagctgcaggctgagatggataaattacctgaggcctgacctcaaaagaggtgcattctctcaggaagaggaagaccttatcattgaactccatgctgttttgggcaacaggtggtctcagattgcaacacggttgcctggaagaactgataacgagatcaagaatctctggaactcaagcatcaagaagaagctccgacagaaaggcattgaccccaacacccacaagccccttgccgaggttgattgcaaagcagctccaacaatcagtactgagagaacctccgagtccagcgatgatgacc

SEQ ID NO: 13240 - protein, 152 aa, Panicum virgatum
  misc_feature: Ceres CLONE 1769060
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: Useful for biocontainment applications
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 824 in the 10/412,699 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: Useful for making plants with modulated biomass
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1917 in the 10/374,780 US patent application
  misc_feature: Useful for making plants with altered alkaloid content
  misc_feature: Useful for making plants with modulated nitrogen use efficiency
  misc_feature: The sequence is a functional homolog of SEQ ID NO 442 in the 10/412,699 US patent application
  misc_feature: Useful for making plants with altered lignin content
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1004 in the 11/435,388 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1002 in the 11/435,388 US patent application
  misc_feature: The sequence is a functional homolog of SEQ ID NO 1010 in the 11/435,388 US patent application
  misc_feature: The sequence is a functional homolog of SEQ ID NO 1073 in the 10/374,780 US patent application 220>
  misc_feature: Useful for making plants with altered cell wall content and/or composition
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 296 in the 11/479,226 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: Useful for making plants with altered carbohydrate content
  misc_feature: The sequence is a functional homolog of SEQ ID NO 58 in the 10/666,642 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 836 in the 10/412,699 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 271 in the 11/479,226 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 569 in the 10/374,780 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application 220>
  misc_feature: Useful for making plants with altered terpenoid content
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 822 in the 10/412,699 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1681 in the 10/374,780 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: Useful for making plants with modulated low light sensitivity
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 794 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 446 in the 10/412,699 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 790 in the 11/435,388 US patent application
  misc_feature: The sequence is a functional homolog of SEQ ID NO 743 in the 10/666,642 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 36 in US patent 7193132
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1572 in the 10/374,780 US patent application
  misc_feature: Useful for making plants with modulated flowering time
  misc_feature: The sequence is a functional homolog of SEQ ID NO 2178 in the 10/374,780 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 126 in the 10/412,699 US patent application
  misc_feature: The sequence is a functional homolog of SEQ ID NO 1566 in the 10/374,780 US patent application
  misc_feature: Useful for making plants with modulated drought sensitivity
  misc_feature: The sequence is a functional homolog of SEQ ID NO 1563 in the 10/374,780 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 1692 in the 11/479,226 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 1565 in the 10/374,780 US patent application
  misc_feature: The sequence is a functional homolog of SEQ ID NO 1564 in the 10/374,780 US patent application
  misc_feature: The sequence is a functional homolog of SEQ ID NO 2898 in the 10/374,780 US patent application
  misc_feature: The sequence is a functional homolog of SEQ ID NO 494 in the 10/225,066 US patent application
MGRHSCCYKQKLRKGLWSPEEDEKLMNHITKHGHGCWSTVPKLAGLQRCGKSCRLRWINYLRPDLKRGAFSQEEEDLIIELHAVLGNRWSQIATRLPGRTDNEIKNLWNSSIKKKLRQKGIDPNTHKPLAEVDCKAAPTISTERTSESSDDD

SEQ ID NO: 13241 - DNA, 562 bp, Panicum virgatum
  misc_feature: Ceres CLONE 1769064
  misc_feature: Encodes the peptide sequence at SEQ ID NO. 13242
aacccccatcgccgcccgaagccgttcgctactcgccgccaatggccatggccttccaaacccttgccgcctcgcgcgtccgcaatcatgggcggtggcacggatgagcaaattgagcggctgcggaagtacgcgaggtcaatagggcttctgttccaggtggtcgatgatatacttgatgtgaccaagtcgtcggaggagctagggaagacagcagggaaggatttggcaagcgacaaggctacatacccgaaattgttggggttagagaagtcacgggagtttgcagaaaaattgctttccgatgcaaaggagcagcttgctggttttgacaaagagaaggcagcacctctgttgcatttggcctactatatcgcccataggcagaactgaggtgattgcttactctgttgttgttcttgttgatctgtaactttgtaaggccattgtacttgggtttcagaaatatccgaatcatcatgtgatgtatactagctgtagctttctaccttgctgtaagaaggctattcagttgaaaatatgaatatcaaatcaaattagt

SEQ ID NO: 13242 - protein, 101 aa, Panicum virgatum
  misc_feature: Ceres CLONE 1769064
  misc_feature: SWISSPROT Homolog: EC 2.5.1.29 Farnesyltranstransferase 220>
  misc_feature: Useful for making plants with altered protein content
  misc_feature: Useful for making plants with altered terpenoid content
  misc_feature: Useful for making plants with modulated nitrogen use efficiency
  misc_feature: Useful for making plants with modulated water use efficiency
MGGGTDEQIERLRKYARSIGLLFQVVDDILDVTKSSEELGKTAGKDLASDKATYPKLLGLEKSREFAEKLLSDAKEQLAGFDKEKAAPLLHLAYYIAHRQN

SEQ ID NO: 13243 - DNA, 1999 bp, Panicum virgatum
  misc_feature: Ceres CLONE 1769065
  misc_feature: Encodes the peptide sequence at SEQ ID NO. 13244
cctcttcattcggttcctcttcctcctccctcccctgcccctcctcctcgtctccccttccccgcctgctcttcgcgtgcgccgcggcggccgtggcccgtggaggacggacagcccgggggacgctcggggctcgtgccgggcgcactgatctgcggcctgcgtgtccccggtggcgggccgggccggcatcggcttcgaggaatgagcagattgtagcagctgtttcttctgcatatgcactttgtatttttgatatcatttcaaaggaggccatagtctcctggattttgtatgccttgttatctggaattggttaccgtagatgtcatttcgtagcatcgtccgtgatgttagggatggcttcggtagcttgtccagacgcagctttgacgtgaccctcgcaagcatttatggccttaccgggcatcacaaagggaggacccagagctcatcgcatgatctcgatgactcgccttccataatccgagaaagccgctgggcaaacctacctcctgaactcatccgtgatataatacggagactcgaggctgatgagagtacctggccagcacggaagcatgttgtttgctttgcagctgtttgtaggacatggagggaaatgtgtaaagagattgtgttgagcccagagttttgtgggaagctcactttccctgtctctctaaaacagcctggtcctcgaaaaggaaatacaatgattcaatgttttataaagaggaataagtcaaaatccacctaccatctctacctgtgccttagcaatgttgttacttcagaaagtggaaaattcctcttatcggctagaagacaccgcaaagccacatgcacagagtacactatatcaatggattctggcagcacctcaagatcaagcagaacctacattggaaaaataaggtcgaacttccttggcacaaaatttttaatttatgatacacaacccccctataatggggctgtagttcctcctgttggaaggaccagcaggaggttcaactccacaaaagtctctccgaagttgccttctgttagttacaacatcgctcaggtgtcatatgagctaaacgtccttggaacgagaggtccaaggcggatgcgttgcatcatgcactccatacccgcctcatcagtggagccaggtggcatagtaccaggacagccagagcagattgtacctcgcgctttggaggactcattccgcagcacagcttccttttcgcagtcattccgtagcaccacctcactgtccaagtccatcatggactcatccatggatttcaatagcgctcgcttctcagacattgctggcagcagtgctcgattctctggcattggcagcagtgctcgtatctcgggcattgctagcggcagattggatcacgacgaggacagtgaaatcaaggagagaccactggttcttcgtaataagccacctaggtggcatgaacagctgcagtgctggtgtctcaacttccgtggccgtgtgacaatcgcctctgtgaagaacttccagctgattgccacaacaactccacccgcaggtgctccaactccctcgcagcctgctccatcagatcctgacaaagtgattctacagtttggaaaagtggcaagggatatgttcacgatggactatcgctacccgctctcggctttccaggcatttgctatctgtctgagcagctttgatacaaaattggcctgtgaataaatggagaacaaaggttaaagaagaacgcagatgccctggcaataggccctcggtatctctttgctttttccagtcgtgttatcttgcttgtaattgttcttgcgtgcttgctgtagccatgaagtggacatatgtgggatgcatgtattgttggccccctctcccaaattgattacaagttccattaggaccacatgttacccgatctgtaatatacttccagtggcattgccacatgataagaaagttcccactggtggttgtacc

SEQ ID NO: 13244 - protein, 468 aa, Panicum virgatum
  misc_feature: Ceres CLONE 1769065
  misc_feature (123)..(462): Pfam Name: Tub Pfam Description: Tub family
  misc_feature (57)..(112): Pfam Name: F-box Pfam Description: F-box domain
  misc_feature: The sequence is a functional homolog of SEQ ID NO 458 in the 10/666,642 US patent application
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
MSFRSIVRDVRDGFGSLSRRSFDVTLASIYGLTGHHKGRTQSSSHDLDDSPSIIRESRWANLPPELIRDIIRRLEADESTWPARKHVVCFAAVCRTWREMCKEIVLSPEFCGKLTFPVSLKQPGPRKGNTMIQCFIKRNKSKSTYHLYLCLSNVVTSESGKFLLSARRHRKATCTEYTISMDSGSTSRSSRTYIGKIRSNFLGTKFLIYDTQPPYNGAVVPPVGRTSRRFNSTKVSPKLPSVSYNIAQVSYELNVLGTRGPRRMRCIMHSIPASSVEPGGIVPGQPEQIVPRALEDSFRSTASFSQSFRSTTSLSKSIMDSSMDFNSARFSDIAGSSARFSGIGSSARISGIASGRLDHDEDSEIKERPLVLRNKPPRWHEQLQCWCLNFRGRVTIASVKNFQLIATTTPPAGAPTPSQPAPSDPDKVILQFGKVARDMFTMDYRYPLSAFQAFAICLSSFDTKLACE

SEQ ID NO: 13245 - DNA, 997 bp, Panicum virgatum
  misc_feature: Ceres CLONE 1769067
  misc_feature: Encodes the peptide sequence at SEQ ID NO. 13246
caccgcagactcttccgccgtcgtcgcgcctcctcgctcggttcgctcgctcgccgccgccgccctccttctacccctacgttccgtgctgcgaatcagtgcgcgcgcgcgtatcttgctgcgccggcggctacttgttcttagtcgatctgttgttgcgttgatgtgcaggtaggtaggagaggaagagggcgaaatggtgaagcacaacaacgttatccccaacgggcacttcaagaagcactggcagaactatgtcaagacatggttcaaccagcccgcccgcaagcagcggcgccgcatcgctcgtcaaaagaaggctgcgaagatattcccacgcccaactgctggacctcttcgccccattgtccaatgccaaactctcaagtacaacatgaagtcaagggctgggagaggcttcactcttgaggagctgaaggctgcgggcattccgaagaagcttgctccaaccattggcatttctgtggatcaccgccgcaagaacaaatcacttgagggcctccaggctaatgtccagaggctgaagacgtacaaggccaagctggttatcttcccaaggcgtgctcgcaaggtcaaggctggtgactctactcctgaggagcttgccagcgccacccaggtccagggtgactacatgccttttactcgtggtgagaagcgctcggttgaggttgtgaaggtcagcgatgagatgaagtcgttcgcagcgtatggcaagatccgccttgagaggatgaacaagaagcaccttggtgcccgccagaagaaggccgctgaggctgagaaggaagagaagaagtaaagtgaccatcggatatagtatcttctagttgatgctacagccaagggcttgttctaagttttgttttgttcctgaaagtagagaccagtggattgttttggtgtccttgtactgtttgatacctggtacgcatttgcgcacactattatctagtggttcatcggattcttgtcc

SEQ ID NO: 13246 - protein, 208 aa, Panicum virgatum; identical to SEQ ID NO: 10192
  misc_feature: Ceres CLONE 1769067
  misc_feature (6)..(185): Pfam Name: Ribosomal_L13e Pfam Description: Ribosomal protein L13e
  misc_feature: Useful for making plants with modulated nitrogen use efficiency
  misc_feature: Useful for making plants with modulated phosphate use efficiency

SEQ ID NO: 13247 - DNA, 845 bp, Panicum virgatum
  misc_feature: Ceres CLONE 1769071
  misc_feature: Encodes the peptide sequence at SEQ ID NO. 13248
acgccatttacctccccgactccgccgtctcctgcccctccgcctcagcggtttaaggttcacctacagccatgggtaaggagaagtcccacatcaacatcgtggtcattggccacgtcgactctggcaagtcgaccaccaccggccacctgatctacaagcttggcggtatcgacaagcgtgtgatcgagaggttcgagaaggaagccgctgagatgaacaagcggtccttcaagtacgcgtgggtgcttgacaagctgaaggctgagcgtgagaggggtatcacaatcgatatcgccctgtggaagttcgagaccaccaagtactactgcactgtcattgatgcccccggacaccgtgacttcattaagaacatgatcacgggtacctcccaggctgactatgctgtacttatcatcgactccaccactggtggttttgaggctggtatctccaaggatggccagacccgtgagcatgctctccttgccttcactcttggagtgaagcagatgatctgctgctgcaacaagatggatgccaccactcccaagtactccaaggcccgttatgatgagattgtgaaggaagtctcctcctacctgaagaaggtcggatacaatcctgataagattgccttcgtccccatctctggttttgagggtgacaacatgattgagaggtccacgaaccttgactggtacaagggaccaaccctgcttgaggctcttgaccagatcaacgagcctaagaggccttcagacaagcccctgcgtctcccccttcaggatgtgtacaagattggtggtattggaaccgtccctgttgggcgtgttgagactggt

SEQ ID NO: 13248 - protein, 257 aa, Panicum virgatum
  misc_feature: Ceres CLONE 1769071
  misc_feature (5)..(225): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADYAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVET

SEQ ID NO: 13249 - DNA, 782 bp, Panicum virgatum
  misc_feature: Ceres CLONE 1769074
  misc_feature: Encodes the peptide sequence at SEQ ID NO. 13250
ctcgcctctctccgcgcttcaaagcttctcctcccatttcccaccgccgccgccgcccacccttccgacgacaccatgagggagtgcatctcgatccacatcggccaggccggtatccaggtcggaaacgcgtgctgggagctgtactgcctcgagcatggcattcagcctgatggtcaaatgcccagtgacaagacagttggaggaggtgatgatgcattcaacaccttcttcagtgagactggcgctgggaagcatgttccccgtgctgtgtttgttgatcttgagcccttttttattgatgaggtgaggactggcacttaccgccagcttttccaccctgagcagctcatcagtggcaaggaggatgctgccaacaactttgcccgtggtcactacaccattggcaaggagattgttgacctatgccttgaccgcatcaggaagcttgccgacaactgcactggtctccagggcttcctcgtgttcaacgctgttggtggaggaacaggctctggccttggttccctcctccttgagcgcctgtctgttgactatggcaagaagtccaagctcgggttcactgtgtacccatctccccaggtctccacctcagttgttgagccatacaacagtgtcctgtccacacactccctcctcgagcacactgatgttgctatcctgcttgacaatgaggccatctacgacatctgccgccgctcccttgacattgagcgcccaacctacactaacctcaacaggcttgtgtctcaggttatctc

SEQ ID NO: 13250 - protein, 235 aa, Panicum virgatum
  misc_feature: Ceres CLONE 1769074
  misc_feature (49)..(235): Pfam Name: Tubulin Pfam Description: Tubulin/FtsZ family, GTPase domain
  misc_feature: Useful for making plants with altered cell wall content and/or composition
MRECISIHIGQAGIQVGNACWELYCLEHGIQPDGQMPSDKTVGGGDDAFNTFFSETGAGKHVPRAVFVDLEPFFIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAILLDNEAIYDICRRSLDIERPTYTNLNRLVSQVI

SEQ ID NO: 13251 - DNA, 1791 bp, Panicum virgatum
  misc_feature: Ceres CLONE 1769075
  misc_feature: Encodes the peptide sequence at SEQ ID NO. 13252
gccctccttccccttctcgatccccaaccccccacagctgtctccgctccaccaatccatccgtccatcccgccgcgcccgcattctccgccctccccggcggcgagcacccgccccgcccctccctcctcggctccgtcgcctccgggagcatcgtcgcggcgcgcccctcgcgggagtcgcggcggcgcgttcccgatcggagctctccccgtcctagggtttttggggcgggccatggacccgatggagcagccggagcccgaagtcgcgggccactactacgcccaccaggtgggctcctacttcctgacgggctactacaacgtgctgacgaaccagccgcacctggcgagccagttctacacggacagcagcagcgtcgtcaggctggactgcgagacggggcagtggtcgcttggagagacgatggaggttatcaatgatatgatgatgtccatgaatgtaaccaaggttgaggttaaaacagcaaatttcttggagtcatggggtgctgcgatcacgctgctggtcactggcctagtgcaattgaaggactaccctgttcgcaagcgattcgttcagaatattgttcttgctccaaagaaagatgggtattttatattcagtgacatctttaagctcatttgtgatgagtatgatgatcagtaccacgtttctgattacatttgtgctgacaacctgccccaagtggatgcttcttatacaatggctgaaacagggtctgattatttggatggagagactcaggaggttgtagctcctgctgaaaatcatgtgcagcagcaagatccttcggagtataaggttgtgaatgtgatctacgaggaaactcattcagaagagcatgtgccctcattccccagttcaaaagatgttaaacaggattcgcctcttgctccccaccctccttccccgcctacccccgaagaacctgttgaagaagcacctaaaacatatgcttcagtgttgcgaacaaaagcgaaggccacaatggggactgctgagtcacaacaggctcaacagttgcctcagcaggtgcaaactgtcctggtgcatgaaaaatctaacttggacaacaaccgggctgttagcgcccctgatgatgaagaagagtttatttcagtttatgttgggaatctttcgccatctacttcagtctttgatcttgagaaggtgtttcaggcttttggcagaattaaacctgatggagttgctatccgaagccgcaaggaggctggagtcttctttggctttgttgagtttgaggacatgtctggtattcagaatgctttaaatgcgtcgccgatagaattgaatggccgtttagtacatgttgaggagaagaggcctaactgtggattcccaagtgccagaagacgggggcgaggaaaggaccaagctgatggacgatatgacggggagtatgctactcgatcgaagggaaccgggtaccagaaaaggggtggacgccagtatgatagctactactagtttcgtatctgctctgctggtggatgagtttcgtatctgctctgctggtggatggccatgtgccgtaggtgttctctacctggtgcggttctggccatagttttgccgaaagtcacaatggtgtgggggctagcatagctttgttgacattaagcagagtcgttttgggatgggcttctgttactgttttgttgcgtcatagtagtttttgcgcctcagctacagtgacctgttaaaatattgatcatgctgccgtctggatcggtgtcttttgag

SEQ ID NO: 13252 - protein, 425 aa, Panicum virgatum
  misc_feature: Ceres CLONE 1769075
  misc_feature (20)..(136): Pfam Name: NTF2 Pfam Description: Nuclear transport factor 2 (NTF2) domain
  misc_feature (304)..(374): Pfam Name: RRM_1 Pfam Description: RNA recognition motif. (a.k.a. RRM, RBD, or RNP domain)
MDPMEQPEPEVAGHYYAHQVGSYFLTGYYNVLTNQPHLASQFYTDSSSVVRLDCETGQWSLGETMEVINDMMMSMNVTKVEVKTANFLESWGAAITLLVTGLVQLKDYPVRKRFVQNIVLAPKKDGYFIFSDIFKLICDEYDDQYHVSDYICADNLPQVDASYTMAETGSDYLDGETQEVVAPAENHVQQQDPSEYKVVNVIYEETHSEEHVPSFPSSKDVKQDSPLAPHPPSPPTPEEPVEEAPKTYASVLRTKAKATMGTAESQQAQQLPQQVQTVLVHEKSNLDNNRAVSAPDDEEEFISVYVGNLSPSTSVFDLEKVFQAFGRIKPDGVAIRSRKEAGVFFGFVEFEDMSGIQNALNASPIELNGRLVHVEEKRPNCGFPSARRRGRGKDQADGRYDGEYATRSKGTGYQKRGGRQYDSYY

SEQ ID NO: 13253 - DNA, 961 bp, Panicum virgatum
  misc_feature: Ceres CLONE 1769083
  misc_feature: Encodes the peptide sequence at SEQ ID NO. 13254
agctgtccaaaggaccaaaaccctagactcggaaaccggccgccgctcgccccttgacaaccgaacagctcggcaaccatgtcgtcggcgttcctcgccgcccggctcctccgccgcgccgccaccgcatcctcgtcctctcctctctccgccctagcccgccgcgccctccacttgggccgtgcccccgttcccctcccgcgccgtctccccgccgccgctcgccggtttctggcgtcgcagtctccggcgtcctcctccaaagactccgccgacgagaacctgaggcgggtcatcgagtcggagatcgagtgcgtcgtccagtcggaggagagcttagccgacaagcacattggactaccagatgacttcccttttgaggtcatagacaatcctggtgatcaatccataaccctcaaaagagagcttgctggtgagacaattaaagctgctgtctacaccaactttgatacagaggaagatttggatgaggatgatgggagtgacaatgatggagaatctttcaagccagcaattcagatggttgtcactgttgaaaaaacagaaggcccaatcctggaatttgactgcaactttaatgatgatgaactggcaattgaaagtatgagggtgctgaaccgtgatgaccctgatgctgagaatatgtatgagggaccaccattttcggacttggatgagagcttgcagaaggccttgcataagtaccttgaggcgagggggatcaagcactcactgcatgactggctgtacgagtacatgatgagaaaggatgagaaggagtatgtggtctggttgaagaacatgaaggagttcattggaaactgagtgcctctgcctgttagtttccttttgttgggagaacaagccttgcactcatcgtctcatactctgatcataattacgcaaatatacctcctggcaacatatattttgcttctcc

SEQ ID NO: 13254 - protein, 255 aa, Panicum virgatum
  misc_feature: Ceres CLONE 1769083
  misc_feature (73)..(253): Pfam Name: MAM33 Pfam Description: Mitochondrial glycoprotein
MSSAFLAARLLRRAATASSSSPLSALARRALHLGRAPVPLPRRLPAAARRFLASQSPASSSKDSADENLRRVIESEIECVVQSEESLADKHIGLPDDFPFEVIDNPGDQSITLKRELAGETIKAAVYTNFDTEEDLDEDDGSDNDGESFKPAIQMVVTVEKTEGPILEFDCNFNDDELAIESMRVLNRDDPDAENMYEGPPFSDLDESLQKALHKYLEARGIKHSLHDWLYEYMMRKDEKEYVVWLKNMKEFIGN

SEQ ID NO: 13255 - DNA, 820 bp, Panicum virgatum
  misc_feature: Ceres CLONE 1769085
  misc_feature: Encodes the peptide sequence at SEQ ID NO. 13256
ctcgatccgaaaacccctccaaccctagccgcctcctgcaagttagggagctcgggaatcaggcagccatggcgacggagacggagaccttcgccttccaggccgagatcaaccagctgctctcgctcatcatcaacaccttctactccaacaaggagatcttcctccgcgagctcatctccaactcctccgatgcgttggacaaaatcaggttcgagagcctcactgacaagagcaagctcgatgcgcagccggagctgttcatccacattgtccccgacaaggccagcaacacgctctccatcatcgacagcggcatcggcatgaccaagtccgatctcgtcaacaacctcgggaccatcgccaggtccggtaccaaggagttcatggaggcccttgccgccggcgcggacgtgtccatgattgggcagttcggtgttggtttctactccgcctacctcgtcgccgagagggtggttgtgaccaccaagcacaacgacgacgagcagtacgtgtgggagtcccaggccggcggatcgttcactgttacccgtgacacgtccggggagcagcttggcaggggtactaagatcacgctcttcctcaaggatgatcagttggaatatcttgaggagcgccgcctcaaggatcttgttaagaagcactctgagttcatcagttaccccatctccctgtggactgagaagacaactgagaaggaaatttctgatgatgaggatgaggaagagaagaaggatgctgaggagggcaaggttgaggatgttgatgaggagaaggaagagaaggaaaagaagaagaa

SEQ ID NO: 13256 - protein, 250 aa, Panicum virgatum
  misc_feature: Ceres CLONE 1769085
  misc_feature (28)..(182): Pfam Name: HATPase_c Pfam Description: Histidine kinase-, DNA gyrase B-, and HSP90-like ATPase
MATETETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKITLFLKDDQLEYLEERRLKDLVKKHSEFISYPISLWTEKTTEKEISDDEDEEEKKDAEEGKVEDVDEEKEEKEKKK

SEQ ID NO: 13257 - DNA, 599 bp, Panicum virgatum
  misc_feature: Ceres CLONE 1769085-R
gaccgtgttgtggactcgccgtgctgccttgtaactggtgagtacggctggacagccaacatggagaggatcatgaaggcgcaggccctgagagactcaagcatggctggctacatgtcgagcaagaagaccatggagatcaacccggagaacgccattatggatgagctccgcaagcgtgctgaggctgataagaacgacaagtcagtgaaggaccttgtgatgatgttgttccagactgcccttctaacttttggttttagtttggatgacccaaaaacattgggcaccaggatccaacgcacgataaagctaggattgagcattgatgaggatgagtaggagagcgctgaagctgagatgcctaagatggaagatgatgctggagagagcaaaatggaggaggtggaataaaactttttacagctttttatgcttcgattatttgcaattaccaagcgaaggctaatattgactgatgttcgaggttttttgaacgttatcggttttcttgctacctacgcgatcagtctggttccgctgtcatcgtacaactctgtcaaccagtctgcagttactattcacacagccactactat

SEQ ID NO: 13258 - DNA, 710 bp, Panicum virgatum
  misc_feature: Ceres CLONE 1769089
  misc_feature: Encodes the peptide sequence at SEQ ID NO. 13259
ggcccaacatgccacataggacccaatggtggcaatttgtcatggcacgagaagagtaaaagaaggtgtgaccttattagtgttagatcactaccctggagcggcgagcttgtagaatatctgacgccttcagaaatcccaaagagggactggttcagcgacgagttcgtctttggctccgccacttcagcataccaaattgaaggtgcttggaatgagcatggcaaggtgtttttttcttgggaccacttctgccacacttatcctgagaggatagttgatggaagcaatggggatgttgcagtgaactcctaccatatgtatgaagaggatgtcaagttgctgaagcaaatgggcatggacgcctataggttctcaatctcttggtcgagaatactgccaaaggggacgctcgaaggtgggataaactataatggcctccagtactacagaaacctgatcaacacgttgaaagagaatggcatagagccatatgtaacaattttccactgggacactcctcaagcactggaggacaagtatggcagcttcagagatccgaggattataaaagactacacagactttgccagggtgtgcttcgagcattttggcgacaaggtgaaacactggttcacctttaatgagcctcaaaacttttgttcatatgcctatggatcggggcagcatgctcctgggaggtgctcacc

SEQ ID NO: 13259 - protein, 236 aa, Panicum virgatum
  misc_feature: Ceres CLONE 1769089
  misc_feature (48)..(235): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
  misc_feature: Useful for making plants with altered carbohydrate content
GPTCHIGPNGGNLSWHEKSKRRCDLISVRSLPWSGELVEYLTPSEIPKRDWFSDEFVFGSATSAYQIEGAWNEHGKVFFSWDHFCHTYPERIVDGSNGDVAVNSYHMYEEDVKLLKQMGMDAYRFSISWSRILPKGTLEGGINYNGLQYYRNLINTLKENGIEPYVTIFHWDTPQALEDKYGSFRDPRIIKDYTDFARVCFEHFGDKVKHWFTFNEPQNFCSYAYGSGQHAPGRCS

SEQ ID NO: 13260 - DNA, 817 bp, Panicum virgatum
  misc_feature: Ceres CLONE 1769090
  misc_feature: Encodes the peptide sequence at SEQ ID NO. 13261
ctgtttccgcactacagtgtccagcgccttcaaccccctccctccctctcgcccctctgtcctctccacttgagaagaacacaatagaaaaaaggcaaaaaacatttacctttttatatctatccgaataaaatcaggaagaggaagagggagagagggcagggagggggagaagagtagcaatccagattcaaagaggctagcaatcagctcgcgaggagaggatagtgagagctgcgttggtgaattgattgctcgctgttccagtcctgcattcctgcggcagcagtttttggcaagtaggtggcgtggcaagcatggtgtttttttatgactgcgccgcctccgtgctgctctgcgcggaggacaacgccgctattctcggccttgatgaggagggggaggagtcctcttgggcgggcgctacgccgccacgcgataccgtcgccggcggcggaggcagcgggatcgccgtggaggaattctcgacggagctccccctgcagtcagatgagtacgttgcggcgctcgtggagagggagacggggcacatgcccgcggaggggtacccccagaagctgcaacgccggcaagggggactggatttggccgccatccggaggggcgccgtcgattggatttggaaggtcactgagcattaccatttcgcaccgttgactacagttttatctgtgaactacctcgatagattcctctccacgtatgagtttcctgaaggcaaaccttggatgccgcagctcttgacagtggcatgcttgtcactggctatgagaatagaggagacttttgcgccact

SEQ ID NO: 13261 - protein, 166 aa, Panicum virgatum
  misc_feature: Ceres CLONE 1769090
  misc_feature (66)..(165): Pfam Name: Cyclin_N Pfam Description: Cyclin, N-terminal domain
MVFFYDCAASVLLCAEDNAAILGLDEEGEESSWAGATPPRDTVAGGGGSGIAVEEFSTELPLQSDEYVAALVERETGHMPAEGYPQKLQRRQGGLDLAAIRRGAVDWIWKVTEHYHFAPLTTVLSVNYLDRFLSTYEFPEGKPWMPQLLTVACLSLAMRIEETFAP

SEQ ID NO: 13262 - DNA, 1912 bp, Panicum virgatum
  misc_feature: Ceres CLONE 1769092
  misc_feature: Encodes the peptide sequence at SEQ ID NO. 13263
atccatccagaacccaaatccatcaagcaactacgcctgttttcacgtcccttccctccctgattctgatcgtcgatggtccaccaccatcgggcgagcctgctggcgccccagcagcgcaaggtcgaggcggcggcggaggacccggagcaaggcggcggcggcaggatgaaggagctccggcgccgcctggcggactacgcctgccaccaccaccggaagcacggccacgacgcgctgctccgcatgctcgcgggcttcgcgctcgcctcctgcctcctgctgctgctcccgggcagccccatcgtctccggcgccatggacgagctgctgcagctcgggaggagggtgcgccgcgaccaggaggcggcgccgccgttcgctgctgacgacgtcgccgacggcaccgtctgctgcgaccgctcgtcgcaccgcaccgacgtctgcgtcatgcgcggggacgtccgcacccaggccgcctccaattcgctcttcctgctcgtgccgccaaacgcgtcgtcccgggccgccgccgccgccgacgagcgcatccggccgtacacgcgcaagtgggagtccggcatcatgagcaccgtcgacgagctccgcctccgctccgcgcccgagggggacgccgccgcgcccgcccgctgcgacgtccgccacggcgtccccgccgtcgtcttctccaccggcggctacaccggcaacgtgtaccacgagttcaacgacgggatcatcccgctctacatcaccgcgcgccgctacaacaagaaggttgtcttcgtcatgctcgagtaccacgactggtggatgaccaagtacggccacatcgtggagcagctctccgactaccctcccgtcgatttcgccaacgaccgccgcacgcactgcttcccggaggccgtcgttggtctgcgcatccacgacgagctcgccatcgacgccgcgcggacgccagccaaccagacaatccaggatttccgccagatgcttgacgacgctcaccgtggccgcatccagacaatcattgaggaggaggagaaggaagccgtcgctgctgctgctgctgctgctgcggcggcggcggcggcgaggaagcagcaacaccgcggcagccagaggatccgacgcaccaggacggccgaggacgacgacagcccacggctcgtgatcgtctcccggaacgggtcgcgcgcgatcgagaacgaggccgagctggtgcgagccgcggcgggcgccgggttccgcgtctccgtgctccagccgcgcccggacacggagcttgccaagatgtaccgcgccctgaacgcgtcggacgtcatggtgggcgtgcacggcgcggccatgacgcacttcctgttcatgcgccccggctccgtgttcatccaggtggtgccgctcggcacggactgggccgccgagacgtactacggcgagccggcgcggcggctgggcctgcgctacatgccctacaagatcctgccatccgagagctcgctccgcgggcagtacgccaaggacgaccccgtgctgaccgacccggacaccgtgaacgccaaggggtggcaggtcaccaagcaggtttacctggacggccagaacgtacggctggacattgcacggttccgccgccacctgcaccgggcgcgtgaccactgggcgacgcgacgcagggccaccgcgcggactggatcaggggcggagcagcggtagcgtttgcggatcttgttttcatttttgacatggtgaatgttgtataaagtatgacatatagagagggtggctgagatctgttgtacatggcagtagatacgttgatttcttttttttttttacatttgggacacaaacggagctgttatgaagtacataacaagacaacaatatcaatgtatattttctcacccag

SEQ ID NO: 13263 - protein, 546 aa, Panicum virgatum
  misc_feature: Ceres CLONE 1769092
  misc_feature: Useful for making plants with altered carbohydrate content
MVHHHRASLLAPQQRKVEAAAEDPEQGGGGRMKELRRRLADYACHHHRKHGHDALLRMLAGFALASCLLLLLPGSPIVSGAMDELLQLGRRVRRDQEAAPPFAADDVADGTVCCDRSSHRTDVCVMRGDVRTQAASNSLFLLVPPNASSRAAAAADERIRPYTRKWESGIMSTVDELRLRSAPEGDAAAPARCDVRHGVPAVVFSTGGYTGNVYHEFNDGIIPLYITARRYNKKVVFVMLEYHDWWMTKYGHIVEQLSDYPPVDFANDRRTHCFPEAVVGLRIHDELAIDAARTPANQTIQDFRQMLDDAHRGRIQTIIEEEEKEAVAAAAAAAAAAAAARKQQHRGSQRIRRTRTAEDDDSPRLVIVSRNGSRAIENEAELVRAAAGAGFRVSVLQPRPDTELAKMYRALNASDVMVGVHGAAMTHFLFMRPGSVFIQVVPLGTDWAAETYYGEPARRLGLRYMPYKILPSESSLRGQYAKDDPVLTDPDTVNAKGWQVTKQVYLDGQNVRLDIARFRRHLHRARDHWATRRRATARTGSGAEQR

SEQ ID NO: 13264 - DNA, 645 bp, Panicum virgatum
  misc_feature: Ceres CLONE 1769094-R
  misc_feature: Encodes the peptide sequence at SEQ ID NO. 13265
ccgcgtgccaatgtggccacggcacctcgtcccgcgcgccccgacgacgccgtgggctcctccgccgtctgacccggcgttctggcaccacccttacatgaggggacctacacatatgccgggccaagtggctccctgcgtagcagtgccaatgccagccgcgcgatttcctgctccaccggtgaggggtgttttgccgtgtccacctccaatgtacagacctctcgttcctccagaactaggcagcaagagtccgcaagatacgcagctccagctacagatacagccatcaagtgagagcatagatgcagcgatcggtgatgttttatcgaaaccatggctgccactgccccttggcctgaagccgccttcagtagacagtgtcatggtcgagttgcagaggcaaggtgtagcagatgttcctccagcttgtggatgatctctgcgagatggatgagtcctccatgatagctgctcgtcccctcagtccaacaaaaagaattcgttgacatgcctttttttcattttcacgaaccatctatggtggacaactctcttaacttgtccagcgttaagaaaaatgacttcagcctttcaccttggcgagaaattaattaacccgaggacatccatgcgaccaagtag

SEQ ID NO: 13265 - protein, 145 aa, Panicum virgatum
  misc_feature: Ceres CLONE 1769094-R
  misc_feature: The sequence is a functional homolog of SEQ ID NO 1093 in the 11/479,226 US patent application
  misc_feature: The sequence is a functional homolog of SEQ ID NO 478 in the 10/412,699 US patent application
RVPMWPRHLVPRAPTTPWAPPPSDPAFWHHPYMRGPTHMPGQVAPCVAVPMPAARFPAPPVRGVLPCPPPMYRPLVPPELGSKSPQDTQLQLQIQPSSESIDAAIGDVLSKPWLPLPLGLKPPSVDSVMVELQRQGVADVPPACG

SEQ ID NO: 13266 - DNA, 141 bp, Panicum virgatum
  misc_feature: Ceres CLONE 1769094
accgagaggggcgacgggcgggacaccagcagagagacgccggcagcgccgccgccggcgagccgggcccaaaaggaagagcgccgcggaggcgccggcgaggagaaggaggagaccggccacgggccggagccggacgac

SEQ ID NO: 13267 - DNA, 842 bp, Panicum virgatum
  misc_feature: Ceres CLONE 1769096
  misc_feature: Encodes the peptide sequence at SEQ ID NO. 13268
gccccctgttttggaaaaccgcggtcggttgtgcagattccgcggcgctactcatagagtcagtgtgctcttcctatgttgcggcttgcttgaggccaaaagcctgtagcgcgctagtagatggccgggcgacgtcgcggtcggattattacgcgcgaaataggaaccagcttgtggaacttcccgtccctgcggcaaagaagaatgagcttctgttgaagctggaggcagcaagcatcaatccggtggactggaagctacagaaagggatgctacgccctatcctgcctcgcaaactgccttttatcccagtgactgatgtggcaggagttgtggttgatgttggtccaggagtcaatggattccaggctggagatcaagttgttgccatgctgaactcattttatggaggtggacttgcggagtatgctgtggcatctgagaatctgaccgttaagaggcctcctgaggtgtcccctgctgaaggcgcagggctgcccatcgcagctggcactgcgctccaagctttaaggaccattggcgccaagttcgacggaactggcgagcccttaaatgtgctgatcaccgcagcatctggtggtgttgggctctacgccgtgcagctcgcaaagctggcaggtctccacatcactgccacctgtggcgcgcgcaatgtggaactggtgaagagcttgggcgcggatgaggtgctcgactacaggacgccggagggcgccagcctgcagagcccatcaggcaagaagtacgacggcatcgttcactgcacagtcgggataagctggtcgacgttcgagcctgtgctcgccaacaccggtagggtg

SEQ ID NO: 13268 - protein, 279 aa, Panicum virgatum
  misc_feature: Ceres CLONE 1769096
  misc_feature (67)..(153): Pfam Name: ADH_N Pfam Description: Alcohol dehydrogenase GroES-like domain
  misc_feature (188)..(279): Pfam Name: ADH_zinc_N Pfam Description: Zinc-binding dehydrogenase
  misc_feature: SWISSPROT Homolog: EC 1.6.5.5 NADPH:quinone reductase
PLFWKTAVGCADSAALLIESVCSSYVAACLRPKACSALVDGRATSRSDYYARNRNQLVELPVPAAKKNELLLKLEAASINPVDWKLQKGMLRPILPRKLPFIPVTDVAGVVVDVGPGVNGFQAGDQVVAMLNSFYGGGLAEYAVASENLTVKRPPEVSPAEGAGLPIAAGTALQALRTIGAKFDGTGEPLNVLITAASGGVGLYAVQLAKLAGLHITATCGARNVELVKSLGADEVLDYRTPEGASLQSPSGKKYDGIVHCTVGISWSTFEPVLANTGR

SEQ ID NO: 13269 - DNA, 541 bp, Panicum virgatum
  misc_feature: Ceres CLONE 1769096-R
caccggtagggtgattgacatcaccccgaacttcaccgccatcctcaagtcggcgctgcacaaggtgacgtttgccaggaagcggctggtgcccctgctcctgtctcccaacaaagctgacctggagttcctggtccggctgctgaagaacggcaagatgaagacgctgatcgactcgaggttctctctgagcgaagccagcaaggcttgtgagaagagaatggagggccccgcgacaggccagataatacttgagatggaagcctgctccgcgcgtaccaaaagcagggagacgcaaggcagatggctatacacatcccgcctcgagggacaagtagtagcagggtgtacgggcacggatttgttgtacagaagaatattggtgcggaacggaggatcgatgttcataggatcgtgctttttgttgtatttcgactgtgaggttgttcagtaggtcggggcttcctggatttgcaccgctgataagtaacgaggcctcgtagcatttcgtcggacatgttccgctagcccactagcttcg

SEQ ID NO: 13270 - DNA, 818 bp, Panicum virgatum
  misc_feature: Ceres CLONE 1769099
  misc_feature: Encodes the peptide sequence at SEQ ID NO. 13271
aaaaaccctagctcggtaacgccgccgcctccgcctccgctaacctccgcagcctagccgagcccgtctcccctctctcctctctcctccctccaccagcagagacaagagaacgcggcggcgagatggtgaagaagagcaagaagagcaagagcaagcgcgtcacgctgcgccagaagcacaaggtgctgcgcaaggtgaaagagcaccaccgcaagaagcgtaaggaggccaagaaggagggcaaggccgaccaccggaagaaggtcgagaaggacccggggatccccaacgagtggccgtttaaggagcaggagctcaaggcgctcgaggcacgccgcgcccaggcgctgcaggagctcgagctcaagaaggaggcgcgcaaggagagggctcggaagaggaagcttggattgcttgaggatgaggacattgccaaattggcatcggcagcttctgcacagggcaatgagtttgcggagaaggatgcaacaaaggagaacgctcctttagaaattgcaaagagccatgatcattcagagagatcgttctacaaggagcttgttaaagtgattgaggcttccgatgtgattctggaagttcttgatgcaagggacccactgggtacccgttgcattgatatggaaaggatggtcaggaaggctgatcctagtaaacgaattgtgctgctactcaacaagatagaccttgttcccaaggaggcggtcgagaagtggcttacatatctaagagaagagatgccaacagttgcatttaagtgtaatacccaagagcagaggaccaagctaggatggaat

SEQ ID NO: 13271 - protein, 230 aa, Panicum virgatum
  misc_feature: Ceres CLONE 1769099
  misc_feature (16)..(96): Pfam Name: GN3L_Grn1 Pfam Description: GNL3L/Grn1 putative GTPase
MVKKSKKSKSKRVTLRQKHKVLRKVKEHHRKKRKEAKKEGKADHRKKVEKDPGIPNEWPFKEQELKALEARRAQALQELELKKEARKERARKRKLGLLEDEDIAKLASAASAQGNEFAEKDATKENAPLEIAKSHDHSERSFYKELVKVIEASDVILEVLDARDPLGTRCIDMERMVRKADPSKRIVLLLNKIDLVPKEAVEKWLTYLREEMPTVAFKCNTQEQRTKLGW

SEQ ID NO: 13272 - DNA, 1438 bp, Panicum virgatum
  misc_feature: Ceres CLONE 1769100
  misc_feature: Encodes the peptide sequence at SEQ ID NO. 13273
gcaagagtttcagccaacacagagaactcttcctcagaactctcccttccctcctgcaggggccagggttagagaagaagagaagtagttccaaaggccaaacaaacaacacagctcatcacctcaattccagcaactgatcattcagttgtatagcttgtgttgggaagctcttttagctatattatttgtagttcctttgtatcgcaatggcaggtctatctctgcagcacccctgggcattcgccttcggcctcctaggcaacgtcatctccttcacgaccttcctggctccaatcccgacattctaccgcatctacaagagcaagtcgaccgagggtttccagtcggtgccctacgtggtggcgctgttcagcgcgatgctgtggatcttctacgcgctgatcaagtccaacgagttcctcctcatcaccatcaacgcagccggcatcgttattgagagcatctacgtagtcatgtacttcgtctacgcggacaagaaagccaagtggttcactgcgaagatcatgctcggcctcaacgtcggcttcttcggggccatcctcctcgtcaccctgctcctcttcaagggcgacaagcgcatcgtcacgctcggctggatctgcgtcgccttctccgtcagcgtcttcgtcgcaccgctcagcatcatcaagcgtgtgattcagacgaggagcgtggagtacatgcccttctccctctcgctctcgctcaccctcagcgccgtcgtctggttcctctacggcctcctcatcaaggacaaatacgtcgcgctcccgaacgtcctcgggttcagcttcggcgtggtccagatgatcctgtacgtggtctacatgaacaagacgccggtggtcgccgagggcatggacgccgccggcggcaagctgccgacggcggcggcggccgcggacgagcacgtcctcgtcaacatcgccaagctcagccccgccatcccggagaagagctccgaggtgcaccccgtgttcgagatgggggctcccaggcgctgcgccaccgaggcggccaaggcggcggcggcggcgaaccgcgacgtggtcgacgtcttcgtcagccgccacagccccgccgtcggggtggcctagacgacgtgcgtacaacgacgacgcgcttcgattaatattcgcgcgacttggagctatctgatggtcatgagcagggacggcgagtggtttaagtatactaattaccagtaattaactgctcatgatggaaaactaggtaatggagaagagagatgcacatgagagccacggagatggtgggaagatttatatgtatacatgtatatgcatggggtgtgtgtagtgttcgtcctgtgctgtgctgctattgttgtgtttattttccgtcgacgatctattatttctttgtacatgtaacgtgaatactattgacacct

SEQ ID NO: 13273 - protein, 303 aa, Panicum virgatum
  misc_feature: Ceres CLONE 1769100
  misc_feature (133)..(219): Pfam Name: MtN3_slv Pfam Description: MtN3/saliva family
  misc_feature (12)..(99): Pfam Name: MtN3_slv Pfam Description: MtN3/saliva family
MAGLSLQHPWAFAFGLLGNVISFTTFLAPIPTFYRIYKSKSTEGFQSVPYVVALFSAMLWIFYALIKSNEFLLITINAAGIVIESIYVVMYFVYADKKAKWFTAKIMLGLNVGFFGAILLVTLLLFKGDKRIVTLGWICVAFSVSVFVAPLSIIKRVIQTRSVEYMPFSLSLSLTLSAVVWFLYGLLIKDKYVALPNVLGFSFGVVQMILYVVYMNKTPVVAEGMDAAGGKLPTAAAAADEHVLVNIAKLSPAIPEKSSEVHPVFEMGAPRRCATEAAKAAAAANRDVVDVFVSRHSPAVGVA

SEQ ID NO: 13274 - DNA, 1619 bp, Panicum virgatum
  misc_feature: Ceres CLONE 1769102
  misc_feature: Encodes the peptide sequence at SEQ ID NO. 13275
ctggcggcgacggctgggcgtgaggcaccgcccttcgccaggtcttcgccgggccggtcgccggcaacgagcacccaccagcggcgacgatcccttgggcagttcttcctccggcgcttcgccgacgacgagcatccgagagagagtggggtcttgtgaccccagaagacccaaatcagatagtcgccgtcaagaatggaatctgggagtgggttctatgcaggcgaaggtctctccatcgatcctaagtggcttatcgacccgaagcttctctttgttgggccacgcattggcgagggcggacatgcaaaggtctatgaggagaagtataagaaccaaaatgttgccatcaagattgtgcacaaaggggacactcctgaggagatgaccaagagggaggggagattcttgagagaggtgtccatgctgtcaagggtgcagcacaagaatctcgtcaagtttatcggggcctgcctagaacctgtcatggtggtggtgactgagcttctggtggggggctcgttgcggaagtacttggtcaatctcaggcctaggagccttgagcctcgtgtagcagtggggtttgcattggacattgcccgagctatggaatgcttgcatgcacatgggatcattcatcgtgatcttaaacctgagaatttggtgctgactgcagaccagagaacagtcaaacttgttgatcttggtttggctagagaagagacgttaacagagatgatgactgctgagaccggaacataccgttggatggcccctgagttgtacagcacagttacgttgaggcatggagaaaagaagcattacaaccacaaagttgatgtttacagctttgcaattgtgctgtgggaactccttcacaataagctgcccttcgagggcatgtctaatctacaagctgcgtatgctgctgctttcaagaatatcagaccaagtgcagataacttgcctgaggagttgtcagaaatactaacatcctgctggaaggaagacccgaacgacagacctaacttcacgcagatagtgcaaatgctcctacattacctatccaccctttcaccacaagaaaacttggcccctcgccgcacattcagttcggagaacacaatcctgcctccggaatctcctgggacaagctcactgatggcttcccggggcgacctcggcgacacaccaaaggggaagagggaagacaagccaaggggcttctttttctgcttcagcgagtgctattagcacaaccatccaaacggagctcaagaagctgcaaatactaaaagaaagcatcacccccctgatgcgctgcgactcgttcacagccggtcgatcgagtctcggcgcacccatagtccatatcccccaagaacagcggaagtcatagtcgaactgttgtttctgctaatcgggtctcctgcatcgctgacgtgttgacatatcagcagggtaaatcgagtaaccttttgactccagatagtaatgatggaaatagcttatcccctgtattttccgtgaaccatggtgccatggagttactgccgcgcgcctagattggccgtctcgcgcgccatctcgtatagaaataaaccaataattcgcattgc

SEQ ID NO: 13275 - protein, 352 aa, Panicum virgatum
  misc_feature: Ceres CLONE 1769102
  misc_feature (26)..(286): Pfam Name: Pkinase Pfam Description: Protein kinase domain
  misc_feature: SWISSPROT Homolog: EC 2.7.11.1 Non-specific serine/threonine protein kinase
MESGSGFYAGEGLSIDPKWLIDPKLLFVGPRIGEGGHAKVYEEKYKNQNVAIKIVHKGDTPEEMTKREGRFLREVSMLSRVQHKNLVKFIGACLEPVMVVVTELLVGGSLRKYLVNLRPRSLEPRVAVGFALDIARAMECLHAHGIIHRDLKPENLVLTADQRTVKLVDLGLAREETLTEMMTAETGTYRWMAPELYSTVTLRHGEKKHYNHKVDVYSFAIVLWELLHNKLPFEGMSNLQAAYAAAFKNIRPSADNLPEELSEILTSCWKEDPNDRPNFTQIVQMLLHYLSTLSPQENLAPRRTFSSENTILPPESPGTSSLMASRGDLGDTPKGKREDKPRGFFFCFSECY

SEQ ID NO: 13276 - DNA, 814 bp, Panicum virgatum
  misc_feature: Ceres CLONE 1769118
  misc_feature: Encodes the peptide sequence at SEQ ID NO. 13277
ccatcttcctcctgcccccgccccgccttaacaccgcactgcagagaggctctccgccggtcgagcgcgcctcgatccagatccaggtaggagatggctctcacgagaattggtctcgctggcctcgcggtcatggggcaaaaccttgccctcaatattgcggagaaagggttccccatctctgtctacaacaggacaacctccaaggttgatgagacagtgcagcgcgccaagctggaaggaaacctccctgtgtatggtttccatgaccctgcatccttcgtgagctccattcagaagcctcgtgtcgtcatcatgcttgtttttgttggggcgccggtcgaccagaccattgccacccttgcggcacacctggagcagggcgattgtatcattgatggaggaaatgagtggtatgagaacacggagaggagggagaaggcaatggaggagcgtggactcctataccttggcatgggtgtctccggaggagaggagggtgcccgcaatggcccgtcattgatgcctggaggctctcttgaggcgtacaagtacatcgaagatattcttctgaaggtggctgcccaggtcccggacagcggcccatgtgtcacatatattggcaaaggtggatcaggcaactttgtcaagatggttcacaatggaattgaatacggtgacatgcaactgattgctgaggcatatgacgttctcaagtccgtgggtaagctcacaaacagtgaactgcagcaggtgttctctgaatggaacaagggtgagctcctcagtttcttgattgagatcaccgcagata

SEQ ID NO: 13277 - protein, 240 aa, Panicum virgatum
  misc_feature: Ceres CLONE 1769118
  misc_feature (3)..(178): Pfam Name: NAD_binding_2 Pfam Description: NAD binding domain of 6-phosphogluconate dehydrogenase
  misc_feature (182)..(240): Pfam Name: 6PGD Pfam Description: 6-phosphogluconate dehydrogenase, C-terminal domain
  misc_feature: SWISSPROT Homolog: EC 1.1.1.44 Phosphogluconate dehydrogenase (decarboxylating)
MALTRIGLAGLAVMGQNLALNIAEKGFPISVYNRTTSKVDETVQRAKLEGNLPVYGFHDPASFVSSIQKPRVVIMLVFVGAPVDQTIATLAAHLEQGDCIIDGGNEWYENTERREKAMEERGLLYLGMGVSGGEEGARNGPSLMPGGSLEAYKYIEDILLKVAAQVPDSGPCVTYIGKGGSGNFVKMVHNGIEYGDMQLIAEAYDVLKSVGKLTNSELQQVFSEWNKGELLSFLIEITAD

SEQ ID NO: 13278 - DNA, 2062 bp, Panicum virgatum
  misc_feature: Ceres CLONE 1769120
  misc_feature: Encodes the peptide sequence at SEQ ID NO. 13279
aaatcatctccacctccaccccctcggccccttctcgtggccgtctaccaccattgcttcctcctccacctccacgactgccacgctacccaatcgtcgcttccctttcttgatctctcgctgtctttgcatgagctgctgaaagcgtgtggcctttccacgattggtgcgcgaacgcccgtccccgtgtcggttcgtggagagtttcgtcggcgcccatggagaagctgcgccgccggcggcggcggcggcggcgggtggcgggtgtcctgctggtgatggcgctgatctccgtgctccctgatctcggcagctgcaacgatgccggacgaggaactctgaacccagaggaaggtatccgctccgactccgaagcctggataatccatggcgaccgtacacggaaaattctgcaggagcagcagaacaagtactggtccggatatttcggcaacaaggcggcatggccggatttcaccaacaataatcctccggccggccgaggcggttttcagggcccgccgtcgacgttcacgccgcagtatccgcagtggccaccgtggccgtggacaccgaaggttacgccgccgatgagctttcccccatcgcctgctccggcaccttccaagcctttgccgcagcccgcgcatgatggaaatccttcacacagcattgcactgcccccacagctggccggcaccggtagtaggccggtgattgccggagttgtgcctggagcggggcactctggtcatgttagcaggcctgcctatgtcatcgccgcggcgggggcctccctcctcgcggccgtgtcggtggcgctcttcgtcctgtgctaccggtccagcaaggtggtcaccgtcaggccgtgggcgaccggcctcagcgggcagctacagaaagcattcgtcacaggtgtgccatcgctgaagagatcggagcttgagctcgcctgcgaggagttcagtaacatcatcggctccttgtcggattacatggtgtacaaggggacgctgtcaagcggcgtcgagatcgcggtggtgtcgacgaccaagaactctgccaaagaatggtccaagcaccgcgaaacacagttcaggaagaagataacaagcttgtccagagtcaaccacaagaacttcgtgaacctgctgggctactgccaggaagaacagcccttcaccaggatgatggtgttcgagtacgctccgaacggcacactcttcaagcacctccacgtccgagaagacggccacctggactggccgacgcgcctgcgggtggctgtgggcatcgcctactgcctggagcacatgcaccagctgagcccgccggagatcctgcgcacgctggacacgtccaccgtctgcctgaccgacgacttcgccgccaagatctccgacgtcttcttctgcgacgagccccgggaccgggaggaagcgagcctgccgtccctgtcccaggcgctggtggacagggagagcgtggtgtacagctacgggatggtgctgctggagaccatgaccggccggttcacggcgtcgggcggcggcctgctggagggctgggcggcggggtacctgagaggggagcggcagcttagggacgtgatggaccccgcgctgcggaggtccttccacgccgccaccgtcgaccggctggacggcgtcatcaggggctgcaccgaccgcgagcccaggcggcggctgaccatgccggaggtcgccaggcggctgagggagatcaccgccatgccgcccgacgcggccacccccaaggtgtcgccgctgtagtgggcggagctggagatcatctccacggaggtcaactgaaactgagcatgggaataggaatgttttcaaggatttcatccaggtcgtttaaaatcctgaaattcccagagcagaatcccgttcaaatgcacctgaaactgtcgtttagttgagaatacaggttgattttgtatttctttttccgttttctggtattcatttgtcctgtaaagtttctgtccattgtgtacatacgaacaatagaagctactgcagcgtgtggccggagc

SEQ ID NO: 13279 - protein, 524 aa, Panicum virgatum
  misc_feature: Ceres CLONE 1769120
  misc_feature (248)..(506): Pfam Name: Pkinase_Tyr Pfam Description: Protein tyrosine kinase
  misc_feature: SWISSPROT Homolog: EC 2.7.11.1 Non-specific serine/threonine protein kinase
MEKLRRRRRRRRRVAGVLLVMALISVLPDLGSCNDAGRGTLNPEEGIRSDSEAWIIHGDRTRKILQEQQNKYWSGYFGNKAAWPDFTNNNPPAGRGGFQGPPSTFTPQYPQWPPWPWTPKVTPPMSFPPSPAPAPSKPLPQPAHDGNPSHSIALPPQLAGTGSRPVIAGVVPGAGHSGHVSRPAYVIAAAGASLLAAVSVALFVLCYRSSKVVTVRPWATGLSGQLQKAFVTGVPSLKRSELELACEEFSNIIGSLSDYMVYKGTLSSGVEIAVVSTTKNSAKEWSKHRETQFRKKITSLSRVNHKNFVNLLGYCQEEQPFTRMMVFEYAPNGTLFKHLHVREDGHLDWPTRLRVAVGIAYCLEHMHQLSPPEILRTLDTSTVCLTDDFAAKISDVFFCDEPRDREEASLPSLSQALVDRESVVYSYGMVLLETMTGRFTASGGGLLEGWAAGYLRGERQLRDVMDPALRRSFHAATVDRLDGVIRGCTDREPRRRLTMPEVARRLREITAMPPDAATPKVSPL

SEQ ID NO: 13280 - DNA, 1696 bp, Panicum virgatum
  misc_feature: Ceres CLONE 1769136
  misc_feature: Encodes the peptide sequence at SEQ ID NO. 13281
aaaaactccccaagcaattccatttctaccaccactcttctcgcagcgcgcaccaacccgccgccgcctactaccactccgcctcctcatggcctcccccacggccggcgacgcccccctcgcggcgcccgcgccggcggccgacgcgacggacgcggccctcgccgccgcggccgcggtaccggatccggacgcggagttcgggttccagcgcccggaggtcgggaaggagaagctggccgggacggtggggttccacgagcgccacgtgttcctctgttacaagggcccggaggtgtggccgtcccacctcgaggccaccgagtccgaccgcctcccccgcctcctcgccgccgcaatcaaggcccgcaaacccaacctgaagaagaccaccaaattgaccatctgtgaaggagaagatggcactgcgtcatctaatggagatgtgttgatctttccagatatgatcagatacaaaggtctgactcattttgacgtcgacaactttgttgaagaagtacttgtgaaggatgctgagtggcttcctagatctcctgaggctatcagcgagtcctatgtctttgtttgctgccatggaagcagggacaaaaggtgtggtgtttgtggacctgctttgattaaaaggttcaaggaagagataagtgggttgggacttgacggtcaggtggctgtcagtgcatgctcacacgtgggaggtcacaagtatgcagggaatgtcatcattttcaggtctgatggcaagggagaagtgagtggccattggtatggctatgttgttcctgatgatgtgcctgtcttgttgcataaacatattggacaaggagaaattgtggaccacctgtggagggggcagatgggtttatctgagaagcagcagaagcaagctcttgagcttaggaacatgacaaatggtgccaaagaatcccttaaagaaactggaacagatggtgcttcttgcaaccctgcagcagctggtggatgctgccagggcaatggtggcttcacttgctgccaaactgacctaccaaaggaaaaacaggacaagagcgttgcagctgagctgaaccagaagggctctcagcaggagaatgacaaggagagcgacaccagcagcaagaaggggcacatgaagacatgctcgatgcccacctggttagagacctgggagagggctgacacctatgccgctcttgctgttgttgcagcggctgcctcggtgtttgtcgctttcagaatctacaagaacctcaactgaacttgagatccttgaagaagtacccgaaacaagtctactgcagtaaaacagtcagtgaggtttcataaaaaaaaagtcagtgatgagaataatatacttgtgcatagtagtgcgagggttagaaccttaaagtagcttatctggagatggtgatgaaaaggtgctgcgcctactgtttcttttgctaaactccatgtgaaactccactgcgaccaaagtttcgattgccttagatgctgtctatcttaagctatattttgtttggattttggatgttctggagcatatgggttgctaaaactatttgccaggttgattggcatattgttcatcttaagcaggagttaacgcttttcttactatgcataggcgtcaggagcttcctctatgtgcgatttttttgtgcatgagatatgtttc

SEQ ID NO: 13281 - protein, 395 aa, Panicum virgatum
  misc_feature: Ceres CLONE 1769136
  misc_feature (49)..(263): Pfam Name: Suc_Fer-like Pfam Description: Sucrase/ferredoxin-like
MASPTAGDAPLAAPAPAADATDAALAAAAAVPDPDAEFGFQRPEVGKEKLAGTVGFHERHVFLCYKGPEVWPSHLEATESDRLPRLLAAAIKARKPNLKKTTKLTICEGEDGTASSNGDVLIFPDMIRYKGLTHFDVDNFVEEVLVKDAEWLPRSPEAISESYVFVCCHGSRDKRCGVCGPALIKRFKEEISGLGLDGQVAVSACSHVGGHKYAGNVIIFRSDGKGEVSGHWYGYVVPDDVPVLLHKHIGQGEIVDHLWRGQMGLSEKQQKQALELRNMTNGAKESLKETGTDGASCNPAAAGGCCQGNGGFTCCQTDLPKEKQDKSVAAELNQKGSQQENDKESDTSSKKGHMKTCSMPTWLETWERADTYAALAVVAAAASVFVAFRIYKNLN

SEQ ID NO: 13282 - DNA, 740 bp, Panicum virgatum
  misc_feature: Ceres CLONE 1769154
  misc_feature: Encodes the peptide sequence at SEQ ID NO. 13283
  misc_feature (140)..(140): n is a, c, t, g, unknown, or other
acggcagcgacagaagagggcgaggaagccgcacgaccacgagcagcggaacgagaacgccaagaaggcgcagcacgcggggcgcggggagccccacccccgcgcccccgagcaccagaaggagggcaagaagaccagcnccaccaacggcggcaacccgcacgcccacggacagaagccgcccacccgcccccgccagggggcggcaccccgccaggcttttttcctgctcgatgatcccaacgtcggcctcttgttcccggcggatgccatcgcgcgggccaagcactacctctccctggcgcccggcggtttaggtgcttacagcgattcccgtggtatccctggaattaggaaggaggttgctgacttcatccagaggcgtgatggatatccgagtgatccagaactcatttacttgacagatggtgctagcaaaggtgtgatgcagatgctgaacgccattatcagaaacgagagaaatgggattttggtccctgttcctcaatacccactttattctgctgccatttccctctttggtggctccctggtcccatactacttggaagaagaggctaactggggccttgactttgtcaatatccgacaaacagtggcggaggcacggtcaaagggaatcactgttcgagcaatggtgattatcaatccgggaaatcccactggacaatgccttagtgaagcaaatataaaggaacttcctgcattttgctaccatg

SEQ ID NO: 13283 - protein, 246 aa, Panicum virgatum
  misc_feature: Ceres CLONE 1769154
  misc_feature: SWISSPROT Homolog: EC 2.6.1.2 Alanine transaminase
  misc_feature: Useful for making plants with modulated nitrogen use efficiency
  misc_feature (47)..(47): Xaa is any aa, unknown, or other
RQRQKRARKPHDHEQRNENAKKAQHAGRGEPHPRAPEHQKEGKKTSXTNGGNPHAHGQKPPTRPRQGAAPRQAFFLLDDPNVGLLFPADAIARAKHYLSLAPGGLGAYSDSRGIPGIRKEVADFIQRRDGYPSDPELIYLTDGASKGVMQMLNAIIRNERNGILVPVPQYPLYSAAISLFGGSLVPYYLEEEANWGLDFVNIRQTVAEARSKGITVRAMVIINPGNPTGQCLSEANIKELPAFCYH

SEQ ID NO: 13284 - DNA, 663 bp, Panicum virgatum
  misc_feature: Ceres CLONE 1769155-R
  misc_feature: Encodes the peptide sequence at SEQ ID NO. 13285
atcgagcggtgcctctcgacggtggaccggaagcaccagccgtggctcgtcttcgcggcgcaccgcgtgctgggctactcctccaacgactggtacgccatggagggctccttcgaggagcccgagggccgcgagagcctgcagaagctctggcagaagtaccgcgtcgacatcgccttcttcggccacgtccacaactacgagaggacctgccccgtctaccagagccggtgcatgaccagcgagaagagccactactcggggacgatgaacgggaccatcttcgtggtggccggcggcggcggcagccacctgtcggactacacgacggcgatccccaggtggagcatcttccgcgaccgggacttcgggttcgtgaagctcacggcgttcaaccactcgtcgctgctgttcgagtacaagaggagcagcgacggcagggtgtacgactccttcaccgtcgacagggactaccgggacgtgctcagctgcgtgcacgacagctgcttcccgaccacgctggccacctgacctgacaaccgtacgtcgccgtgctgggtgccgcgagtagtagggtggtgatgtcttggtcttgtagctgagcacgatcaggaacgtgtgttgtgtaacgagtgattcgattggctgtgtctctttcatccc

SEQ ID NO: 13285 - protein, 176 aa, Panicum virgatum
  misc_feature: Ceres CLONE 1769155-R
  misc_feature: SWISSPROT Homolog: EC 3.1.3.2 Acid phosphatase
IERCLSTVDRKHQPWLVFAAHRVLGYSSNDWYAMEGSFEEPEGRESLQKLWQKYRVDIAFFGHVHNYERTCPVYQSRCMTSEKSHYSGTMNGTIFVVAGGGGSHLSDYTTAIPRWSIFRDRDFGFVKLTAFNHSSLLFEYKRSSDGRVYDSFTVDRDYRDVLSCVHDSCFPTTLAT

SEQ ID NO: 13286 - DNA, 851 bp, Panicum virgatum
  misc_feature: Ceres CLONE 1769155
agtttagcagcggcgaccagcaaagcagcaacacctagtgccgagctagctagctgcttcccatggggaggagagacgccgcggcggctctggcggtggtgctggctgccgttgcggcggcggcgatgatgagcacgtcgtcgccggcggaagggttccagccgctgtccaagatcgccgtccacaggaccaccgtcgagatgcagccgtcggcgtacgtgcgggcgacgccatcgctgctcggcgggcagggaggagacaccgaatgggtgacggtgaagtacggctggacaagcccgtccgtcgatgactggatcgccgttttctctccagctgatttcatctcgggcacgtgccctaaccctgcgagagacccaccgcacctctgcacggctcctatcaagtatcagtatgccaattactcggcgaactacatctattggggcaagggcagcgtccggttccagctcatcaaccaacgctacaacttttccttcgccctcttcaccggcggtctcgagaacccgaagctgatcgcggtgtcggagccgatctcgttcaagaaccccaaggcgcccgtgttcccgcgcctcgcgcagggcaagacccacgacgagatggctgtgacatggaccagcggctacgacatcagcgaggcgtacccgttcgtggagtggggcgcggtcggcggcggccagcccgccgcgcggtcgcccgccgggacgctcaccttcagccgcggcagcatgtgcggcgagccggcgcgcaccgtcgggtggagggagcccggcttcatccacaccgcgttcatgaggaatctctggcccaacaaggagtgagcacactgctct

SEQ ID NO: 13287 - DNA, 867 bp, Panicum virgatum
  misc_feature: Ceres CLONE 1769157
  misc_feature: Encodes the peptide sequence at SEQ ID NO. 13288
cccgtgccacacatccgtccgcttcttctcccctcctgccggtcccgaataaagagcagcagcgcaagaggttggtggagtaatttaccccagaacaattaggcagcagcaatggcggcggagagcttcctcttcacctccgagtccgtgaacgaggggcaccccgacaagctgtgcgaccaggtgtcggacgccgtcctggacgcgtgcctggcgcaggaccccgacagcaaggtggcctgcgagacctgcaccaagacaaacatggtgatggtgttcggcgagatcaccaccaaggccaccgtcgactacgagaagatcgtgcgcgacacctgccgcgagatcggcttcacctccgacgacgtgggcctcgacgccgaccgctgcaaggtgctcgtcaacatcgaacagcagtcccccgacatcgcgcagggcgtgcacggccacttcaccaagcgccccgaggagatcggcgccggcgaccagggccacatgttcggctacgccaccgacgagacccccgagctgatgccgctcagccacgtgctcgccaccaagctcggcgcgcgcctcaccgaggtccgcaagaacggcacctgcgcctggctcaggcccgacggcaagacccaggtcaccgtcgagtacctcaacgagggcggcgccatggtccccgtccgcgtccacaccgtcctcatctccacccagcacgacgagaccgtcaccaacgacgagatcgccgccgacctcaaggagcacgtcatcaagcccgtcatcccggagaagtacctcgacgagaagaccatcttccacctcaacccgtcgggccgcttcgtcatcggaggcccccacggcgacgcggggctcacc

SEQ ID NO: 13288 - protein, 251 aa, Panicum virgatum
  misc_feature: Ceres CLONE 1769157
  misc_feature (118)..(240): Pfam Name: S-AdoMet_synt_M Pfam Description: S-adenosylmethionine synthetase, central domain
  misc_feature (4)..(103): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
MAAESFLFTSESVNEGHPDKLCDQVSDAVLDACLAQDPDSKVACETCTKTNMVMVFGEITTKATVDYEKIVRDTCREIGFTSDDVGLDADRCKVLVNIEQQSPDIAQGVHGHFTKRPEEIGAGDQGHMFGYATDETPELMPLSHVLATKLGARLTEVRKNGTCAWLRPDGKTQVTVEYLNEGGAMVPVRVHTVLISTQHDETVTNDEIAADLKEHVIKPVIPEKYLDEKTIFHLNPSGRFVIGGPHGDAGL

SEQ ID NO: 13289 - DNA, 671 bp, Panicum virgatum
  misc_feature: Ceres CLONE 1769157-R
  misc_feature: Encodes the peptide sequence at SEQ ID NO. 13290
cgcccgccgctgcctcgtgcaggtgtcctacgccatcggcgtgcccgagcccctgtcggtgttcgtcgactcgtacggcaccggcacgatccccgacaaggagattctcaagatcgtcaaggagaacttcgacttcaggcccgggatgatcaccatcaacctcgacctcaagaagggcggcaacaggttcatcaagaccgccgcctatggccacttcgggcgtgacgacgccgacttcacctgggaggtggtgaagcccctcaagttcgaaaaggcatcagcttagagatcgaagaggacgttgagtgtcttgtctccgtgctatcatctactacctcttgctgctgatgttacctgcaagcattgctgctgctgctgctcctgctcctggatgtgtgtctgatcagtgactggctgcttccttagaagatgatgcagagaagatgaacaagaaggcttcggcaatcgccgcagcaagccatgtcgccggtggcggcttagtgattgggtaaaatttggtgtggcagccaggattacgcgctgatcttaccttgactagtttggtcgtccggtatcttttttttcgtcctttctccccgccctttttcgggtcgtactgaaactgctgagagatttgcagttttgatctatcataattcgtatgttactgc

SEQ ID NO: 13290 - protein, 94 aa, Panicum virgatum
  misc_feature: Ceres CLONE 1769157-R
  misc_feature (1)..(83): Pfam Name: S-AdoMet_synt_C Pfam Description: S-adenosylmethionine synthetase, C-terminal domain
  misc_feature: SWISSPROT Homolog: EC 2.5.1.6 Methionine adenosyltransferase
  misc_feature: Useful for making plants with modulated biomass
ARRCLVQVSYAIGVPEPLSVFVDSYGTGTIPDKEILKIVKENFDFRPGMITINLDLKKGGNRFIKTAAYGHFGRDDADFTWEVVKPLKFEKASA

SEQ ID NO: 13291 - DNA, 2256 bp, Panicum virgatum
  misc_feature: Ceres CLONE 1769164
  misc_feature: Encodes the peptide sequence at SEQ ID NO. 13292
cacttcaccgcttcccctttctcgttcacctcctccgggaaggcctcggcgactcgctcgccgtgtccctcatcgaggcgcagtttgagccactccttttgctgccactgtaactcggccgggcggagctcagatctgatccaaaataatctgcatccaggtgcagccactcctcgtcggccatggatttcatgaaggttttcgatcagactgtgcgtgagatcaagagggaggtcaatttgaaggtgctcaaggtccccgagattgagcagaaggtacttgatgcgacaagtgatgaaccatggggcccccatggaagtgcgctttcggagcttgcacacgctaccaagaagttctctgaatgccagatggtaatgaatgtcttatggactagacttggtgagagaggcgcaaattggcgtcatgtgtataaggccttgacaattatcaagtacttgatagccaacggttctgagagggcagttgatgatattcttgatcattattctaagatctcggttctttcaagcttcgagtatgtggagcctaatggaaaagatgtagggataaatgtgaggaagaaagtagaaactattgttggcatcttaaatgacaaggagagaataaaggctgtgagagacaaggcggccagcaaccgtgacaagtacattggactatcatcgacagggataacatataaatcaagctcagcctcatttggtagtaactacagttcaggcgaacgttatggcagtttcagtggcacaagggatgccgactcatttggtgacagttacagggacaaagaacctgttaaaacctccacaagtaaaactggcagccagaaatctggcagtaagttgagaaaggatacaaagtctgatagaaggaatgaggattacagttcacccagctccttgaagcccccatctaatacgaacaacagcgaggatgattttgatgactttgatccccgcggatcaaatggcaaagctgctgctaaatcaactgaggtggatctgtttggcccaaacttgatggacgatttcattgatgcatctgcagcagctccagcaacagacagtgtcgtcgaaccacaggttgatctgtttgctgatgcagatttccagtcagcaaccacaagtacagaagcaactgcaaatatggatgtccagggcaatgttgacctgtttgcggaaaagacatcttttgctgcagcattcccgccacagactgggtttattccaccaccaagttcaggggtatcttccgaagtaaatacttccatatccaagaacgcggctcctgaaccttttgatccttttggtgctattccattgaacagttttgatggatctgacccatttggtggcttcagctcaaatactggttcatctgccataccaccacccacacacagttctaatggaaatatcagtacatcaggccagaaccttcaggctgcatccgactttggtgcctttgtatcaaacaatgaagaagctgctaaagatccatttgatctttcttcaactgtcaatgtcagaaaaacgcctttggcagctcccaaaaccgacgtatgtgattttggtgcatttgtatctagcaacgaggaagcagctaaggacccttttgatctttcttcgaatagcaaccttggaaggacagaccaaacacctttggcagctcccagtcctagcgcaaaaaaagaaaattttcaggtgaagtctggcatatgggcagactccttgagccgaggattgattgatctgaacattactgcaccgaagaaggtgaacctagccgacattggcatcgtcggtggccttagtgatgggtccgatgagaaggccatgccctcttggaccatgggcacgacatctggcctaggaatgggtatcccgccatctacacaagccggtggcatcgagagcttagcaaactacaacaagcatcaatttggcttcaagtgagccttgagctctcgtacaggaagatctctatcatccgcagtttcctcctctgccggcctgcccccccttcaatatatggctattgatttaatttccttttgtttgttctttggtgacttcgccacactacattttgtaccaaccaatcttgccccgttttgtcacgcttgtatgtggtatctaccgtgtttgcgggtatgatatttattgtgtttacgggtaagcatcccaactccccgaccacagcctgtttgagttaaaatgatacgtccggttgctatgc

SEQ ID NO: 13292 - protein, 596 aa, Panicum virgatum
  misc_feature: Ceres CLONE 1769164
  misc_feature (25)..(148): Pfam Name: ENTH Pfam Description: ENTH domain
MDFMKVFDQTVREIKREVNLKVLKVPEIEQKVLDATSDEPWGPHGSALSELAHATKKFSECQMVMNVLWTRLGERGANWRHVYKALTIIKYLIANGSERAVDDILDHYSKISVLSSFEYVEPNGKDVGINVRKKVETIVGILNDKERIKAVRDKAASNRDKYIGLSSTGITYKSSSASFGSNYSSGERYGSFSGTRDADSFGDSYRDKEPVKTSTSKTGSQKSGSKLRKDTKSDRRNEDYSSPSSLKPPSNTNNSEDDFDDFDPRGSNGKAAAKSTEVDLFGPNLMDDFIDASAAAPATDSVVEPQVDLFADADFQSATTSTEATANMDVQGNVDLFAEKTSFAAAFPPQTGFIPPPSSGVSSEVNTSISKNAAPEPFDPFGAIPLNSFDGSDPFGGFSSNTGSSAIPPPTHSSNGNISTSGQNLQAASDFGAFVSNNEEAAKDPFDLSSTVNVRKTPLAAPKTDVCDFGAFVSSNEEAAKDPFDLSSNSNLGRTDQTPLAAPSPSAKKENFQVKSGIWADSLSRGLIDLNITAPKKVNLADIGIVGGLSDGSDEKAMPSWTMGTTSGLGMGIPPSTQAGGIESLANYNKHQFGFK

SEQ ID NO: 13293 - DNA, 840 bp, Panicum virgatum
  misc_feature: Ceres CLONE 1769166
  misc_feature: Encodes the peptide sequence at SEQ ID NO. 13294
caagtgttttacagcttaaagctcccctttagatatttggtgatctgcacggtcaatttggtgacctcatgcgcttatttgatgagtatggtgctccttcaacagctggagacattgcctacattgattatctcttcttgggagattatgtggatcgtggtcagcatagtctggagacaatcactcttcttcttgcactgaaggttgaatatcctcataatgtacatttaattcgagggaatcatgaggcagcagatatcaatgctctgtttgggttccgaatagagtgcatagagcgaatgggtgagcgggatggaatctttttctggcatcgtgtaaacaggttatttaattagctccctttggctgcactaatagaaaagaaaataatttgtatgcatggtggtattggtcggtccatcaaccatgtcgagcaaattgagaatcttcaaaggccaattacaatggaagcaggctcagttgttctgatggatcttctatggtctgacccaactgagaatgacagcgtagaaggactcagaccaaatgcacggggccctggtcttgttacctttgggcctgatagagttatggagttctgcaacaacaatgacctgcagttgattgtacgagcacatgagtgtgtgatggatggctttgagcgtttcgctcaaggtcacctgatcactcttttctcagcaacaaattactgtggtacggcgaacaatgcaggtgcaatcttagttcttggaagggatctggtggttgttccaaaactcatccatcctttgccgcctgccattacgtcacccgagacctctccggagcatcatattgagg

SEQ ID NO: 13294 - protein, 95 aa, Panicum virgatum
  misc_feature: Ceres CLONE 1769166
  misc_feature: SWISSPROT Homolog: EC 3.1.3.16 Phosphoprotein phosphatase
MRLFDEYGAPSTAGDIAYIDYLFLGDYVDRGQHSLETITLLLALKVEYPHNVHLIRGNHEAADINALFGFRIECIERMGERDGIFFWHRVNRLFN

SEQ ID NO: 13295 - DNA, 839 bp, Panicum virgatum
  misc_feature: Ceres CLONE 1769169
  misc_feature: Encodes the peptide sequence at SEQ ID NO. 13296
aagcgaaagctcaagcaatcgaacaacagtcgcctaatccacactcaaatcaagcaccaaacagcctccagatcccccgatagaggtcacccaccgcagcctctgcagcgagatggctcccgagattgccggcaagatgaccgctaaggccgccgccgccgccgccgcggtgaagcccgcgaccagggcgtacgtgacgttcctggcgggtgacggcgactactggaagggcgtggtgggtctggccaagggcctgcgcaaggtcggctcggcgtacccgctggtggtcgccgtgctgcccgacgtgccggaggcccaccgccggatcctcgtctcgcagggctgcatcgtccgcgagatcgagcccgtgtacccgccggagaaccagacgcagttcgccatggcctactacgtcatcaactactccaagctccgcatctgggagttcgtggagtacgagcggatggtgtacctggacgcggacatccaggtgttcgataacatcgacgagctgttcgagctcgagaagggccacttctacgcggtgatggactgcttctgcgagaagacgtggagccacaccccgcagtacaagatcggctactgccagcagtgccccgacaaggtcgcgtggcccaccgccgagctcggccccccgccggcgctctacttcaacgccggcatgttcgtgcacgagcccagcatggccaccgccaaggccctgctcgagacgctccgcgtgaccccacccacccccttcgcggagcaggtgagtgagcgatcgatagatgcgtggcgcacccgtgcccaggctcttgaattgtttgtcgatagctagc

SEQ ID NO: 13296 - protein, 241 aa, Panicum virgatum
  misc_feature: Ceres CLONE 1769169
  misc_feature (28)..(232): Pfam Name: Glyco_transf_8 Pfam Description: Glycosyl transferase family 8
  misc_feature: SWISSPROT Homolog: EC 2.4.1.186 Glycogenin glucosyltransferase
  misc_feature: Useful for making plants with altered carbohydrate content 220>
  misc_feature: Useful for making plants with altered cell wall content and/or composition
  misc_feature: Useful for making plants with modulated water use efficiency
MAPEIAGKMTAKAAAAAAAVKPATRAYVTFLAGDGDYWKGVVGLAKGLRKVGSAYPLVVAVLPDVPEAHRRILVSQGCIVREIEPVYPPENQTQFAMAYYVINYSKLRIWEFVEYERMVYLDADIQVFDNIDELFELEKGHFYAVMDCFCEKTWSHTPQYKIGYCQQCPDKVAWPTAELGPPPALYFNAGMFVHEPSMATAKALLETLRVTPPTPFAEQVSERSIDAWRTRAQALELFVDS

SEQ ID NO: 13297 - DNA, 691 bp, Panicum virgatum
  misc_feature: Ceres CLONE 1769170
  misc_feature: Encodes the peptide sequence at SEQ ID NO. 13298
actagtacaccggttagcggttatacgcagcaccaaccgccatggcctccctcgccgccgtctccgtgcagccggtcgccgtgaagggcctcgccggcagctccatctccggcaggaggctcgccgccgtcaggccgtcgcgccgcgccggggccggcgcctgcgcctgccgctccgcccgcaggccccgcggcgctgccgtggtggccaagtacggcgacaagagcgtctacttcgacctcgacgacatcggcaacaccaccgggcagtgggacctctacggctccgacgctccctcgccctacaacccgctccagagcaagttcttcgagacgttcgcggggccgttcaccaagaggggcctgctgctcaagttcctgctggtgggcggcgggtcgctgctggcctacgtcagcgcgtcggcgtcgccggacctgctgccgatcaagaaggggccgcagcagccgccgcagccggggccgcgcggcaagatctaagttcagttgttccttctcctcatccatctgtctctactagctgcttgcttgtaccgccgctagctccggacgccatggatcgtccttgcctgtcgttgtgctgctgatattcgatcgcgctgcctgtttatcaatgttcataatgttgtattcatatatactctggcatacaattacaatggtgttgcgtgctt

SEQ ID NO: 13298 - protein, 151 aa, Panicum virgatum; identical to SEQ ID NO: 12116
  misc_feature: Ceres CLONE 1769170
  misc_feature (5)..(151): Pfam Name: PSI_PsaH Pfam Description: Photosystem I reaction centre subunit VI

SEQ ID NO: 13299 - DNA, 1437 bp, Panicum virgatum
  misc_feature: Ceres CLONE 1769180
  misc_feature: Encodes the peptide sequence at SEQ ID NO. 13300
cgagcacctgtatcgttggctccgtctagggttttagcccctgccgccgccaacctcccggccctgcccccagccgccgcaacctcctcctccccctgtgaatcccgtgcccccgcaatccgtgccaccaccgtaccggaggccgagatggaccggtaccagagggtggagcggccgcggaccgagtcggcgaccatcgaggagaacgagatccgcatcacctcgcagggcctcatccgcaactatgtctcctacgccacctccctcctccaggagcggagaataaaagagattgttttgaaggccatgggacaggcaatcagtaagtctgttgctgttgcagagattatcaagaaaagaaacgctggtttgcatcaggataccaatatcagttctgtcagcattactgatgtctgggagcctatagaagaaggccttgtcgcgctggagatgactcgacatgtttcgatgatttcaattaccttgtctcctggagagctggataagaacacccctgggtaccaagctcctgcttatgtcgagcagcacaggcaaccgcagcgcctccagcaggcaccaccgccgcagcaccaacctcaccgagcgcaaggccaattccaacagtttgagtatgaagactcctatgcacggggtcgaggtagaggaaggggccgtggacgtggaaggggctggggtagaggaggctatggtggttatggtggatatggaaacaaccaaggtgggtacaatcagggtggcggttattatgataatcaaggtgggtatggcggctatgataatcaaggtgggtatggaggctatgataatcaaggtgggtatggtggtggatatggctacaaccatggaaggtatggaaactaccaagaaaatggtgggtatagccgaggacgaggtggtggtatgcgtagaagaggcaactggggttaccgtggaggctatgacggaggcagaggaggctatgagcaaggcaggggcggaggctatgaaagtggcaggggcggtggctatgatggaggcaggggtgggggtggaaggggctatggtggccgtggaaggggaagaatggggggccgcgggcgagggaactgagcgcaggcacaaacttcatgggcttctggtgtttcttcaatgcatgctttatataatcagtggaaaaaaggataagttatctgagctgtcggaagccatcagttatgtgtgaggtctctgttgttttccctgagggtgaggtttggttgtgagcataatgcatttgcaagtttaatcatgttgtcatctttcaatatttctgctgccgaggttgcttgttttcccaatggtctttaaattaaatgctgagcatgctgccctatgttcatgcctgctgtagcaacagatggaaactcttcccgtattaattgttcagtctatttttgc

SEQ ID NO: 13300 - protein, 320 aa, Panicum virgatum
  misc_feature: Ceres CLONE 1769180
  misc_feature (18)..(88): Pfam Name: Alba Pfam Description: Alba
  misc_feature: SWISSPROT Homolog: EC 3.1.26.5 Ribonuclease P
  misc_feature: Useful for making plants with altered lignin content
  misc_feature: Useful for making plants with altered terpenoid content
MDRYQRVERPRTESATIEENEIRITSQGLIRNYVSYATSLLQERRIKEIVLKAMGQAISKSVAVAEIIKKRNAGLHQDTNISSVSITDVWEPIEEGLVALEMTRHVSMISITLSPGELDKNTPGYQAPAYVEQHRQPQRLQQAPPPQHQPHRAQGQFQQFEYEDSYARGRGRGRGRGRGRGWGRGGYGGYGGYGNNQGGYNQGGGYYDNQGGYGGYDNQGGYGGYDNQGGYGGGYGYNHGRYGNYQENGGYSRGRGGGMRRRGNWGYRGGYDGGRGGYEQGRGGGYESGRGGGYDGGRGGGGRGYGGRGRGRMGGRGRGN

SEQ ID NO: 13301 - DNA, 1967 bp, Panicum virgatum
  misc_feature: Ceres CLONE 1769182
  misc_feature: Encodes the peptide sequence at SEQ ID NO. 13302
gaaccacccagaaagcctcgctccgctcgctcgccgcccgccgcgccatgagcgccgccgcgtgcctcctcgccgccgcctcctgcatcccccacccctctaccccctccacctccggccccgcctgcccaggcgcaggcgcgtcgggcacgcgctgccggcggaggcccgcccccctcctccgctgctccccagctcgccgccgtgggccggcccgggcactcgacgagcggctgctcgaggccgcggctgcggaggagagccatggggaggaggcaggtgttgatgtaggaggtgggttcttggacgcagagggcgatgaagtgggagagcaggcggtggtggtggaggagcagcggccgccggcgaaggcgttcgtgaagagcaggcggcagcggcaggaggaggaggaggaggccgccacggggcaagaccggttcaagctcatcaacggcaaagagatatttcaagagaaggcttatctggttggtgtcgagttcaaacggacaggagggaacctcttcggaatagaggagtctcttaaggagctggagcaactagctgatactgccgggctcgtggttgtcggctcgacctatcagaagctttctaccccaaacccaaggacttacattggttcaggcaaggtttctgaaatcaggagtgccattcatgcccttgacgttgagactgtaattttcgatgatgagttatcccctggacaactgcgtaacttggagaaatcatttggtgggagcgtccgtgtctgtgaccgaactgctcttattctggatatttttaatcaaagggcagcaacacatgaagctgctttacaggtcaccttggcacagatggaatatcaacttcctaggctgacgaagatgtggagtcaccttgaacggcaggctggaggtcaagttaagggtatgggagagaagcaaattgaagtggacaagcgcattttgagaactcaaataggtgcattgaggaaagaactggaatctgttcgaaaacaccgaaagctgtatcgcaaccgtcgccaatcagttcctattcctgttgtttctctggtagggtatacaaatgctggaaaaagtacactcctgaaccgcttaactggagctgatgtacttgcagaggacaagttatttgccacgttagacccaacaacaaggagggttttgatgaagaatgggactgagttccttctaactgatacggtcggattcattcagaagttacccactatgttggtagcagcatttagggcaacattggaggagatatcagaatcgtcagttatagttcatcttgttgacatcagccatccattagcccaacagcagatagatgctgttgacagagtattgaaggagttagatgtagagtcaatccgcaaattggtcgtgtggaacaagattgacaataccgatgaaccattcagagtaaaagaggaagcagagaaacaagggataatctgcatatcagcaatgaatggtgatggtctggaagaattctgcaacgccatccaagccaagctgaaagactcaatggtgccaatagaagcatttgtcccatatgacaaaggagatctacttaatgacatacatagggttggaatggttgagaaaatggaatacaaggaaaatgggacatttgtaaaagctcatgtgcctctacctctcgcaaggcttctcacacctctacggcagcaggtggtggctgccgtatgatgtgcatgtcattaagcagttcttgatgccaatggcactcacataattagctcatcttgtagattcgcaaaaagaatgcccttgttgtagaaaatttagtcatagattatctttactgtttctttttatcttcgtagggcatcaaacatcaacacatgtaattagagagctgtatatatccatgacagaattgtaaatattgtcagctgaattttactcttttcccattccgag

SEQ ID NO: 13302 - protein, 561 aa, Panicum virgatum
  misc_feature: Ceres CLONE 1769182
  misc_feature (337)..(459): Pfam Name: MMR_HSR1 Pfam Description: GTPase of unknown function
MSAAACLLAAASCIPHPSTPSTSGPACPGAGASGTRCRRRPAPLLRCSPARRRGPARALDERLLEAAAAEESHGEEAGVDVGGGFLDAEGDEVGEQAVVVEEQRPPAKAFVKSRRQRQEEEEEAATGQDRFKLINGKEIFQEKAYLVGVEFKRTGGNLFGIEESLKELEQLADTAGLVVVGSTYQKLSTPNPRTYIGSGKVSEIRSAIHALDVETVIFDDELSPGQLRNLEKSFGGSVRVCDRTALILDIFNQRAATHEAALQVTLAQMEYQLPRLTKMWSHLERQAGGQVKGMGEKQIEVDKRILRTQIGALRKELESVRKHRKLYRNRRQSVPIPVVSLVGYTNAGKSTLLNRLTGADVLAEDKLFATLDPTTRRVLMKNGTEFLLTDTVGFIQKLPTMLVAAFRATLEEISESSVIVHLVDISHPLAQQQIDAVDRVLKELDVESIRKLVVWNKIDNTDEPFRVKEEAEKQGIICISAMNGDGLEEFCNAIQAKLKDSMVPIEAFVPYDKGDLLNDIHRVGMVEKMEYKENGTFVKAHVPLPLARLLTPLRQQVVAAV

SEQ ID NO: 13303 - DNA, 2336 bp, Panicum virgatum
  misc_feature: Ceres CLONE 1769183
  misc_feature: Encodes the peptide sequence at SEQ ID NO. 13304
agagcgaagagatgggagaaattacgcgtcgcccagcacgcgccccccacccccacccgcgcgctcctccccctcccccctcccctccctcgctcgctcggctggctggctcctcacccgcgtcatccccccttcccgtcttccccctccacctcgtcacgccgcacgggcccggcccaaataccctcgccctcgcctcccacccctcgcgctctcgccacaaaccctaaccctagctccccaccggctcgccgccgccgccggtccgccgtcggcccgctctgtccgaggtcacgaagttggctagcgcaaaggtgagttcagctggagttcagcgcgtgtggcgatggaggggcgggggaaccctccgcttggcaccactgaagcagtgataaagaagccaagaagtgttgtatcaaggaagccgaggtccacagagcaactcgcttctgagtacaatggcatgtatgcgccatctcggtacattttccatgatgatgacaccggcattgaagccggcaggcatcggaggaaagagctatacctaaatagccctgagacgaagaactccatggctcataagaatgacgtgtccaggaagttaagaagggatgacagatctggaggagactatgatggccacagtcggagcagcaaatcaaaggatgctaccaagcatggtagtgatggtgttcttgcactggaatgtaccatgagaagctctggatcccccccggataacccacagttggtcccgagggatgcaagtgtgcctggtgagaataggttgagaaaagtaaagctcaaagttggcgggattactcgaaccatacatccaaaaaccgttccagaaccggatcctgccacgtcggatggctcctctcatcggcacaagcacaaggattctggtggggacacaagcaaagatactcatggtagtcgtgttgaaggaaaacatggcaataggcatgacatttcaccatcatctgaccttgttcgcaagagcaaaaggattcctaagaagaaagctcttgatggagattctgatgatgaagatggcgaattacgctatctggaaaaactcagaagggctaaagttgcaccagatcctatgaccactggccatggatcttatgatgattctgctgctgatggtctcaagaaaaagaatttgtccaaggtttctaaaaacaagagcacaccatatgaagtggatgaggactttacaatgtcacgatttggcaaggatggcaggaagaagtcgcaattaggggatggcaatgaatctatcgaagaggaggaatctgagattgatgaaaaggttgggtcaaaggaagttgattcgccttcagatgtgaagattgaaattcctggtcttactacaagacagcgagcccttcaaggcaggggtgggcatggagaaagtctgattgaatttcctgatggattaccagctgtttcatcaagaaagcaaaaggagaagctttcaggagtggagatacaagccaaaaaagcagaagctgcacagaggcgtaagatgcaagttgagaaggcagagaaggaacaacaggctgaagcaatgaggaagatattaggtatagattctgagaagaaaaaggaagagaagaagcttaaagaacaggaggagaaggaaaaacaagcaaggttagaagaatacaggaaaaactgtgtccggactgtcattggcccaaccggaactgtcattacattccctgagagtatggggcttccaagcatattcaactccaagcctgtcagctatccacctccaagagagaagtgtgcaggcccgaattgcacaaacccctacaagtaccgggactccaagacaaggcttccactgtgcagcttggcatgctacaaagctgtccagggacgtcctgtccaggggagtgaagctgcacaaggaagtgctgctgcccagggaagtgtcgctgaccagggaagtgatgcggcccagggaagtgtcgctgaccagggaagtgatgcagcccagggagatattgctgcccaggaaagtgctggaaagcaagcatgaagaacctagttacctgacgtgatgcaaccatgaccgtcagtaggctggagaagtgtatgtcgacatggccagctcgctggtgtgttgttttcgcggtttccgtggtagtagtttactagtttaacaatcaacttgacaaaggatggggtgacagccgatttccttctgcccttcgagttgggcgtcgtagtcgtattggtggtggtggatctagttgttatcttgtggttagtgtatgatactagtcgggaaagaagaagaaaaaaagttgtacagt

SEQ ID NO: 13304 - protein, 570 aa, Panicum virgatum
  misc_feature: Ceres CLONE 1769183
  misc_feature (384)..(469): Pfam Name: PAPA-1 Pfam Description: PAPA-1-like conserved region
  misc_feature (482)..(513): Pfam Name: zf-HIT Pfam Description: HIT zinc finger
MEGRGNPPLGTTEAVIKKPRSVVSRKPRSTEQLASEYNGMYAPSRYIFHDDDTGIEAGRHRRKELYLNSPETKNSMAHKNDVSRKLRRDDRSGGDYDGHSRSSKSKDATKHGSDGVLALECTMRSSGSPPDNPQLVPRDASVPGENRLRKVKLKVGGITRTIHPKTVPEPDPATSDGSSHRHKHKDSGGDTSKDTHGSRVEGKHGNRHDISPSSDLVRKSKRIPKKKALDGDSDDEDGELRYLEKLRRAKVAPDPMTTGHGSYDDSAADGLKKKNLSKVSKNKSTPYEVDEDFTMSRFGKDGRKKSQLGDGNESIEEEESEIDEKVGSKEVDSPSDVKIEIPGLTTRQRALQGRGGHGESLIEFPDGLPAVSSRKQKEKLSGVEIQAKKAEAAQRRKMQVEKAEKEQQAEAMRKILGIDSEKKKEEKKLKEQEEKEKQARLEEYRKNCVRTVIGPTGTVITFPESMGLPSIFNSKPVSYPPPREKCAGPNCTNPYKYRDSKTRLPLCSLACYKAVQGRPVQGSEAAQGSAAAQGSVADQGSDAAQGSVADQGSDAAQGDIAAQESAGKQA

SEQ ID NO: 13305 - DNA, 851 bp, Panicum virgatum
  misc_feature: Ceres CLONE 1769190
  misc_feature: Encodes the peptide sequence at SEQ ID NO. 13306
ttcccacgccagttaccctccccgactctgccgtcacccgcgccgccgcctcctctgctcgccgtctaagcggtttaaggttcgcctgcagccatgggtaaggagaagtcccacatcaacatcatggtcattggccacgtcgactctggcaagtcgaccactaccggccacctgatctacaagcttggaggtatcgacaagcgtgtgatcgagaggtttgagaaggaagctgctgagatgaacaagcggtccttcaagtacgcgtgggtgcttgacaagctgaaggctgagcgtgagaggggtatcacaatcgatatcgccctgtggaagttcgagaccaccaagtactactgcactgtcattgatgcccccggacaccgtgacttcatcaagaacatgatcacgggtacctcccaggctgactgtgctgtccttatcattgactctaccactggtggttttgaggctggtatctccaaggatggccagacccgtgagcatgctctccttgctttcactcttggagtgaagcagatgatctgctgctgcaacaagatggacgctaccactcccaagtactccaaggcccgttatgatgagatcgtgaaggaagtctcctcctacctgaagaaggtgggatacaaccctgataagattgccttcgtccccatctctggttttgagggtgacaacatgattgagaggtccacgaaccttgactggtacaaggggccaaccctgcttgaggctcttgaccagatcaacgagcccaagaggccttcagacaagcctctgcgtctcccccttcaggatgtgtacaagattggtggtattgggactgtgcctgttgc

SEQ ID NO: 13306 - protein, 252 aa, Panicum virgatum
  misc_feature: Ceres CLONE 1769190
  misc_feature (5)..(225): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIMVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPV

SEQ ID NO: 13307 - DNA, 841 bp, Panicum virgatum
  misc_feature: Ceres CLONE 1769192
  misc_feature: Encodes the peptide sequence at SEQ ID NO. 13308
cccactccacctccggtcggcagcgagagaggggggaaaatctcaaccaccagcaggttgactgattgattcccacgaagagggtctctttgggggtgtccgaagattttgtcatccgtggtccttggagctccaactccaactgatttcttgctggattgctgcgtctcttgctctgctcgagatgctgtctctgagctgccccggggtgtccatgagcaagaaggcgttcgatttgggggaagctggcatcctaccgctgcagctggcccgtcacccgcgcggcgccgaggcggcggcgcacgccatgtgtttgcttcgttgccttacccgccacccagactggccttgctgcagttggctgcccccgcagacgattcctactgcggcggcagcgagcgtccctgagcgcatttctgtttcatcgctgctggaggtcgtctcggacgacctgctgaacctcaacaacaatctcaaaccgcttgttggtgcagaaaatccagttttagtttctgctgcggaacaaatttttggtgctggtgggaagagattacgaccagctttagtttttctggtgtccagagcaactgctgaattagctgctttgtcggagctaactacagaacatcagcgcttggcagagataatagagatgattcatactgcaagtttaatacatgatgatgtcatagacgatagtgggatgcgaagaggaaaagagacgatccatcagctttatggcacaccggtggctgtgcttgctggtgattttatgtttgcgcagtcttcttggtttcttgcaaaccttgaaaacattgaagttatcaagctcatcagccag

SEQ ID NO: 13308 - protein, 218 aa, Panicum virgatum
  misc_feature: Ceres CLONE 1769192
  misc_feature: SWISSPROT Homolog: EC 2.5.1.30 Trans-hexaprenyltranstransferase
MLSLSCPGVSMSKKAFDLGEAGILPLQLARHPRGAEAAAHAMCLLRCLTRHPDWPCCSWLPPQTIPTAAAASVPERISVSSLLEVVSDDLLNLNNNLKPLVGAENPVLVSAAEQIFGAGGKRLRPALVFLVSRATAELAALSELTTEHQRLAEIIEMIHTASLIHDDVIDDSGMRRGKETIHQLYGTPVAVLAGDFMFAQSSWFLANLENIEVIKLIS

SEQ ID NO: 13309 - DNA, 820 bp, Panicum virgatum
  misc_feature: Ceres CLONE 1769195
  misc_feature: Encodes the peptide sequence at SEQ ID NO. 13310
aaattcgtcagggtccacctccacggccccgagacggggtcatcagccacctcgccaccggtatttaagagcggccggaggtgaagggggagatccggcgagctgcttcccctgtcaggaatccccctccgccgctcccgaatcttgctccggcgccggcaccccaccgcttgccagaatggcgctcaacaaggagtacacgtacgcggagctggagaaggagccctactggccatttgagaagctgcgaatctccatcacgggcgccggtgggttcatcgcgtcccacatcgcgaggcgcctcaagagcgagggccactacatcatcgcctctgactggaagaagaatgagcacatgaccgaggacatgttctgccatgagttccatcttgtcgacctgagggtcatggacaactgcctcaaggtgaccacgggggttgaccatgtgttcaaccttgctgctgatatgggtgggatggggttcatccagtccaaccactctgtgatcatgtacaacaacaccatgatcagctttaacatgcttgaggctgctagaattaacggcgtcaagaggttcttttatgcatcaagcgcctgtatttatcctgaatttaagcagttggagactgtagttagcttgaaggagtcagatgcctggcctgcagagcctcaagatgcctatggcttggagaaacttgctactgaggaactgtgcaagcactacacaaaggattttggcattgagtgccggatcggtcgctttcacaacatatatggtccctttggaacatggaaaggtggaagggagaaggcacctgct

SEQ ID NO: 13310 - protein, 213 aa, Panicum virgatum
  misc_feature: Ceres CLONE 1769195
  misc_feature (25)..(212): Pfam Name: Epimerase Pfam Description: NAD dependent epimerase/dehydratase family
  misc_feature: SWISSPROT Homolog: EC 5.1.3.18 GDP-mannose 3,5-epimerase
MALNKEYTYAELEKEPYWPFEKLRISITGAGGFIASHIARRLKSEGHYIIASDWKKNEHMTEDMFCHEFHLVDLRVMDNCLKVTTGVDHVFNLAADMGGMGFIQSNHSVIMYNNTMISFNMLEAARINGVKRFFYASSACIYPEFKQLETVVSLKESDAWPAEPQDAYGLEKLATEELCKHYTKDFGIECRIGRFHNIYGPFGTWKGGREKAP

SEQ ID NO: 13311 - DNA, 809 bp, Panicum virgatum
  misc_feature: Ceres CLONE 1769196
  misc_feature: Encodes the peptide sequence at SEQ ID NO. 13312
accttttgccccactccctcctccccacctctcgttctctcctccctctccctctccctccgctccccacccctctcccttctcacgcgcgcgcccgcccgcccagatctagggttcccccccgcggcgaagatgagcagcccccatggcggcctcgacgaccagatcgagcggctcatgcagtgcaagccgctccccgagcccgaggtcagagcgctgtgtgagaaggcgaaggagattctgatggaggaaagcaatgttcagcctgtaaagagtcctattacaatttgtggtgatattcatggacaatttcatgatcttgctgaactcttccggattggtggaaagtgtccagatacaaactacttgtttatgggagattatgttgatcggggctactattccgttgaaaccgtcacgcttttggtggctttaaaagttcgctatcctcagaggatcaccattcttagaggaaaccacgaaagccgacagatcactcaagtttatggattctatgatgagtgcttaaggaagtatggaaatgcaaatgtctggaaaaccttcacggacctctttgactacttccccttgacagcgttggttgagtcagaaatattttgcttgcatggtggattatcaccatctatcgaaaccctcgataacatccgcaacttcgatcgtgtccaagaagttcctcatgaaggtcctatgtgtgatcttctgtggtctgatccagatgatcgatgtggttggggtatttctccacgtggtgctggatatacctttggacaggatatttcagagcagtt

SEQ ID NO: 13312 - protein, 225 aa, Panicum virgatum
  misc_feature: Ceres CLONE 1769196
  misc_feature (48)..(189): Pfam Name: Metallophos Pfam Description: Calcineurin-like phosphoesterase
  misc_feature: SWISSPROT Homolog: EC 3.1.3.16 Phosphoprotein phosphatase
  misc_feature: The sequence is a functional homolog of SEQ ID NO 13 in US patent 7271316
MSSPHGGLDDQIERLMQCKPLPEPEVRALCEKAKEILMEESNVQPVKSPITICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQ

SEQ ID NO: 13313 - DNA, 630 bp, Panicum virgatum
  misc_feature: Ceres CLONE 1769196-R
  misc_feature: Encodes the peptide sequence at SEQ ID NO. 13314
caaaaaagttgtgaccatatttagcgcacctaattattgctatcgctgtgggaacatggcgtcgatcttagaagtggatgattgcagggagcatactttcatccagtttgagccagccccaagaaggggagagccagatgtaactcgtaggacacctgactatttcctgtgatgcaaaagtgatgtggatctgcagcaaaggtttgatagataggtgaagtttcctggttgcagatattttttttgctcgaaaccctccgtgtgctattcttattatttttgcccatggctcctcggctgtcgcgggctgctcagtcacatctcgattcaagtgtatacctacctactacagctggaaggaccggattgtgttctcacttatctctaactggttgatgcttttggcttggtgggggtgctgcagtggtgggttcaggcatcaagcagcaatctgtatgatgagaggaaactgttcccgttgtattcattttgttcccctttcttcctcacttgtttctccttttctttttttcgtattcctgtagaggtgaacaattgtatggttctgtgttgggccattagtcttttttctgactgcctcgatttgccgtatagaattaccatttaagc

SEQ ID NO: 13314 - protein, 56 aa, Panicum virgatum
  misc_feature: Ceres CLONE 1769196-R
  misc_feature: SWISSPROT Homolog: EC 3.1.3.16 Phosphoprotein phosphatase
  misc_feature: The sequence is a functional homolog of SEQ ID NO 13 in US patent 7271316
KKVVTIFSAPNYCYRCGNMASILEVDDCREHTFIQFEPAPRRGEPDVTRRTPDYFL

SEQ ID NO: 13315 - DNA, 837 bp, Panicum virgatum
  misc_feature: Ceres CLONE 1769201
  misc_feature: Encodes the peptide sequence at SEQ ID NO. 13316
attccaacagcttcttcccctcaaagaccactccggcgagattcttcccagaccggccggcgaatcacagctcgatcgatcgttctccggcgagctagcaaccactccctgatcggaatggacttcggaggggcgctgcagctgccgccggggttccggttccacccgacggacgaggagctggtgacgcactacctcctgcgcaagtgcggcgggctggcaccggcggcgccggtgatcgcggaggtggacctgtacaagttcgacccgtggagcctgccggagcgggcggccggcggggagaaggagtggtacttcttctcgccgcgggaccgcaagtaccccaacgggtcgcgccccaaccgcgccgccggcgccgggtactggaaggccaccggcgccgacaagcccgtgggcgcgccgcgccccgtcgccatcaagaaggcgctcgtcttctacgccggcaagccgcccaggggcgtcaagaccaactggatcatgcacgagtaccgcctcgccgacgtcgaccgctccgccgccgcccgcaagaagacggccaataacaacgcgctcaggctggatgactgggtgctgtgccggatctacaacaagaagggcgtgatcgagcggtacgacacggtggacgacgacgaggtcgcggcggccaacgacgtcaagccggccgcgcccaagaacccgcgcggggcggccggcgccggcggcggccgcgcgccgatgaaggtggagatggccgactacggcgggtactacgacgacgggtacgacctcgagacgccgtccgcggggatgctgtgcttcgaccgcccggcggccgtg

SEQ ID NO: 13316 - protein, 239 aa, Panicum virgatum
  misc_feature: Ceres CLONE 1769201
  misc_feature (9)..(134): Pfam Name: NAM Pfam Description: No apical meristem (NAM) protein
  misc_feature: The sequence is a functional homolog of SEQ ID NO 890 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: The sequence is a functional homolog of SEQ ID NO 854 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Useful for making plants with modulated oxidative stress sensitivity
  misc_feature: Useful for making plants with modulated water use efficiency
  misc_feature: Useful for making plants with modulated light quality response
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Useful for making plants with modulated nitrogen use efficiency
MDFGGALQLPPGFRFHPTDEELVTHYLLRKCGGLAPAAPVIAEVDLYKFDPWSLPERAAGGEKEWYFFSPRDRKYPNGSRPNRAAGAGYWKATGADKPVGAPRPVAIKKALVFYAGKPPRGVKTNWIMHEYRLADVDRSAAARKKTANNNALRLDDWVLCRIYNKKGVIERYDTVDDDEVAAANDVKPAAPKNPRGAAGAGGGRAPMKVEMADYGGYYDDGYDLETPSAGMLCFDRPAA

SEQ ID NO: 13317 - DNA, 1680 bp, Panicum virgatum
  misc_feature: Ceres CLONE 1769202
  misc_feature: Encodes the peptide sequence at SEQ ID NO. 13318
gaacagtttgcgctgcgagcatgggcctctcaccgtttcttgcagtgctgcccgccattattgcccttctctccctcgtgttcttcttctccaccggcagaaaagctgctctctcccatggacatggacatggacggaggagcttgccgccgtcgccgccgggcttccctctcgtcggccacctgccgcttcttggatcgctaccccaccggacgctccgggcgatggccggaacgcacggcccggtcatgctcctgcggctcggccgcgtgcccgtcgtggtggcctcctcggcggccgcggcgcaggaggccatgaaggcccgagacgtggccttcgcgggccggtacagcgggccgatggtcgagcgccttttctacgggcgcgaccgcgacatggccttcgcttcctacggcgagcactggcgccaggcgcgacgcgtctgcgtgctccacctcctcagccagcgctgcgtgctctccttccggcgcgttcgccagcaggagacggccgccctgatcggccgcgtccgccgcgatgccgccgccgccgtgaacctgagccatcttctcgtcgtctactccagcgccgtcctcctgcgggccgcgttcggcaacgacgacgacgacgactccagctacgggctcgacggagaaggggagattcttaggaagttgctagtcgacgccgaggagttgctgggcttgggcacgctcggcgaggtcgtgccgtggctggcgtgggtggactcggtgaggggggtgcatgccaaggcagcacggacgtctgaggcgctggatggcttcctcgagcggggccttgcggaccaccatacgcggcgccaccgtggaggtccgcggaagggagacggtggcggcgacgagaatcgccgcagcttcgcgagcgtgctgctggatgtgaaggaggaggaagaggcgggaggaatccagtttgacacggcagccgtcaaggccatcatcctagatatgtccctagccggctcgtccacgaccgcctccattgtggaatcggcaatggcggagctcatcaaccatccagatgagatgcgcaagctccaagaggagatacgcgcggccatcatccatgacggcggtgacaaccaaattaccgaggaccacctaggtaagctgcgccgcctcaagccggtgctcaaggagacgctccgtctgcacatgccgtcgccgctcgtgcatcgagagacggtcgaggacaccgagctgctcggataccatgttccagcgcgcacccgtgtcatcatcgacgtcggggccatcgcacgggaccccgccacgtgggagcgcgcaggggagttcctgccggagcggtggttcggggatgacggcgcggcggcggcggtggcggggcaggacttcacattcttgccgttcggtggcgggcggagagggtgccccggtgccgggtttggcatggcgagcgtcgacctggtgctgacgagcctgctgtaccattttgactgggagctaccggccggtggggcgtccacggtcgacatggatgaggtgggtgaattggccgtgcggttgaagaaacctctgtgtctggtcgctaagccatggtgtccttaataagatccatcacgcatggtgtccatcctgctcatattcatcaggaaattaaataaagagtttaattatccgc

SEQ ID NO: 13318 - protein, 528 aa, Panicum virgatum
  misc_feature: Ceres CLONE 1769202
  misc_feature (43)..(523): Pfam Name: p450 Pfam Description: Cytochrome P450
  misc_feature: SWISSPROT Homolog: EC 1.14.13.68 4-hydroxyphenylacetaldehyde oxime monooxygenase
MGLSPFLAVLPAIIALLSLVFFFSTGRKAALSHGHGHGRRSLPPSPPGFPLVGHLPLLGSLPHRTLRAMAGTHGPVMLLRLGRVPVVVASSAAAAQEAMKARDVAFAGRYSGPMVERLFYGRDRDMAFASYGEHWRQARRVCVLHLLSQRCVLSFRRVRQQETAALIGRVRRDAAAAVNLSHLLVVYSSAVLLRAAFGNDDDDDSSYGLDGEGEILRKLLVDAEELLGLGTLGEVVPWLAWVDSVRGVHAKAARTSEALDGFLERGLADHHTRRHRGGPRKGDGGGDENRRSFASVLLDVKEEEEAGGIQFDTAAVKAIILDMSLAGSSTTASIVESAMAELINHPDEMRKLQEEIRAAIIHDGGDNQITEDHLGKLRRLKPVLKETLRLHMPSPLVHRETVEDTELLGYHVPARTRVIIDVGAIARDPATWERAGEFLPERWFGDDGAAAAVAGQDFTFLPFGGGRRGCPGAGFGMASVDLVLTSLLYHFDWELPAGGASTVDMDEVGELAVRLKKPLCLVAKPWCP

SEQ ID NO: 13319 - DNA, 847 bp, Panicum virgatum
  misc_feature: Ceres CLONE 1769206
  misc_feature: Encodes the peptide sequence at SEQ ID NO. 13320
gctggcttggcagcagagcacgatggccacccacgctgctctcgcggcgtcgcgcatccccgcaggcgcccggctgcacagcagggcggcgtccaggcagagggtggacttcgccgacttctctgggccgaggccgggatcatgctccgtcagcaccgccgccagggaggcgtccttctccgacgtgctcggtgcgcagctcgtcgccaaggccaccggggagaacgcggtgagggcgcccgctgaggccaagctcaaggtggcgatcaacgggttcgggcgcatcggccggaacttcctccggtgctggcacggccgcaaggactccccgctcgatgtcgtcgtcatcaacgacagcggaggcgtcaagaacaaaacacctgttcaggcgtctcacctcctcaagtacgactcgatgctcggcaccttcaaggccgacgtcaagatcgtcgacgacaccaccatcagcgtcgacggcaagctcatcacggtcgtctccaacagggacccgctcaagctcccatgggccgagctcggcatcgacattgtcatcgagggtaccggagtcttcgtcgacggcccgggcgccgggaagcacatccaggccggcgccaagaaggtcatcatcaccgctccggccaagggcgccgacatcccgacctacgtcgtcggcgtcaacgagggcgactacgaccacggcgtggccgacatcatcagcaatgcttcctgcacgaccaactgcctcgcgccgttcgtcaaggtcttggacgcggagttcgggatcgtgaagggaacgatgacgacgacccactcgtacacgggcgaccagaggctgctggacgcgtcc

SEQ ID NO: 13320 - protein, 274 aa, Panicum virgatum
  misc_feature: Ceres CLONE 1769206
  misc_feature (78)..(236): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MATHAALAASRIPAGARLHSRAASRQRVDFADFSGPRPGSCSVSTAAREASFSDVLGAQLVAKATGENAVRAPAEAKLKVAINGFGRIGRNFLRCWHGRKDSPLDVVVINDSGGVKNKTPVQASHLLKYDSMLGTFKADVKIVDDTTISVDGKLITVVSNRDPLKLPWAELGIDIVIEGTGVFVDGPGAGKHIQAGAKKVIITAPAKGADIPTYVVGVNEGDYDHGVADIISNASCTTNCLAPFVKVLDAEFGIVKGTMTTTHSYTGDQRLLDA

SEQ ID NO: 13321 - DNA, 669 bp, Panicum virgatum
  misc_feature: Ceres CLONE 1769206-R
  misc_feature: Encodes the peptide sequence at SEQ ID NO. 13322
accggcgcggccaaggtggtggcgctggtgctgccgcagctcaaggggaagctgaacggcatcgcgctccgcgtgccgaccccgaacgtgtccgtggtggacctggtgatcaacaccgagaagaagggcatcaccgccgacgacgtcaacggcgcgttccgcgaggccgccgccagcccgctcaatggcgtcctcgacgtctgcgacgcgccgctcgtgtccgtcgacttcaggtgctccgacgtgtcctccaccatcgactcctcgctcaccatggtcatgggcgacgacatggtcaaggtcgtcgcctggtacgacaacgagtggggatacagccagcgcgtggtcgatttggcgcacctggtggcggccaagtggccgggcgcggcgacggcgggcagcggcgaccccctggaggacttctgcaaggacaaccccgccaccgacgagtgcaaggtgtacgaggcataaggcctccgtgttctgttgttcggaagcgtacattacgatcgatcaggaagagggcagagtaactttgctgtcactgcccgcccggtgttcttccgtagagagtacacacacactaactttgttgttcagaaatgcatctttgtttctgtgtgtgaggtgtaatcatcactgaactcgtacaggcttcagatttcattt

SEQ ID NO: 13322 - protein, 156 aa, Panicum virgatum
  misc_feature: Ceres CLONE 1769206-R
  misc_feature (1)..(105): Pfam Name: Gp_dh_C Pfam Description: Glyceraldehyde 3-phosphate dehydrogenase, C-terminal domain
  misc_feature: SWISSPROT Homolog: EC 1.2.1.13 Glyceraldehyde-3-phosphate dehydrogenase (NADP(+)) (phosphorylating)
TGAAKVVALVLPQLKGKLNGIALRVPTPNVSVVDLVINTEKKGITADDVNGAFREAAASPLNGVLDVCDAPLVSVDFRCSDVSSTIDSSLTMVMGDDMVKVVAWYDNEWGYSQRVVDLAHLVAAKWPGAATAGSGDPLEDFCKDNPATDECKVYEA

SEQ ID NO: 13323 - DNA, 845 bp, Panicum virgatum
  misc_feature: Ceres CLONE 1769228
  misc_feature: Encodes the peptide sequence at SEQ ID NO. 13324
agcggtctggtctggtctggtctggtgcttccctcttcggtgggaaggccggaaggaaggggaggacgcaaggcgaggcgactggccgacgcagggagagagtgccgcgcgagcgccccccaaatctcgtcctgccgtccccccgcgggatttagggaggagaggaagcaagtggttcaccatgaaggcgctcattcttgttgggggtttcggaacccgcctgcgccctttgactctcagcttcccaaagccccttgttgattttgcaaacaagcccatgattctgcatcagattgaagctttgaaagaagttggggtcacggaggtggttttagccatcaactaccgcccagaggtgatgattaacttcttgaaggactttgaggataagcttggcatcacaattacatgctctcaagagaccgagcccttaggaactgctggcccacttgctctagcaagggacaagcttgtggatggatctggcgagccattctttgtcctcaacagtgatgtcataagtgaatacccatttgctgaactcatcaaatttcacaagggccatggtggtgaggcaacaattatggtcactaaggtggatgaaccatcaaaatatggtgttgtggtcatggaggaggcaactggaagggtggatagatttgtagagaagccaaaaatatttgtgggcaacaagatcaatgctgggatttacttgctgaacccatctgtccttgatcgcattgaactgaggccaacatcaattgagaaagaggtcttccctcaaattgcagctgaccaaaagctctatgcgatggttcttccaggattttggatggatgttggtc

SEQ ID NO: 13324 - protein, 221 aa, Panicum virgatum
  misc_feature: Ceres CLONE 1769228
  misc_feature (2)..(221): Pfam Name: NTP_transferase Pfam Description: Nucleotidyl transferase
  misc_feature: SWISSPROT Homolog: EC 2.7.7.13 Mannose-1-phosphate guanylyltransferase
MKALILVGGFGTRLRPLTLSFPKPLVDFANKPMILHQIEALKEVGVTEVVLAINYRPEVMINFLKDFEDKLGITITCSQETEPLGTAGPLALARDKLVDGSGEPFFVLNSDVISEYPFAELIKFHKGHGGEATIMVTKVDEPSKYGVVVMEEATGRVDRFVEKPKIFVGNKINAGIYLLNPSVLDRIELRPTSIEKEVFPQIAADQKLYAMVLPGFWMDVG

SEQ ID NO: 13325 - DNA, 811 bp, Panicum virgatum
  misc_feature: Ceres CLONE 1769234
  misc_feature: Encodes the peptide sequence at SEQ ID NO. 13326
agttgcttctcctgaactcttcgagaggctttcttcatcctctccgtcttccttcccctgaccccatccaccccgcccgctgctacaagcaaccgccgatccagtccgttccgcctccaggcgaatggtcgccaaccaggaggcggaggcggcatcggcggcagcgcccggggcagggacgacggtggacccgatgcgtctggcgtcgcggtggcggtccccggcggagtgggagtgtgcggcggcggagctggatgctgagccgctcccgtccgagctcaacaccgtcaacagctcgggccttttcgccgtcgtctccatcgacaagttgtccgtcaaataccttggcagccatcatcatggccacgacgtcggggtcgtgcaagccgaccgccccgcgcccacgcgccgggccgtgtactactttgagatgggtgtcaagaacgccggctacaaggggcagacctcaatcgggttcacaaacgaaagcttcaagatgcggcgacaaccgggttgggagtctaacagttgtggataccatggtgatgatagctatctttaccgaggtcaagggaaaggtgaatcattcggacccaaatttacatctggcgacacaattggtgctggcatcaactacttgtcacaagaatttttcttcacgaaaaatggatctctggttggagcctttccaaaagaaattaaaggtccactatatcctactgttgcagttcatagtcagggtgaagagttgactgtaaactttggaaaagaaccattctgttttgatattgagggttatatactcgaagag

SEQ ID NO: 13326 - protein, 228 aa, Panicum virgatum
  misc_feature: Ceres CLONE 1769234
  misc_feature (96)..(217): Pfam Name: SPRY Pfam Description: SPRY domain
  misc_feature: SWISSPROT Homolog: EC 2.7.10.2 Non-specific protein-tyrosine kinase
MVANQEAEAASAAAPGAGTTVDPMRLASRWRSPAEWECAAAELDAEPLPSELNTVNSSGLFAVVSIDKLSVKYLGSHHHGHDVGVVQADRPAPTRRAVYYFEMGVKNAGYKGQTSIGFTNESFKMRRQPGWESNSCGYHGDDSYLYRGQGKGESFGPKFTSGDTIGAGINYLSQEFFFTKNGSLVGAFPKEIKGPLYPTVAVHSQGEELTVNFGKEPFCFDIEGYILE

SEQ ID NO: 13327 - DNA, 500 bp, Panicum virgatum
  misc_feature: Ceres CLONE 1769234-R
tcctgtctacgaaccccgccatgaaggaccctgagagctgtctttactcgtgtctcgagaggttactaaggcagctcacagtatgtagctttgagcgacgcacattcaacaacgaccaaggagatgcattcttacttcacaaagaagtgcgcaactgtgaaaggtcccggcgttcataggcacatctgagaattcaactcagatgttagactccaactgctgttcggaggaccaaggatcaccgcggatggagttgttgaccattgcaggagcaagcacagatccttccttttgaaggtctgcagcgtccatgggctttctgaattccgataggtgcacactcagttgcacagagctctgaaggagtttcctttctgtaatcagaaaactcgttcagaatcggccgaagtatctattcccataatttgttggttggctaatagaccgtttgattctgtgaatgttaaaaaggcttcaatatatgttctttacctttatat

SEQ ID NO: 13328 - DNA, 835 bp, Panicum virgatum
  misc_feature: Ceres CLONE 1769242
  misc_feature: Encodes the peptide sequence at SEQ ID NO. 13329
ctcctctcctctcctctccctcttcctccctccctctccgtgcgctcgagcgaattcccgagcgggattctccgcggtagaggaaccctagcgctccccggatcccgccgcggggtgcaatggccgcgccggcgttcctgcccgagctggccacgcaggtggtggtgcccgtcgcggccgtggtgggcatcgccttcgcggtgctgcagtgggtgctggtctccaaggtgaagctctcccccgagccgcggcgcggggacgggtcctcagcgaagagcggcgccggcgccagcgagtacctcatcgaggaggaggaggggctcaacgagcacaacgtcgttgtcaagtgcgccgagatccagaacgccatctccgaaggagcaacatctttccttttcactgaatacaagtatgttggactattcatgggcatttttgctgtcctgatcttcctcttccttggctctgttgaggggttcagtaccaagagtcagccttgccactacagcaagggcaagacgtgcaagcctgcccttgccaatgctcttttcagcaccattgcctttgtgcttggtgcagtcacctcacttgtttctgggtttcttggaatgaagattgcgacatatgcaaatgccaggacgactcttgaggcaaggaagggtgtcggaaaggcattcattaccgctttccgctctggtgctgtgatgggcttcctgcttgctgccagtggcctttttgttctttatatcgcaatcaacttgttcggaatttattatggtgatgactgggaaggcctttatgaggctatcactggttatggtctcggtggttcttc

SEQ ID NO: 13329 - protein, 238 aa, Panicum virgatum
  misc_feature: Ceres CLONE 1769242
  misc_feature (9)..(238): Pfam Name: H_PPase Pfam Description: Inorganic H+ pyrophosphatase
  misc_feature: SWISSPROT Homolog: EC 3.6.1.1 Inorganic diphosphatase
  misc_feature: Useful for making plants with modulated water use efficiency
MAAPAFLPELATQVVVPVAAVVGIAFAVLQWVLVSKVKLSPEPRRGDGSSAKSGAGASEYLIEEEEGLNEHNVVVKCAEIQNAISEGATSFLFTEYKYVGLFMGIFAVLIFLFLGSVEGFSTKSQPCHYSKGKTCKPALANALFSTIAFVLGAVTSLVSGFLGMKIATYANARTTLEARKGVGKAFITAFRSGAVMGFLLAASGLFVLYIAINLFGIYYGDDWEGLYEAITGYGLGGS

SEQ ID NO: 13330 - DNA, 806 bp, Panicum virgatum
  misc_feature: Ceres CLONE 1769247
  misc_feature: Encodes the peptide sequence at SEQ ID NO. 13331
tttgatcccgccgcccctgcttctccgtggccgccatggcgtcgcccatgctctccgccaccaccgtcccgctccagggcgccggcctcggcgagttcaccggcctccggagctccgcgtcgctgccgctgcgccgcggtaatgccgccgcctccgacgacttcatgtccgccgtctccttcaggaccaacgcggtcgccaccagcggcgggccgcggcgggcgccggcggaggcgaagctcaaggtggcgatcaacgggttcgggcgcatcgggcgcaacttcctgcgctgctggcacgggcgcgacgactcgccgctcgacgtcatcgccatcaacgacaccgggggcgtcaagcaggcgtcgcacctgctcaagtacgactccacgctcggcaccttcgacgccgacgtcaagcccgtgggcgacaacggcatctccgtcgacggcaaggtcatcaaggtcgtgtcggaccgcaaccccagcaacctgccctggggggacctcggcatcgacctcgtcatcgaggggacgggggtcttcgtcgaccgcgagggcgccgggaagcacatccaggcgggcgccaagaaggtgctcatcaccgcgccgggcaagggcgacatccccacctacgtcgtcggcgtcaatgccgaccagtacaaccccgacgagcccatcatcagcaacgcctcctgcaccaccaactgcctcgcgccgttcgtcaaggtcctcgaccagaagttcggcatcatcaagggcaccatgaccaccacccactcctacaccggtgaccagaggctgctggac

SEQ ID NO: 13331 - protein, 256 aa, Panicum virgatum
  misc_feature: Ceres CLONE 1769247
  misc_feature (69)..(220): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MASPMLSATTVPLQGAGLGEFTGLRSSASLPLRRGNAAASDDFMSAVSFRTNAVATSGGPRRAPAEAKLKVAINGFGRIGRNFLRCWHGRDDSPLDVIAINDTGGVKQASHLLKYDSTLGTFDADVKPVGDNGISVDGKVIKVVSDRNPSNLPWGDLGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLL

SEQ ID NO: 13332 - DNA, 1594 bp, Panicum virgatum
  misc_feature: Ceres CLONE 1769248
  misc_feature: Encodes the peptide sequence at SEQ ID NO. 13333
gatcaagcaagcaccgcatcgccccgtatgcttcgtcgcgcgggcacgcgtgtcgtcgtcggcggcggcggcggcggccggcgaggaggagccctcatggcctccctcatccacttcctcccttcctccgcctactcctcctcccatctcccgccccagccccagccgcggccaactcccgcccccgcccccgccgcggcgcggccgtcccggctccgcctcccgttcgcgcgcgccgccgcgcggcgcgaccccgagcctctgccgttcccggcggaggcgcctccggatcccgcggtcgaggagcggaggtcgctggcggtgaggacgggggagctgttcctggggctggcggcgctgctgctgcgcgggaccggggccgttcgcggaggcggcggggcggcggcggtggaggaggtggaggcgagggacggggtggtgtgggagcagcggcccgaggacktgsaggccgagcggcgkckgcgggagctcaccagtccccgggttcagcttctccgcggctgggctgctcttcccctaccacctcggcgtcgcgcagtgcctcatgcacaaaggatacatcactgagagaactctgttagctggctcatcagctggtgccataatctgtgcagtgattgcatctagaaacacaatgcaagatgctttgcaggtgactaaagatctakctgacaactgccggagtaaggggactgcatttcgwcttggggctgtgctcasggatgtccttgacaagtttctaccagatgatttgcacatcasatgcaatggaaggattcttgttgctattactcagctatcctggaggcctaggggcttactagttgaccaatttgactccaaagaagatgtcattaatgctgtcattacatcctcttttattcctggatacctagctcccaggccggcaacatacttccgtaaccgcctatgcattgatgggggccttacattgtttatgccacccacttctgcttccgaaacaatccgaatatgtgctttcccagccatcacactgggtttgcaaagcattgggattagtccagactgcaatccggagaacagggctagcccaagacagctgtttaactgggctctggaaccggcggaagatgaaattctcgrcaagttatasgagcttgggtacatggacgcagctgtatgggtcgagcagaagtctaccgagttgaatgcgaagaatgatcaacctctcgccgttgaatgaattgaacccctttggtctgctcaaaactgctgggttcatgttcatgggagttctatacttgtaatgtatcataaagattagattttttttaggagaagtacatgaaaagatgtcaggsacttgccatcagtgttaggcatgacaacaatgctggaggcaagttgatattagggtttacgggctgatgggcattttcaaatgtatatattagacaacgaggtttgaccggagaggtcgttttgtaatggtacaggggagtaatgtttgccccttgcgggctggcaactcctataaaaacaactttcacaaactcaacttgttatgtgcaaatttataaacttatattcg

SEQ ID NO: 13333 - protein, 226 aa, Panicum virgatum
  misc_feature: Ceres CLONE 1769248
  misc_feature (3)..(145): Pfam Name: Patatin Pfam Description: Patatin-like phospholipase
  misc_feature: SWISSPROT Homolog: EC 3.1.1.3 Triacylglycerol lipase
  misc_feature (42)..(42): Xaa is any aa, unknown, or other
  misc_feature (59)..(59): Xaa is any aa, unknown, or other
  misc_feature (73)..(73): Xaa is any aa, unknown, or other
  misc_feature (194)..(194): Xaa is any aa, unknown, or other
  misc_feature (197)..(197): Xaa is any aa, unknown, or other
MHKGYITERTLLAGSSAGAIICAVIASRNTMQDALQVTKDLXDNCRSKGTAFRLGAVLXDVLDKFLPDDLHIXCNGRILVAITQLSWRPRGLLVDQFDSKEDVINAVITSSFIPGYLAPRPATYFRNRLCIDGGLTLFMPPTSASETIRICAFPAITLGLQSIGISPDCNPENRASPRQLFNWALEPAEDEILXKLXELGYMDAAVWVEQKSTELNAKNDQPLAVE

SEQ ID NO: 13334 - DNA, 817 bp, Panicum virgatum
  misc_feature: Ceres CLONE 1769249
  misc_feature: Encodes the peptide sequence at SEQ ID NO. 13335
aagcaactctcgatccctaatcagcagctcgatcgagcccgctttagcttgagagaagcagtgcctgtgtgtgttcgcagcaatggcgaccgccaatgtcctcctcgtcctgctctgctcaaccctctgcttcctcgcccgccgggccgccggcgactacggcgggtggcagagcgcccacgccacgttctacggcggcggcgacgcgtccggcacaatgggcggggcgtgcgggtacgggaacctgtacagcaccgggtacggcaccaacacggcggcgctgagcacggcgctgttcaacgacggcgcctcgtgcgggcagtgcttcgagctccgctgcgacaacgccgggcagtcgtgcctgcctggcaccatcaccgtgacggccaccaacttctgcccgcccaactacggcctccccagcgacgacggcggctggtgcaacccgccgcgcccgcacttcgacatggcccagccggccttcctccagatcgcacagtaccgcgccggcatcgtgcccgtcgcctacaggaggtacgttgcttctcgtgggcccgtgcgggtgtcatcaggtcttcggaccaaccgagcctggaccggctggacctcaccacggccggcttagcttgcatgccatgttacgtgggccttgttacgattttattgtgatttctgcaagttgcaacttgcaaacatcgcaaacgatcggcgatagcaacgcttcacctgtcatgtcatgttcgtgccgtgtcctagatgaacgcttttttatttcactgcagtttttccccccttttactgatgatgatgatcgttc

SEQ ID NO: 13335 - protein, 180 aa, Panicum virgatum
  misc_feature: Ceres CLONE 1769249
  misc_feature (64)..(149): Pfam Name: DPBB_1 Pfam Description: Rare lipoprotein A (RlpA)-like double-psi beta-barrel
  misc_feature: Useful for making plants with altered carbohydrate content
  misc_feature: Useful for making plants with altered cell wall content and/or composition
MATANVLLVLLCSTLCFLARRAAGDYGGWQSAHATFYGGGDASGTMGGACGYGNLYSTGYGTNTAALSTALFNDGASCGQCFELRCDNAGQSCLPGTITVTATNFCPPNYGLPSDDGGWCNPPRPHFDMAQPAFLQIAQYRAGIVPVAYRRYVASRGPVRVSSGLRTNRAWTGWTSPRPA

SEQ ID NO: 13336 - DNA, 656 bp, Panicum virgatum
  misc_feature: Ceres CLONE 1769249-R
  misc_feature: Encodes the peptide sequence at SEQ ID NO. 13337
gtccgccaccgggtggcaggccatgtcccgcaactggggccagaactggcagagcaactcgctcctcgacggccaggccctctccttcaaggtcaccgccagcgacggccgctgcgtcaccagcgacaacgccgcgccggctggctggcagttcggccagaccttcgagggcggccagttttgatctagccgccggccggccccgcgccgccgcttgacgaggacgacccatcatcggtttgcattgcgttcggagaaggaaaccggccggccttttcgccgtagtaaagaagagagcccgccggccattttgaggctgcttattatcactagcacccgcttaggcctttccttttccgatgatggtaggattaagttaatatttttttgcaccagtgagtgattgtgtagccttggactaaggggatcgattaaaaaaaagaagaacctgctgcagggccgattattgtagagcaagctgcaggggagtgtgtggtgtcgtgttcgtgtaacttttgttgttgttacatgggttgggtgggagatgtttgctggggatttatatatcccccgatggcacctttgggaccgtgaccaatgcttgttcatggccggtctgtacgtgcagtatatatggtatgctttgtgctttgttg

SEQ ID NO: 13337 - protein, 60 aa, Panicum virgatum
  misc_feature: Ceres CLONE 1769249-R
  misc_feature (1)..(46): Pfam Name: Pollen_allerg_1 Pfam Description: Pollen allergen
  misc_feature: Useful for making plants with altered carbohydrate content
  misc_feature: Useful for making plants with altered cell wall content and/or composition
  misc_feature: Useful for making plants with altered lignin content
SATGWQAMSRNWGQNWQSNSLLDGQALSFKVTASDGRCVTSDNAAPAGWQFGQTFEGGQF

SEQ ID NO: 13338 - DNA, 855 bp, Panicum virgatum
  misc_feature: Ceres CLONE 1769257
  misc_feature: Encodes the peptide sequence at SEQ ID NO. 13339
agccaccgactccctcccccaccgccccgattcggagccgagtcgcccttgctcaggaggcagagagccccgaaccgcggcgggagggagggcggccttcctcttagcttccaccccgccggaggccagccgccccatgggccggtcgcccgcgcgcgctacgtaccagctcatcgaccgccggaaagggcttgggtaactctttgttgaaagaacctctcttgtacatgtaacattgcatgtaatttctgttaaagatgagttctctgaataaagttgtttcaaatagtggggatgtgtgttcggtgttacctagtaaagcaacatcattaaatcccaatgcagcagaattcgtaccttcgtttattaaaccatctgttggaaatagcacagctccagatgtagctaagtcagattttagggggtcttctggaaaaacaatcctagataggtccgagtcttcaaagtctaataactcggatgatgaggcacaccagttttggcgcaagcagcttccagatgacattattccagacttctcttcatttgagaaaattgaacaagggcctgaagaattgtctcttgctggattatccttgaatgcgccgcccttttatgggacaacttccagccgtttctcaagagaacatcaagaattatcttctccagctaccaagggcctggaactggaacatactaatctactgtacgaagataattatttgggttcaagcaactgggaacaaaattatattggtgatcttcatattgctaatgggaaccaggaccttcattatgagtctgaaagcgctgcaggcttttctgacagttttgctagtgagtatgctgccgcag

SEQ ID NO: 13339 - protein, 199 aa, Panicum virgatum
  misc_feature: Ceres CLONE 1769257
  misc_feature (20)..(37): Pfam Name: PAM2 Pfam Description: Ataxin-2 C-terminal region
MSSLNKVVSNSGDVCSVLPSKATSLNPNAAEFVPSFIKPSVGNSTAPDVAKSDFRGSSGKTILDRSESSKSNNSDDEAHQFWRKQLPDDIIPDFSSFEKIEQGPEELSLAGLSLNAPPFYGTTSSRFSREHQELSSPATKGLELEHTNLLYEDNYLGSSNWEQNYIGDLHIANGNQDLHYESESAAGFSDSFASEYAAA

SEQ ID NO: 13340 - DNA, 811 bp, Panicum virgatum
  misc_feature: Ceres CLONE 1769268
  misc_feature: Encodes the peptide sequence at SEQ ID NO. 13341
acagcatcatcagttcactctccttcgtcctcttctcggttatcccaccaactccccaatctcaccccaattcaccaaatatcccattttcatcccagaacaatcccccaatccgccaaagattgccgattggggcctcggcaatggccgcccgagccgccgcgctgcttgccgccatcctcctgggggccctcggcgccgcgcggcgggccgacgcggcgatcggggtgaactggggcaccgtctcgtcccaccgcgcgccgccgggcgtggtggtggacctgatgcgcgcgaaccggatcagcaaggtcaagctcttcgacgccgacccgggtgtgctgcgcgcgctcgccggcagcggcatacaggtcatggtcggcgtcaccaacggcgagctcgcaagcattgcgggatcgcagggggccgccgacgcctgggtcgcgcagaacgtgtcgcggtacgtcggtcgcggcggcgtggacatccgatatattgctgtgggcaatgagcctttcctgacaagctaccagggtcaatttgaatcatatatcattccagcaatgacaaatattcagcaatcactggtgaaagctaatcttgctagttacataaagctagtagtaccctgcaatgcagatgcgtatgagagtgcttctgttccatcccaaggagtattcagggctgaattgactcagataatgacccagttggctgcttttctgagttctagcggggctccattcgtcgtcaatatctacccgttcctcagtctttatcaaaattcggatttcccacaagattatgcattctt

SEQ ID NO: 13341 - protein, 222 aa, Panicum virgatum
  misc_feature: Ceres CLONE 1769268
  misc_feature (27)..(222): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Useful for making plants with altered cell wall content and/or composition
  misc_feature: Useful for making plants with altered carbohydrate content
MAARAAALLAAILLGALGAARRADAAIGVNWGTVSSHRAPPGVVVDLMRANRISKVKLFDADPGVLRALAGSGIQVMVGVTNGELASIAGSQGAADAWVAQNVSRYVGRGGVDIRYIAVGNEPFLTSYQGQFESYIIPAMTNIQQSLVKANLASYIKLVVPCNADAYESASVPSQGVFRAELTQIMTQLAAFLSSSGAPFVVNIYPFLSLYQNSDFPQDYAF

SEQ ID NO: 13342 - DNA, 830 bp, Panicum virgatum
  misc_feature: Ceres CLONE 1769281
  misc_feature: Encodes the peptide sequence at SEQ ID NO. 13343
gtaccctctcccaccaccaccaccacacagaccgaaccccccacgccgacaaccaccagggagccaccagccatggcgctctcgcacgcgagctccatcgcccgggacgacgccgtcgcctgcaccttcgcgtcgcgctacgtgcgcgagcgcctgccgcggtaccggatgccggagcggtcgatcccgcgggaggcggcgtaccagatcatcaacgacgagctgatgctggacggcaacccgcggctgaacctggcgtccttcgtcaccacctggatggagcccgagtgcgacaagctcatcatgggctccatcaacaagaactacgtcgacatggacgagtaccccgtcaccaccgagctccagaaccgttgcgtaaatatgatagctcacctgttcaacgcgccgattaaggaggatgagactgctgtcggagttggaacagtgggatcctcggaagcaattatgcttgcaggcctagcattcaagaggaaatggcaaaacaagaggaaggaacaggggaagccgtatgacaaacccaacattgtcaccggtgctaatgttcaggtttgctgggagaagtttgcaagatattttgaagtggagctaaaggaggttaagttatctgaaggatattatgtcatggaccctgtcaaggctgttgacatggtggatgagaacaccatatgtgttgcggctatcttgggatctactctcacaggagagtttgaagatgtcaagcaattgaatgaccttcttactgaaaagaacaaggaaactgggtgggatgtgccgattcatgttgacgctgcgagcggagggttcatagc

SEQ ID NO: 13343 - protein, 252 aa, Panicum virgatum
  misc_feature: Ceres CLONE 1769281
  misc_feature (34)..(252): Pfam Name: Pyridoxal_deC Pfam Description: Pyridoxal-dependent decarboxylase conserved domain
  misc_feature: SWISSPROT Homolog: EC 4.1.1.15 Glutamate decarboxylase
  misc_feature: Useful for making plants with modulated nitrogen use efficiency
MALSHASSIARDDAVACTFASRYVRERLPRYRMPERSIPREAAYQIINDELMLDGNPRLNLASFVTTWMEPECDKLIMGSINKNYVDMDEYPVTTELQNRCVNMIAHLFNAPIKEDETAVGVGTVGSSEAIMLAGLAFKRKWQNKRKEQGKPYDKPNIVTGANVQVCWEKFARYFEVELKEVKLSEGYYVMDPVKAVDMVDENTICVAAILGSTLTGEFEDVKQLNDLLTEKNKETGWDVPIHVDAASGGFI

SEQ ID NO: 13344 - DNA, 1616 bp, Panicum virgatum
  misc_feature: Ceres CLONE 1769283
  misc_feature: Encodes the peptide sequence at SEQ ID NO. 13345
gtgaacccggcctacctcgccttttcttctcccgtccaccccgcgcccgcgctctcctaggcgaaggcgacgacgactgggcgacgcccgcagccgccgctctccacctggtcttcgccggcgacgagcaccaacccgccagatggggagcagcgagaagaccgtcagcgcttatggtgagtacacctatgctgagctggagagggagccctactggccaagtgagaagctgaggatttcgattactggggctggtggtttcattggatcccacattgctcgccgtctcaagagtgagggccattacatcatcgcctctgactggaagaagaatgagcacatgacagaggacatgttctgccatgagttccaccttgttgacctcagggtcatggacaactgtctcaaggttacccaaggcgtcgaccatgtattcaatcttgctgctgatatgggtggcatggggttcatccagtcaaaccactctgtcatcatgtacaacaacaccatgatcagtttcaacatgcttgaggctgcacgcatcaatggtgtgaagaggttcttctatgcctcgagtgcatgcatttaccctgaattcaagcagcttgaaacaaatgtgagcttgaaggaatctgatgcctggcctgctgagcctcaagatgcctatggcttggagaagcttgcaaccgaggagctctgcaagcactacacaaaggactttggcatcgagtgccgcattgggcgtttccacaacatctatggcccctttggaacatggaaaggtggtcgtgagaaggcacctgctgccttctgcagaaaggctcagacatctaccgagaggtttgagatgtggggcgacggactccagacacgatccttcactttcatcgacgagtgtgtcgagggtgttctgaggttgaccaagtctgacttctgcgagccggtgaacatcgggagcgacgagatggtgagcatgaacgagatggccgagatcgtcctgagcttcgaggataggaagctgcccatccaccacatccctggccccgagggggtccgcgggcgcaactccgacaacaccctcatcaaggagaagcttggctgggccccgaccatgaagctcaagaacgggctgaggttcacctacttctggatcaaggagcagatcgagaaggagaagacgcagggggtcgacgtcgcggcgtacgggtcctccaaagtggtgtccacccaggcgcccgtgcagctgggctccctccgcgccgccgacggcaaggagggcctctgaggaggcattgactgaaccgatggtttggttcaggactgcatacggatactgttgaaaagttggacggcggtagagttattgcagcaaccatatataccttttagccccatctggggttagagacgatcgtgttctagcaattcagcgcccccattgatttatttttggtgccatcttgttaattgcatgtgtgtttcttttttttggggggtggggggaataattgcatgtatgtttcactttcactgttgtactcctttggtcatgatgaacagttaaaatccctgtgctttactgtgaatgatacaataaaaatctagatctttccctg

SEQ ID NO: 13345 - protein, 380 aa, Panicum virgatum
  misc_feature: Ceres CLONE 1769283
  misc_feature (32)..(271): Pfam Name: Epimerase Pfam Description: NAD dependent epimerase/dehydratase family
  misc_feature: SWISSPROT Homolog: EC 5.1.3.18 GDP-mannose 3,5-epimerase
MGSSEKTVSAYGEYTYAELEREPYWPSEKLRISITGAGGFIGSHIARRLKSEGHYIIASDWKKNEHMTEDMFCHEFHLVDLRVMDNCLKVTQGVDHVFNLAADMGGMGFIQSNHSVIMYNNTMISFNMLEAARINGVKRFFYASSACIYPEFKQLETNVSLKESDAWPAEPQDAYGLEKLATEELCKHYTKDFGIECRIGRFHNIYGPFGTWKGGREKAPAAFCRKAQTSTERFEMWGDGLQTRSFTFIDECVEGVLRLTKSDFCEPVNIGSDEMVSMNEMAEIVLSFEDRKLPIHHIPGPEGVRGRNSDNTLIKEKLGWAPTMKLKNGLRFTYFWIKEQIEKEKTQGVDVAAYGSSKVVSTQAPVQLGSLRAADGKEGL

SEQ ID NO: 13346 - DNA, 807 bp, Panicum virgatum
  misc_feature: Ceres CLONE 1769296
  misc_feature: Encodes the peptide sequence at SEQ ID NO. 13347
cttcccgccgtcctcgccttctccccttccccgccgaaccccaccgccacctcctcccaccgccgccatgggccgcaagcttcccgccgagcaagcgaaagcggagctacccaggagcagcaaaaaggagaagaagagcaagaaggacaagaagcggaagctcgctgccgaggccgaggccgaggcggcggcggcggcgacggaggaggcggtcgcgaagagcagcaagaagaagcgggcggaggatgggcccggcggcggcggcggaggggaggcggagaacggcgccgagaaggccgtcgcggtgaccgggaagggctccgaggagcccaagtacgcggcgctgcggtcgttctccgccgctgagctgccgtcccaggtgctcgactgctgcaaagcgttcgcgcggccgtcgcccatccaggcgcactcctggccgttcctcctcgacggccgcgatctcatcggcatcgccgccaccggatccgggaagacaattgccttcggtgtgccggcgctgatgcacatcaggaagaaggtaggagggaaaacggggaagaaggccgtgccgcggtgcctcgtgctgtcgccgacgagggagctcgctcagcagattgcagatgtacttagtgaggctggtacaccttgtgggataaattcagtttgcctttatggtggaacttcaaagggaccccaaatagctgcccttaaatcaggagtggatatagtcataggaactcctggtcgtatgaaagaccttattgaaatgggtgtttgcaaccttcatgaagtttcgtttgtggttct

SEQ ID NO: 13347 - protein, 246 aa, Panicum virgatum
  misc_feature: Ceres CLONE 1769296
  misc_feature (116)..(246): Pfam Name: DEAD Pfam Description: DEAD/DEAH box helicase
MGRKLPAEQAKAELPRSSKKEKKSKKDKKRKLAAEAEAEAAAAATEEAVAKSSKKKRAEDGPGGGGGGEAENGAEKAVAVTGKGSEEPKYAALRSFSAAELPSQVLDCCKAFARPSPIQAHSWPFLLDGRDLIGIAATGSGKTIAFGVPALMHIRKKVGGKTGKKAVPRCLVLSPTRELAQQIADVLSEAGTPCGINSVCLYGGTSKGPQIAALKSGVDIVIGTPGRMKDLIEMGVCNLHEVSFVV

SEQ ID NO: 13348 - DNA, 237 bp, Panicum virgatum
  misc_feature: Ceres CLONE 1769304
  misc_feature: Encodes the peptide sequence at SEQ ID NO. 13349
ggggacgcaggcaccggagaaccacacccaagaaaaggaggagaggagcgcacgggagaaggcgaccgacgaccggcccccgaccaccccggcaaggaacgccaagcggagggacgcggccccacacaacgacaccgccaaggaaggagccggcgcgcccagccccccacaagccaggacggagcagggccggggcccgggcagcgcagcgcggaacagaattttgatcgccacacc

SEQ ID NO: 13349 - protein, 78 aa, Panicum virgatum
  misc_feature: Ceres CLONE 1769304
  misc_feature: Useful for making plants with altered oil content
GTQAPENHTQEKEERSAREKATDDRPPTTPARNAKRRDAAPHNDTAKEGAGAPSPPQARTEQGRGPGSAARNRILIAT

SEQ ID NO: 13350 - DNA, 1786 bp, Panicum virgatum
  misc_feature: Ceres CLONE 1769309
  misc_feature: Encodes the peptide sequence at SEQ ID NO. 13351
gctaaaggctaaagctcaccccctccgccccccaacgcgcccgacctcacccaaatccccccacgtccctcccacccctgctccgcggcgttctatggcatacacctcctccctccacctccccaagcacctgctcctgcccaacccccgccggaccaggcacaggtcctcctcctcctccgtctccttcgtccccgccgccgcggccagggccaacggcgtggacgggcgcgcgcccgagaagaagccaccgccgcccaacggcaaggcgcgcatcaacggcgtgaacggcaagaagggggcgaacgggcacgtcaacggcaacaagggggtgaacgggcacgtcaacggcaacaagggcgtcaacgggcacgtcaacggccatgccgaccggatccacctctcggtgagcacgggcggcggcggcgcgggggcacaggacggctccgggctccgcgtggcgttccagggcgcgcccggcgcgtacagcgagttcgcggccaagacggcgctgcccgggtgcgacacggtcccgtgccggaccttcgcggacgcgctggcggccgtggagcggggcgccgccgaccgcgccatcctccccgtggagtccaccatggagggcaccacgctgcggaactacgacctgctgctgcggcacggcctggtggtggcgcaggagatcaacctcttcgtgcactactgcctcctcgccatgccgggggtgcgcgccgccgaggtgcgccgcgtcatcagccacccgatggcgctcgcgcactgcggccgcgcgctggcgcgcctcggggtggaccgcaagcccgtcgaggacaccgccggcgccgtcgaaatgctgcgctccaaccggatgctcgacaccgccgccatcgccagcccgcgcgccgccgacctgtacggcctcgacgtgctcgcgcacggcctccaggacgagtcctggaacgtcacgcgcttcctgctcctctccaggccgccgtcgcccgtcgcgctgcacgtcgacgccgacgccaagaccagcatggtcgtcgcgcaccggggcggctccatgatggtcctgctcaaggtgctctccgccttctcctcccgcaacatcaacctcaccaagctggaggtcatcaacaacgacggcgacgccgccggggccggcgcccgcccgccggtcatgatcctggacacgagcgcccggggcgcgcccacgctgcgcgccttcccgcacgtcctgtacgtcgactgcgcgggcgccgcgcacgacccgcgcgtccgcgaggccatccaggagatcgagaagttcgccgtgttcgtgcgcgtgctcggctgctacgccgccgactccaccatctacgacctgcaatgagggaggggaggaggaagacaggatcgccgtggtgcggatcgggactgctggaatctatagctagttgactggcggcaatctctctgttaaaattgggccaagctatcggatctaccagcactcagtaactagctcaagcgagattagttgtttcgcttgctgctgctgctgcgtaatttttatacatacagatgcaataagaatcttcctattgctgctcgattatattagatgtgtgagtgtttgtgcatagattcaggcttgatgatgatgatgctagctcaagggtgtttgtactaagaagtcctgttggtcatgaccggatcgtttgtaatcttcttgtcctaaaatttcggcgcaagcttttagtttttgtattacagcctcgatcttattacagtgtcagcactggacctttgc

SEQ ID NO: 13351 - protein, 423 aa, Panicum virgatum
  misc_feature: Ceres CLONE 1769309
  misc_feature (122)..(299): Pfam Name: PDT Pfam Description: Prephenate dehydratase
  misc_feature: SWISSPROT Homolog: EC 4.2.1.51 Prephenate dehydratase
MAYTSSLHLPKHLLLPNPRRTRHRSSSSSVSFVPAAAARANGVDGRAPEKKPPPPNGKARINGVNGKKGANGHVNGNKGVNGHVNGNKGVNGHVNGHADRIHLSVSTGGGGAGAQDGSGLRVAFQGAPGAYSEFAAKTALPGCDTVPCRTFADALAAVERGAADRAILPVESTMEGTTLRNYDLLLRHGLVVAQEINLFVHYCLLAMPGVRAAEVRRVISHPMALAHCGRALARLGVDRKPVEDTAGAVEMLRSNRMLDTAAIASPRAADLYGLDVLAHGLQDESWNVTRFLLLSRPPSPVALHVDADAKTSMVVAHRGGSMMVLLKVLSAFSSRNINLTKLEVINNDGDAAGAGARPPVMILDTSARGAPTLRAFPHVLYVDCAGAAHDPRVREAIQEIEKFAVFVRVLGCYAADSTIYDLQ

SEQ ID NO: 13352 - DNA, 465 bp, Panicum virgatum
  misc_feature: Ceres CLONE 1769314
  misc_feature: Encodes the peptide sequence at SEQ ID NO. 13353
  misc_feature (101)..(101): n is a, c, t, g, unknown, or other
cacagcagggcggcggccaggcagagggcggacaccgccgacgccgccgggcggaggccgggaccacgccccgccagcaccgccgccagggaggcggcacnccccgacgcgcccggggcgcagcacgccgccagggccaccggagagaacgcggcaagggcgcccgcagaggccaagcacaagggggcgagcaacgggcgcttttttttcggccggaaccgccgccggggcgggcacggccgcaaggaccccccgctcgatgtcgccgccgccaacgacagcggaggcgtcaagaacgcgtcccacctcctcaagtacgactcgacgcacggcaccaacaaggccgacgtcaagatcgtcgacgacaccaccatcagcgacgacggcaagctcatcaccgtcgtctccaacagggacccgctcaagctcccatgggccgagctcggaatcgacattgccatcgag

SEQ ID NO: 13353 - protein, 154 aa, Panicum virgatum
  misc_feature: Ceres CLONE 1769314
  misc_feature (71)..(154): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
  misc_feature (34)..(34): Xaa is any aa, unknown, or other
HSRAAARQRADTADAAGRRPGPRPASTAAREAAXPDAPGAQHAARATGENAARAPAEAKHKGASNGRFFFGRNRRRGGHGRKDPPLDVAAANDSGGVKNASHLLKYDSTHGTNKADVKIVDDTTISDDGKLITVVSNRDPLKLPWAELGIDIAI

SEQ ID NO: 13354 - DNA, 1621 bp, Panicum virgatum
  misc_feature: Ceres CLONE 1769315
  misc_feature: Encodes the peptide sequence at SEQ ID NO. 13355
atccctacccgcgggacgccggagcagggggcagcgtcgcactcccgcggcccgcggagccaccccgcgcgatccgggcggcggcgctccccctggctcccgcgggccaccggagcagcggcgcagtcccgcgcggccggacagcggaggagctcaccctcagagcagggcccagcgcggcgggtggcagagctcgcccgcgagcgcggtcggcggcgctcctccacacttaaaaaaagaagatacagaggtcgagccggctcctttgcagccgaaaaaaaataggatcacgacgagcagttttcggcgcctcgctcggtggacggcggcacctcttctgtcttcactgcagcatcaactcctggagctcatggccgccaccgcccacggctggatcaagcgtctcatggaggtcggcgagaacgcgacgtagtggtcacaactcggaaggatccaaagacgataagcccgaccgcttcttcggagacggaaccatggcgacagcgggtgagatcgcggcggtgggcgtgatcggcgcggggcagatgggctcggggatcgcccagctcgcagccgccgccggctgcgccgtcctcctcctcgacgccgactccgccgccctctcccgcgccgttgcctccatctccgcctcgctccgccgcctcgccgccaagggccagctctcccaggcagcgtgcgaagactccatcaagcggatacggtgcgtctccaccgtgcaagatctcagggacgcggatcttgtgattgaggccatcgttgagaacgaagatgtcaagaagaagctgtttgtggagctggataagatcacgaagccctccgccattctagcgtccaacactagctccatctccataacccgcctggcttcagctaccaaacgcccctctcaggtcataggcatgcacttctttaaccctcctccgataatgaaattgatcgagattatccgaggagctgatacctcagatgaggtgtttgctgcagtcaaatctttttccgagaggctcgggaagactgtcatatgctcacaagattacccaggattcattgtgaaccgcattctcatgccgatgatcaatgaggctttctgggcgctgtacaccggagtggccacccaagaggacattgacaccgggatgaagctgggaaccaaccatccaatgggtccgctgcagctcgccgatttcattgggttggacgtctgcctttcagttcttcgggtacttcataatggcctgggagataacaagtacagcccttgccctcttctcgttcaatatgttgatgctggccggcttgggaagaagcgaggagtaggtgtatattcatatggacagaaatcttcatccgtcaagccaaagtcgtctctgtaaacaccatagcaactgttgagcaaataaaagcatacggatgttattttgtatgtccagggaaaaatttacacactacagcagttcaaaagtacagtgagcacttccaagtcgttcaaatcacaatgataggcttatacagacttttgctgctctatctagaaaaatggttctctggttcaaactaatatgtggaagtcgtgaaatttgcattattcaagagatctggc

SEQ ID NO: 13355 - protein, 299 aa, Panicum virgatum
  misc_feature: Ceres CLONE 1769315
  misc_feature (9)..(188): Pfam Name: 3HCDH_N Pfam Description: 3-hydroxyacyl-CoA dehydrogenase, NAD binding domain
  misc_feature (190)..(286): Pfam Name: 3HCDH Pfam Description: 3-hydroxyacyl-CoA dehydrogenase, C-terminal domain
  misc_feature: SWISSPROT Homolog: EC 1.1.1.157 3-hydroxybutyryl-CoA dehydrogenase
MATAGEIAAVGVIGAGQMGSGIAQLAAAAGCAVLLLDADSAALSRAVASISASLRRLAAKGQLSQAACEDSIKRIRCVSTVQDLRDADLVIEAIVENEDVKKKLFVELDKITKPSAILASNTSSISITRLASATKRPSQVIGMHFFNPPPIMKLIEIIRGADTSDEVFAAVKSFSERLGKTVICSQDYPGFIVNRILMPMINEAFWALYTGVATQEDIDTGMKLGTNHPMGPLQLADFIGLDVCLSVLRVLHNGLGDNKYSPCPLLVQYVDAGRLGKKRGVGVYSYGQKSSSVKPKSSL

SEQ ID NO: 13356 - DNA, 653 bp, Panicum virgatum
  misc_feature: Ceres CLONE 1769334-R
  misc_feature: Encodes the peptide sequence at SEQ ID NO. 13357
ggttcatctgggttctgcgcgacgccgaccgcggcaacgtgttcgcggactccggcgagagccggcacgccaagttcatgtccgagttcaccaagcagacggagggaacagggctgctgatcaccgactgggcgccgcagctggagatccttgcccaccccgccacggcggcgttcctgagccactgcggctggaactccaccatggagagcatgagctacgggaagcccatcctggcgtggcccatgcactcggaccaggcgtgggacgccgagctggtgtgcaagtacctcaagaccggcttcctggtgaggccatgtgagaagcacgccgaggtgattccggcggcagacatacgggaggtgatcgagaagattttagtctccgaggaagggctcgcggtgcggcagcgtgcagtggcgctcggcgaggctgtccgcgcgtccgtggctacgggcgggtcatcccaaaaggaactcgaggacttcgttgctcacatcacaaggtaagaggtccaagaatggcaggaacgtttggtgtatcactttgaatttcaattctatttctttcctgaaaagaagctggagagtgttctgtacaagtggtaactagaaaataaacgattgtaccaaataaatttgagctccggtttc

SEQ ID NO: 13357 - protein, 168 aa, Panicum virgatum
  misc_feature: Ceres CLONE 1769334-R
  misc_feature: SWISSPROT Homolog: EC 2.4.1.215 Cis-zeatin O-beta-D-glucosyltransferase
  misc_feature: The sequence is a functional homolog of SEQ ID NO 8 in US patent 7148405
FIWVLRDADRGNVFADSGESRHAKFMSEFTKQTEGTGLLITDWAPQLEILAHPATAAFLSHCGWNSTMESMSYGKPILAWPMHSDQAWDAELVCKYLKTGFLVRPCEKHAEVIPAADIREVIEKILVSEEGLAVRQRAVALGEAVRASVATGGSSQKELEDFVAHITR

SEQ ID NO: 13358 - DNA, 147 bp, Panicum virgatum
  misc_feature: Ceres CLONE 1769334
ccggcgcagggccaccggaaccagcggccgcacccgccgccgcaccccgccccgcgcggcccgcccgagcaccgcgcggcgcccgcggagcacgcccgccaggccaaggcgcgccgccacggcaggggcgccaacgcccgccgcggc

SEQ ID NO: 13359 - DNA, 601 bp, Panicum virgatum
  misc_feature: Ceres CLONE 1769338
  misc_feature: Encodes the peptide sequence at SEQ ID NO. 13360
  misc_feature (74)..(74): n is a, c, t, g, unknown, or other
  misc_feature (112)..(112): n is a, c, t, g, unknown, or other
  misc_feature (146)..(146): n is a, c, t, g, unknown, or other
  misc_feature (244)..(244): n is a, c, t, g, unknown, or other
cgccgcgccaccgccccccacccgcgaggagaacgaaggccgggggcgagagggggcgagacaagacccggcgnccccccggcagccgccaccgccggcagcggcgggggcnggcgacgcccacccccaccggcgccaccaacgangacagccgcgccggggacgccgcgccggggccccgcccgaacgaggccccccccccacgccgccaggacaagacccccgaccgccattccatcgaccncaacgagacaggaacgaagctgaagcacatgcccggggcgattcaaggcgggaagggccttgagcacgactgcggggtgcaccgggggatcggctacttcctcgagccgctcatactgctcggcttgttcgcgaaggcgcccatatcgattcggctgaaaggaatcactaatgatacaaaggacccttctgtggatactttccggatgacaaccttgcatatgctcaagcattttggtgttcctttggagggtttggagctaaagattgatagccgaggatctcctccccttggcggtggtgaagtgttcctccgagttcccaatataaatagcacactaacggcagcaaactgggt

SEQ ID NO: 13360 - protein, 199 aa, Panicum virgatum
  misc_feature: Ceres CLONE 1769338
  misc_feature (50)..(198): Pfam Name: RTC Pfam Description: RNA 3'-terminal phosphate cyclase
  misc_feature: SWISSPROT Homolog: EC 6.5.1.4 RNA-3'-phosphate cyclase
  misc_feature (37)..(37): Xaa is any aa, unknown, or other
  misc_feature (48)..(48): Xaa is any aa, unknown, or other
  misc_feature (81)..(81): Xaa is any aa, unknown, or other
PRHRPPPARRTKAGGERGRDKTRRPPGSRHRRQRRGXATPTPTGATNXDSRAGDAAPGPRPNEAPPPRRQDKTPDRHSIDXNETGTKLKHMPGAIQGGKGLEHDCGVHRGIGYFLEPLILLGLFAKAPISIRLKGITNDTKDPSVDTFRMTTLHMLKHFGVPLEGLELKIDSRGSPPLGGGEVFLRVPNINSTLTAANW

SEQ ID NO: 13361 - DNA, 815 bp, Panicum virgatum
  misc_feature: Ceres CLONE 1769344
  misc_feature: Encodes the peptide sequence at SEQ ID NO. 13362
gtgatcagatcgagcgcaggccagactcgattcgattcgagcccccgcggccggaaggattcggaatctcgcgggccagaggaggaacccccgtaggcgaatcggcgatccagcccacctcgccgcggtacttcttctcctcgctggccgcggcctccgccgccgcgtcctccccgcaccgccgcatcggcatcgccgtcgacctctccgacgagtccgccttcgccgtcaagtgggccgtccagaactacctccgccccggggacgccgtcgtgctgctgcacgtccgccccacctccgtgctctacggcgccgactggggctccatcccggtctccgtcgacgacgaccccgacgccgacatcgccgagggcgcggcgcgcgccgcggcctccgaggagcccgaggaggccaagaagaagcgggaggaggacttcgacgccttcacctccaccaaggcgcaggacctcgcgcagccgctcgtcgttgcgcagatccccttcaagatccacatcgtcaaggaccacgacatgaaggagcgcctctgcctcgaggccgagcgcctcggcctgtccgccttgatcatgggcagccgcggcttcggcgcctcgcgcagggtcgggaaagggaggctcgggagcgtcagtgactactgcgtgcaccactgcgtctgccctgtggtggttatgcgctacccggatgatgctgcgggagctggtgctggcgacgccttcggggatgagctgcgcccggtgcctgaaaatgagcctgtgtatcatgaggcaccagaggcgcagaaaggtccgcccctttgc

SEQ ID NO: 13362 - protein, 270 aa, Panicum virgatum
  misc_feature: Ceres CLONE 1769344
  misc_feature (58)..(230): Pfam Name: Usp Pfam Description: Universal stress protein family
DQIERRPDSIRFEPPRPEGFGISRARGGTPVGESAIQPTSPRYFFSSLAAASAAASSPHRRIGIAVDLSDESAFAVKWAVQNYLRPGDAVVLLHVRPTSVLYGADWGSIPVSVDDDPDADIAEGAARAAASEEPEEAKKKREEDFDAFTSTKAQDLAQPLVVAQIPFKIHIVKDHDMKERLCLEAERLGLSALIMGSRGFGASRRVGKGRLGSVSDYCVHHCVCPVVVMRYPDDAAGAGAGDAFGDELRPVPENEPVYHEAPEAQKGPPL

SEQ ID NO: 13363 - DNA, 812 bp, Panicum virgatum
  misc_feature: Ceres CLONE 1769345
  misc_feature: Encodes the peptide sequence at SEQ ID NO. 13364
ccacacatccgtccgcttcttctcccctcctgccggtcccgaataaagagcagcagcgcaaggtgagcgccacctcgccgcttccctctcgttcgatcgccgtgcttctcgctagaggttggtggagtaatttaccccagaacaattaggcagcagcaatggcggcggagagcttcctcttcacctccgagtccgtgaacaaggggcaccccgacaagctgtgcgaccaggtgtcggacgccgtcctggacgcgtgcctggcgcaggaccccgacagcaaggtggcctgcgagacctgcaccaagacaaacatggtgatggtgttcggcgagatcaccaccaaggccaccgtcgactacgagaagatcgtgcgcgacacctgccgcgagatcggcttcacctccgacgacgtgggcctcgacgccgaccgctgcaaggtgctcgtcaacatcgaacagcagtcccccgacatcgcgcagggcgtgcacggccacttcaccaagcgccccgaggagatcggcgccggcgaccagggccacatgttcggctacgccaccgacgagacccccgagctgatgccgctcagccacgtgctcgccaccaagctcggcgcgcgcctcaccgaggtccgcaagaacggcacctgcgcctggctcaggcccgacggcaagacccaggtcaccgtcgagtacctcaacgagggcggcgccatggtccccgtccgcgtccacaccgtcctcatctccacccagcacgacgagaccgtcaccaacgacgagatcgccgccgacctcaaggagcacgtcatcaag

SEQ ID NO: 13364 - protein, 217 aa, Panicum virgatum
  misc_feature: Ceres CLONE 1769345
  misc_feature (118)..(217): Pfam Name: S-AdoMet_synt_M Pfam Description: S-adenosylmethionine synthetase, central domain
  misc_feature (4)..(103): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
MAAESFLFTSESVNKGHPDKLCDQVSDAVLDACLAQDPDSKVACETCTKTNMVMVFGEITTKATVDYEKIVRDTCREIGFTSDDVGLDADRCKVLVNIEQQSPDIAQGVHGHFTKRPEEIGAGDQGHMFGYATDETPELMPLSHVLATKLGARLTEVRKNGTCAWLRPDGKTQVTVEYLNEGGAMVPVRVHTVLISTQHDETVTNDEIAADLKEHVI

SEQ ID NO: 13365 - DNA, 585 bp, Panicum virgatum
  misc_feature: Ceres CLONE 1769345-R
  misc_feature: Encodes the peptide sequence at SEQ ID NO. 13366
atccccgacaaggagattctcaagatcgtcaaggagaacttcgacttcaggccggggatgatcaccatcaacctcgacctcaagaagggcggcaacaggttcatcaagaccgccgcctatggccacttcgggcgtgacgacgccgacttcacctgggaggtggtgaagcccctcaagttcgaaaaggcatcagcttagagatcgaagaggacgttgagtgtcttgtctccgtgctatcatctactacctcttgctgctgatgttacctgcaagcattgctgctgctgctgctgctcctgctcctggatgtgtgtctgatcagtgactggctgcttccttagaagatgatgcagagaagatgaacaagaaggcttcggcaatcgccgcagcaagccatgtcgccggtggcggcttagtgattgggtaaaatttggtgtggcagccaggattacgcgctgatcttaccttgactagtttggtcgtccggtatcttttttttcgtcctttctccccgccctttttcgggtcgtactgaaactgctgagagatttgcagttttgatctatcccacttcgtatgtcactg

SEQ ID NO: 13366 - protein, 65 aa, Panicum virgatum
  misc_feature: Ceres CLONE 1769345-R
  misc_feature: SWISSPROT Homolog: EC 2.5.1.6 Methionine adenosyltransferase
  misc_feature: Useful for making plants with modulated biomass
IPDKEILKIVKENFDFRPGMITINLDLKKGGNRFIKTAAYGHFGRDDADFTWEVVKPLKFEKASA

SEQ ID NO: 13367 - DNA, 798 bp, Panicum virgatum
  misc_feature: Ceres CLONE 1769349
  misc_feature: Encodes the peptide sequence at SEQ ID NO. 13368
tttggggggtcttggtaggtgtggtgtgcacgggagttggggcttcgttgctttgcttcgctcgtgcgcaagggagagagagaagagggaggagtaagcgaggaggcagatggcgtcgaagcggatcctcaaggagctcaaggacctgcagaaggatcctcccacctcctgcagcgcaggcccagtcgcggaagatatgttccactggcaagcaacgattatgggtccatcggatagcccatacgctggcggcgtctttttggtcacaattcacttccctccagactacccattcaaaccgcccaaggtacacagttttctaggagaagtacataagatcactgcccatttcaggctgtgtttagatccgtaaaatagtggtaaaaaaggttacatcggatactatggcacactgtagcacttttcgtttatttgtgataattgttgtcctaccatgacctaactaggctcaaaagattcgtctcatcgtgtacatcaaaactatacaattagtttttttatttacctacatttaatgctccatgcatgaggtaagagatttgatgtgataggtgaatagtgaaatttggagagagaaattttggaactaaacacagcctcagtttcaattagttttcttctgtttatgactgtcaactcttatgagtagttactggacgcccatttctgtaccacaagttgtccatatagattctagatccccattggaattagtgacaaggaatggtgtgtgccagtttggaactggccccgtttatgttctgcttgtgaacaaat

SEQ ID NO: 13368 - protein, 87 aa, Panicum virgatum
  misc_feature: Ceres CLONE 1769349
  misc_feature (5)..(83): Pfam Name: UQ_con Pfam Description: Ubiquitin-conjugating enzyme
  misc_feature: SWISSPROT Homolog: EC 6.3.2.19 Ubiquitin--protein ligase
  misc_feature: Useful for biocontainment applications
  misc_feature: Useful for making plants with modulated light quality sensitivity
  misc_feature: Useful for making plants with modulated low light sensitivity
MASKRILKELKDLQKDPPTSCSAGPVAEDMFHWQATIMGPSDSPYAGGVFLVTIHFPPDYPFKPPKVHSFLGEVHKITAHFRLCLDP

SEQ ID NO: 13369 - DNA, 1488 bp, Panicum virgatum
  misc_feature: Ceres CLONE 1769359
  misc_feature: Encodes the peptide sequence at SEQ ID NO. 13370
actgcacatcgcttcgcactgttccttctatagctagctttgcttgctgctgaccggattcttcatcgatcgtcacctagctatctagctagtagctagctgaaagcgctagctcgatcgagagaggaagaaatccataattaaacaagcagcaagcaacctgctgcagccagcgatcgagacgatgatcgggtggggcgacgtgtacaaggtggtggcggcgacggtgccgctctacttcgcgctgttcctggggtacgggtccgtgcggtggtggcgcatcttcacgcgggagcagtgcgacgccgtgaaccgcctggtggccttcttcgcgctgcccttcttcaccttcgagttcacgctgcacacggacccgttccaggtcaactaccgcgccgtcgccgccgacgtcatctccaaggcggtcatcgtcgccgtcatcgcctgctgggccaggttcgccgccgccaagggcgccggctgcgccgtcggctggtccatcaccagcttctccctctccacgctcaccaactcgctcgtcgtcggcgtgcccatggcccgggccatgtacggcgagtgggcccagcagctcgtcgtccagctctccgtcttccaggccatcgtctggctcacgctcctgctcttcgtgctcgaggtcaggaaggccgccatcggcatgtacgtcgccgccgcagacgactcctcggcggccgtcaaggacgtcgaggccgccgccggtgccgccgtgcccgtctccatcgtcggcggcaagccgtcgctctgggcgctcgtcaaggtggtggcgcacaagctgtcgcgcaaccccaacacgtacgccagcttcgtcggcatcacctgggcctgcgtcgccaacaggctgcacatcgagctgcccagcgccttcgaaggctcggtgctcatcatgtccaagtcaggcacaggaatggccatgttcagcatggggttgttcatggcgcagcaggagaaggtgctggcgtgcgggccgtgctttgcggcgctgggcctcgtgctcaagttcgcgctcggcccggccgccatggccatcggctccatcgccgtcggcctccgcggcgacgtcctccgcgtcgccatcatacaggctgcactacctcaatccatcacatcatttatattcgcaaaagaatatgggttgcatgctgatgttctcagtactgcggttatttttgggatgcttgtctccttgccgttgctagttggattttatattgttttagagttaattagatagacaagggtgcacagtgttaagcctactgatgaaactcgttcttcccttgaagctggccaaacatgcatactgacaacaagttctaagaaatgtctgctgctttctttcctcattgcacaaaactgcaaagggagttattgagtaatatcaaatatgttttgacatgtattatgtacgaagaatgcttattcattctgttactaaaatgaatgtgtagc

SEQ ID NO: 13370 - protein, 361 aa, Panicum virgatum
  misc_feature: Ceres CLONE 1769359
  misc_feature (9)..(354): Pfam Name: Mem_trans Pfam Description: Membrane transport protein
MIGWGDVYKVVAATVPLYFALFLGYGSVRWWRIFTREQCDAVNRLVAFFALPFFTFEFTLHTDPFQVNYRAVAADVISKAVIVAVIACWARFAAAKGAGCAVGWSITSFSLSTLTNSLVVGVPMARAMYGEWAQQLVVQLSVFQAIVWLTLLLFVLEVRKAAIGMYVAAADDSSAAVKDVEAAAGAAVPVSIVGGKPSLWALVKVVAHKLSRNPNTYASFVGITWACVANRLHIELPSAFEGSVLIMSKSGTGMAMFSMGLFMAQQEKVLACGPCFAALGLVLKFALGPAAMAIGSIAVGLRGDVLRVAIIQAALPQSITSFIFAKEYGLHADVLSTAVIFGMLVSLPLLVGFYIVLELIR

SEQ ID NO: 13371 - DNA, 803 bp, Panicum virgatum
  misc_feature: Ceres CLONE 1769360
  misc_feature: Encodes the peptide sequence at SEQ ID NO. 13372
agcggcagcggccacacccccacatggtttggccgcccgcttcctcctcaacgcgctgctcctcctccttgccgccgccgcgccgtcccatggcctcacccaagctgatgttgcgaagcgattgaaggaggagctgtcagagaggaaccgagagaatgagatgctcaagtcatggaatggggacccgtgttccctttcaacctgggaaggattttcttgcgaacccaaggatggcgcccgtgtcgtcgtcaagctgaacttttcttcgaagaatttgcaaggccagattccagcagcgattgggaacttaacagacctaactgaaattgatctgcaggtcaataatttcactggatctattccggcatccttttccgctctcaaacacctgcgcaatctgtcagtgaagtgcaaccccttcctaagcaaccagctacctgatggtttgtcaactggggtggatttcagccatggagcctgtgctgctgaagagtacgaaagcccacctggagttgctagtcagagagtaattgttatcggcggtgttgcctgtggatctttggcatgcacttttgctcttggatttctatttatttgttttaacaaacgtgaacgacgttctccagaaaaagactgctcatctacaacaaatcccatttttcaagaatgtggcatccataacactgcaaatcctacagtgcaacagttctccctcaaatctatccagactgcaacaggcaacttcaaaacattgataggagagggtgggtttggagcagtttatcaaggtacattaccgcatg

SEQ ID NO: 13372 - protein, 267 aa, Panicum virgatum
  misc_feature: Ceres CLONE 1769360
  misc_feature: SWISSPROT Homolog: EC 2.7.11.1 Non-specific serine/threonine protein kinase
AAAATPPHGLAARFLLNALLLLLAAAAPSHGLTQADVAKRLKEELSERNRENEMLKSWNGDPCSLSTWEGFSCEPKDGARVVVKLNFSSKNLQGQIPAAIGNLTDLTEIDLQVNNFTGSIPASFSALKHLRNLSVKCNPFLSNQLPDGLSTGVDFSHGACAAEEYESPPGVASQRVIVIGGVACGSLACTFALGFLFICFNKRERRSPEKDCSSTTNPIFQECGIHNTANPTVQQFSLKSIQTATGNFKTLIGEGGFGAVYQGTLPH

SEQ ID NO: 13373 - DNA, 645 bp, Panicum virgatum
  misc_feature: Ceres CLONE 1769360-R
  misc_feature: Encodes the peptide sequence at SEQ ID NO. 13374
agtgggaattctttattctgggctggactcgtccgcgttgatgttgtcaaggctcttccacgcacacgactgacattctatggacccaagaagctaaaggttaatgtagtcccaaccacagaagcagatcaattttacaagactgaagttggagtgacactgactcccccaactggcacggagagagctgaaggatgggcggggctgcagggtgttcgcgagttgaagataaaatatgaagaacttgatagacctgcttgtgacatatcgatctctgggctcgggtggatttctgtggagccattaggtgtgccatcaaacagcacggatagcaatggcaatgtcgatggtgagctgcacccgatagtccatgtccccaaaccagttgaggtcttcgtccgtcccccattgcctgtcggtaaagcagcatcgcaatggtaccggtatcaggagctgacagagcaagaagaggaattaacacctaaatggccttactgacactgctcccccttccctcttcttgtagttgtatcttgcgtacgctactagtacaattctgcgtagtcccaattcagtaaaaagttatcctctcatgtgatgttaggacaacttacgtaaaaaccacaatggatatttagtattcag

SEQ ID NO: 13374 - protein, 165 aa, Panicum virgatum
  misc_feature: Ceres CLONE 1769360-R
  misc_feature: SWISSPROT Homolog: EC 1.14.13.39 Nitric-oxide synthase
  misc_feature: Useful for making plants with modulated flowering time
SGNSLFWAGLVRVDVVKALPRTRLTFYGPKKLKVNVVPTTEADQFYKTEVGVTLTPPTGTERAEGWAGLQGVRELKIKYEELDRPACDISISGLGWISVEPLGVPSNSTDSNGNVDGELHPIVHVPKPVEVFVRPPLPVGKAASQWYRYQELTEQEEELTPKWPY

SEQ ID NO: 13375 - DNA, 1755 bp, Panicum virgatum
  misc_feature: Ceres CLONE 1769361
  misc_feature: Encodes the peptide sequence at SEQ ID NO. 13376
aggcttccagcccagccgccctctcctgtcttccactctccactcggccttcttctccatcggccagctcgaaatcgtccgcccgtcctccggctatccgcctcaccattctcggccgcctcgtaaaccctccgctctccgccccgcacgaaccggggcggaaccaatccaaaaccctacctacgtgaccccgcatcccgtacccctcgcgcaagccgcgccatgttccgcgtcgcgaggtcgcgcctcctccccaggatctccgcgctctccttctgcactgcctcccctgcagccgccgccgcctcctcctcctccactcctccggtggctgctgctgccgccgccgccgcctccgcctccgaggcttcgtccacctctggagacccatcatcccagcagcccccggtggcccgaaagccatggggcacgctcaaggtcgcagccttcgcggccgtgttcgccgcggtcggtgccacaggctacgccagctacgcttattctctagaggaattggatcagatgacacgggagttccggaagaaatcgaagcatcccattcctgaagactcgtccggcttcgagaagtttcaggctatggcttattcagcagctatgaaagctcctgttgccgctattgagctatacctggatgtcaggagccaaattgaagatcaaattcggggctttagtgaaccagtatcagacaaactccttccagatcgtcctcctcaagaacagcatgtattgaccctagttctggatctcaacgagactcttgtatactcagattggaagcgtgagagaggatggaggacttttaagaggccaggagtggaggcctttttggaacatcttgggaagttttatgaaattgttgtgtattctgatcagcttagtatgtatgttgatcctgtcgttgataggctggatccgaagggaaatattcggcacaggctatcaagagttgcaactaaatacgaaaatggaaaacattatcgggatttatcgaagctgaacagaaatcctgctcaagttatttatgtcagtgctcatgctttggagtcaagtctgcagcctgaaaattctgtgcaaattaaaccttggaagcttgaaaatgatgacactcaactgcttgatctcattccatttctagaatatgttgctatggcaagacctcctgacatcagggctgttcttgcatcctatcaaggtagtgacattgctgctgagtttattgagcgctctaaggaacaccaaaggcgcatgcaagaacaaaagcattcaggacgcatatggcggcgatgatgactaaatagtctacatacttctatagacacatcaaacttttggcgcttcaatccaaatgaagagaatgaatccatcgtccatggattaatatttgtcaacttttggagatatcacccttgaacatttttaataaatgtttacattttgatgggtgtcttacagagatcaaacgttaccttttcagtttttttttttggctagaacctttccagaattcttggccaacgttttgaaagtatctttatggcagattcacttgaattagttttagattagtagaagctagtattatctgttcaacaaatctactgcacgcattctatgctggccttctttgactggtgagattgcaaatattcctgtggattgttgcaatcttgtgaaacgtactagctgaactgcaaaaataatgactggtggatgagttgaaaccgttttgtgggt

SEQ ID NO: 13376 - protein, 361 aa, Panicum virgatum
  misc_feature: Ceres CLONE 1769361
  misc_feature (167)..(328): Pfam Name: NIF Pfam Description: NLI interacting factor-like phosphatase
  misc_feature: SWISSPROT Homolog: EC 3.1.3.16 Phosphoprotein phosphatase
MFRVARSRLLPRISALSFCTASPAAAAASSSSTPPVAAAAAAAASASEASSTSGDPSSQQPPVARKPWGTLKVAAFAAVFAAVGATGYASYAYSLEELDQMTREFRKKSKHPIPEDSSGFEKFQAMAYSAAMKAPVAAIELYLDVRSQIEDQIRGFSEPVSDKLLPDRPPQEQHVLTLVLDLNETLVYSDWKRERGWRTFKRPGVEAFLEHLGKFYEIVVYSDQLSMYVDPVVDRLDPKGNIRHRLSRVATKYENGKHYRDLSKLNRNPAQVIYVSAHALESSLQPENSVQIKPWKLENDDTQLLDLIPFLEYVAMARPPDIRAVLASYQGSDIAAEFIERSKEHQRRMQEQKHSGRIWRR

SEQ ID NO: 13377 - DNA, 1601 bp, Panicum virgatum
  misc_feature: Ceres CLONE 1769370
  misc_feature: Encodes the peptide sequence at SEQ ID NO. 13378
ccgacccggggttccaagatgaggagcggcagcgggggtgcttcgccctggaggcggagcgaccccggcggcagcggagagctgtcccgcgtctccgtcgccaccacggcgtcgtccgtctccgagcgttccgtgagcggtgccgggcgcggggtctccttcctcgacgccttccgctcctgcttcgtgcccccggaggcgcgctcgccggagacctccatgtccgacgacttccacccctcccaccaactctcgcactcggtgagctcacaaggttctaacagtgggagcactttcgggagcaagcgatcaattaaaggaatgtatagtcccatgcataggaactcttcagagagggagatgcctggcagcacaaaattctccttgccgcagatccagaaagcaaccaagaacttctcaccaaacttgaagattggccagggtggttctgggactgtatacaagggtcagcttgctgatggtaccctcgtcgctgtcaaacgggccaagaagaatgtgtatgacaagcatatgggccgtgagttctggaacgagattgagacattacaacgcattgagcacctgaatttggtcaggtttcatgggtacctggagtttggtggcgagcagttgatcattgtggagtatattcccaatgggaatcttcgagagcaccttgactgtgtcaatggtaaagtattggaattctcacagagattggaaattgcaattgatgtggctcatgctattacatatcttcatacctactcggaccatccagtcatccacagggacatcaaatcctcaaacattcttctaatgaacaattttcgagccaaggttgctgactttgggtttgccaaactggctccaactgacgctagccatgtctctactcaagtcaaaggaacagcaggctatcttgatccagaatatctcagaacataccagctcaatgagaagagtgatgtctactcctttggggttctgctggtggagttggttactgggaggcgccctatagagccgaagagatccatcattgagcgtgttaccgccaaatggtcaatggagaaatttgtggagggcaatgctatccaaacactggattcgaatctggaagcaaacgacgctatcaatctggcagtcgagaagatgtacgagctggctctgcaatgcttagctccaacaaagaggaaccgaccgagcatgaggagatgcgcggagattctgtggagcatacgtaaagattacagggagttggttgtacccacctcggccatgaactgaagcagctcacctggagcaatcaagcgaacaaaagatgcattccagtttacctctctacaaagattttggtggtgggaatcacgcaaacgctttgctgcgagtagctgtgaacgggactggtgggcctccctagatgttgtgtgtcttctactagtaactaggcaaccagaaaaaaatctcttcttacaagtcttactatacagtatgaaaatgtttctgagcaaacatgtatgaatacgagtatatagtggtatgtgtatcctgtaggttttcttatacaggtggatatatgaagaatcttgttttccccg

SEQ ID NO: 13378 - protein, 423 aa, Panicum virgatum
  misc_feature: Ceres CLONE 1769370
  misc_feature (133)..(408): Pfam Name: Pkinase Pfam Description: Protein kinase domain
  misc_feature: SWISSPROT Homolog: EC 2.7.11.1 Non-specific serine/threonine protein kinase
MRSGSGGASPWRRSDPGGSGELSRVSVATTASSVSERSVSGAGRGVSFLDAFRSCFVPPEARSPETSMSDDFHPSHQLSHSVSSQGSNSGSTFGSKRSIKGMYSPMHRNSSEREMPGSTKFSLPQIQKATKNFSPNLKIGQGGSGTVYKGQLADGTLVAVKRAKKNVYDKHMGREFWNEIETLQRIEHLNLVRFHGYLEFGGEQLIIVEYIPNGNLREHLDCVNGKVLEFSQRLEIAIDVAHAITYLHTYSDHPVIHRDIKSSNILLMNNFRAKVADFGFAKLAPTDASHVSTQVKGTAGYLDPEYLRTYQLNEKSDVYSFGVLLVELVTGRRPIEPKRSIIERVTAKWSMEKFVEGNAIQTLDSNLEANDAINLAVEKMYELALQCLAPTKRNRPSMRRCAEILWSIRKDYRELVVPTSAMN

SEQ ID NO: 13379 - DNA, 2215 bp, Panicum virgatum
  misc_feature: Ceres CLONE 1769391
  misc_feature: Encodes the peptide sequence at SEQ ID NO. 13380
aatattgcgatcgtggtgtgagctttaactaccctttcccacccgccgctagggtttctcctctcttttttccccctcctccccgctcccccttcaatcccccgacgccggctagggttttgcctcatcccctccgccgccaccgccggcgctggagcgagcgagaccgagggggtagggagcgagcggagcgtaggcagccatgtcgctgcgcccgagcgagcgggtcgaggtgcggcggaaccgctacaaggtggcggtggacgcggaggaggggcggcggcggcgcgaggacaacatggtggagctccgcaagaaccgccgcgaggagagcctcctcaagaagcgccgcgaggggctccaggcccaggtccccgtccccgcctccggggtcgagaagaagcttgaaagcctcccagctatggttagtggggtttattcggacgacaacaaccttcagcttgaggccacaacacaattccgcaagttgctctccatagagaggagccccccgattgaggaagttattcagtcaggtgttgttcctagatttgtgcagttcctcaccagagaggatttccctcaactgcagtttgaagcagcatgggcacttacaaatattgcttctggcacttcggaaaatacgaaggttgtcattgatcatggggctgttccgatatttgtgaaacttcttcagtctgctagtgatgatgttcgtgagcaggctgtatgggctttgggcaatgttgctggtgattctccaaagtgccgcgaccttgttctcgccaatggtgccttgatgcctctgctagcccagttaaatgagcatgctaagctctccatgttgaggaatgctacatggactctgtcaaacttctgcaggggaaagccgcagccatcatttgatcagactaagcctgctcttccagcacttgcacgacttatccactccaatgatgaggaagttctcactgatgcatgctgggctctttcatacttatctgatggcactaatgacaaaatccaagctgtgattgaagctggtgtgtgtccccgccttgtggagctcctcctccatccatcaccttcggtgcttatacctgctctacgaactgttggaaacattgtcactggagatgatttgcaaactcagtgcatcattgatcatcaagctcttccctgccttctgaatctattgacacagaaccataagaaaagtattaagaaagaggcttgctggacaatttcaaatattactgctggaaacaaagatcagatacaggctgtgattagtggtggaattatcgctcctttattgcatctactccaaacagcagagtttgatattaagaaagaggctgcttgggctatctcaaatgctacctcaggtggttcccacgagcaaatcaagtatttggtgtctgagggctgcatcaagccattgtgcgaccttcttgtttgccctgatccaagaattgtaacagtgtgtttggagggtcttgagaatattctcaaagtgggtgagcatgacaaggccgcaggtgcaacaggtgacatcaatgtctttgctcagatgatcgatgaagctgaaggcctggagaagattgagaacctacagagccatgataacaatgaaatctatgaaaaggctgtgaagcttcttgaggcatactggatggaggaggaagatgaggcaatggctactgctggggaagctgctcctgctgtttttgactttggccaaggtggcaaccctcccgctggtggtggtttgaacttcaattaagtacagtctttttaccaaagggtggtaataccctcagtgatggcttgtcatgattagtcaatgtagtcagtttggttccatgttcgggatgatggctgtggtggggtccaataagcttgagatttcgatggagctgggttaccaagtcatggatatcaatatcgcagggtctgtaacaggattataattgtcaacctgagtctggatttttgaaaaggctactctagagtttgcatagtttggtgtgttatatctggctactgtatagcccgtcgtctgcaaggccgttaagacattcctgaatagtttggttgaggtttttcaggaattggctgcgttgcagtttgtccggagttgtaaaccttcaatggtttctgagtatattgctaggcctttatttactacggtcaattcaacctgttggagctt

SEQ ID NO: 13380 - protein, 527 aa, Panicum virgatum
  misc_feature: Ceres CLONE 1769391
  misc_feature (101)..(142): Pfam Name: Arm Pfam Description: Armadillo/beta-catenin-like repeat
  misc_feature (144)..(184): Pfam Name: Arm Pfam Description: Armadillo/beta-catenin-like repeat
  misc_feature (186)..(227): Pfam Name: Arm Pfam Description: Armadillo/beta-catenin-like repeat
  misc_feature (229)..(268): Pfam Name: Arm Pfam Description: Armadillo/beta-catenin-like repeat
  misc_feature (270)..(310): Pfam Name: Arm Pfam Description: Armadillo/beta-catenin-like repeat
  misc_feature (312)..(353): Pfam Name: Arm Pfam Description: Armadillo/beta-catenin-like repeat
  misc_feature (355)..(395): Pfam Name: Arm Pfam Description: Armadillo/beta-catenin-like repeat
  misc_feature (398)..(438): Pfam Name: Arm Pfam Description: Armadillo/beta-catenin-like repeat
  misc_feature (4)..(92): Pfam Name: IBB Pfam Description: Importin beta binding domain
MSLRPSERVEVRRNRYKVAVDAEEGRRRREDNMVELRKNRREESLLKKRREGLQAQVPVPASGVEKKLESLPAMVSGVYSDDNNLQLEATTQFRKLLSIERSPPIEEVIQSGVVPRFVQFLTREDFPQLQFEAAWALTNIASGTSENTKVVIDHGAVPIFVKLLQSASDDVREQAVWALGNVAGDSPKCRDLVLANGALMPLLAQLNEHAKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDLQTQCIIDHQALPCLLNLLTQNHKKSIKKEACWTISNITAGNKDQIQAVISGGIIAPLLHLLQTAEFDIKKEAAWAISNATSGGSHEQIKYLVSEGCIKPLCDLLVCPDPRIVTVCLEGLENILKVGEHDKAAGATGDINVFAQMIDEAEGLEKIENLQSHDNNEIYEKAVKLLEAYWMEEEDEAMATAGEAAPAVFDFGQGGNPPAGGGLNFN

SEQ ID NO: 13381 - DNA, 610 bp, Panicum virgatum
  misc_feature: Ceres CLONE 1769395
  misc_feature: Encodes the peptide sequence at SEQ ID NO. 13382
aacgacccggaggccaccgcgaggacgatcgacgtcgacggctggctccacaccggcgacatcggctacgtcgacgacgacgaggaggtcttcatcgtcgaccgcgtcaaggagctcatcaagttcaagggcttccaggtgccgccggccgagctcgaggccctgctgctcgctcacccttccatcgccgacgcagccgtcgtcccgcaaaaggatgacgccgccggcgaggtccccgtcgccttcgtggtccgcgccgccgactccgacatcgcagaggatgccatcaaggagtacatatccaagcaggtggtgttctacaagaggctgcacagggtgtacttcacccactccatccccaagtcagcgtcggggaagatactgaggagagagctgcgggccaagctcgccgcagcggcgaccgcctgagtagctgcagcctcagacccttgccttgctacgtgcattcatttggtgttggcattgtattaccattcagtgtatgtgtataagcgtaccgagattgcaagatgtattcataatttcatatgctttgtaagagaatgcatttattcgatgtggcatcaataagattggcaaattttgaatc

SEQ ID NO: 13382 - protein, 142 aa, Panicum virgatum
  misc_feature: Ceres CLONE 1769395
  misc_feature: SWISSPROT Homolog: EC 6.2.1.12 4-coumarate--CoA ligase
  misc_feature: Useful for making plants with altered carbohydrate content
  misc_feature: Useful for making plants with altered lignin content
  misc_feature: Useful for making plants with altered cell wall content and/or composition
NDPEATARTIDVDGWLHTGDIGYVDDDEEVFIVDRVKELIKFKGFQVPPAELEALLLAHPSIADAAVVPQKDDAAGEVPVAFVVRAADSDIAEDAIKEYISKQVVFYKRLHRVYFTHSIPKSASGKILRRELRAKLAAAATA

SEQ ID NO: 13383 - DNA, 605 bp, Panicum virgatum
  misc_feature: Ceres CLONE 1769396-R
  misc_feature: Encodes the peptide sequence at SEQ ID NO. 13384
ttcattgttgtatctgcgggatatcaagttatggttctcacaccaacaataatacttgctaagcaacactatgatgtaatgactgagcgttttgccacctatcgagaaataaagcttgccatatttagtggtgctcagagcaaagaggaaaaagatgagctaataacaaagattaagaacggaaatttgcatatcattgttggaactcatgctctccttactgaaaggatggcctataacaatcttggtcttctagtggtggatgaagaacaaaagtttggtgtccaacaaaaggagaagattgcatcatacaaagcttctattgacgttcttacactctctgcaacacccataccacgtaccttgtatctggctttgactggtttccgtgatgcaagtttaatgtctacaccacctcctgaaagagttgctgtaaagacatatgtgtcagcatttagtaaagaaagggccctatcagctatcaagtttgagctacaacgtgggggtcaagtcttctatgttgtaccacgaataaaagcaatagacgatgtgttgcagtttctcaaggactctctgccggatgtaccaatcgctgttgctcatgg

SEQ ID NO: 13384 - protein, 201 aa, Panicum virgatum
  misc_feature: Ceres CLONE 1769396-R
  misc_feature (1)..(125): Pfam Name: DEAD Pfam Description: DEAD/DEAH box helicase
FIVVSAGYQVMVLTPTIILAKQHYDVMTERFATYREIKLAIFSGAQSKEEKDELITKIKNGNLHIIVGTHALLTERMAYNNLGLLVVDEEQKFGVQQKEKIASYKASIDVLTLSATPIPRTLYLALTGFRDASLMSTPPPERVAVKTYVSAFSKERALSAIKFELQRGGQVFYVVPRIKAIDDVLQFLKDSLPDVPIAVAH

SEQ ID NO: 13385 - DNA, 133 bp, Panicum virgatum
  misc_feature: Ceres CLONE 1769396
ccggcgcaagcgccgccagcggggcccgagagaggggcagcgaaaacacggggaaggggccccgcagcgcgaagagcgaggagggacccagcccgcggttttttccgcgcggcggcgccggccaggacagacg

SEQ ID NO: 13386 - DNA, 1875 bp, Panicum virgatum
  misc_feature: Ceres CLONE 1769404
  misc_feature: Encodes the peptide sequence at SEQ ID NO. 13387
agccggagcccggaggggaggaagctgcaagcgagcgccaaacgagcaagcgagcgagctagctaagcaaaagcacaccggagcaggaagcgggagcacttctcctcgcccgcaactgtttcaggctctcagctccctcccccagccgcacgcgcgcgcgagaaggaagcgacgagagggagggggaaaagtgggaggaggagcggcgaggcgagcgagcatgctccccggcggcggcgggcggatctgccggagcgcggcgcggggaccgcggcgctaatcgtctccacctcgcggccgcgggatctgacgccgcggcggccgctcggatcgagccagcggcggcggcgggggacggagggacgctgctcgggctccggggacgagatagaaggaaaagattgcgcctagcttcggcttcggcttcggcttcggcggcggctttcatcttcgggttccgcaatcgcggctcgcggtgaaaaaaagaaacggggctagctgtggaaccgggaaagtgatggtttccttcgggaaggcgctgtgatttggcctcaaaaaggaggaatctttcctacgctccccccttgcttcccccgctcttataccgccctcagatcgcggggccggcagtctgattggtccgtcggcaacggggaaggaaaatgaggctctcgtcgtcgtccggcagcgtcctcccggcccaggcggcttcgccggaagctgttgaggagcacaagtgtctgaactcggagttgtggcatgcatgcgccggaccccttgtttccttgccggcggtgggtagccgggtggtgtacttccctcagggtcacagcgagcaggtagcagcatcaacaaacaaggaaatggagtctcaaatccccaattatcctaatctgcctccacagcttatatgccaactgcataatgtgacgatgcatgctgatgcagagacagatgaggtgtatgcgcagatgacattacaaccactcaacccgcaagaactgaaggacccatatttacctgctgaattaagttctgccaataatcagccaacaaactatttttgcaaaacattaactgcgagtgacacaagtacacatggtggattctctgttccacgtcgagcagctgagaaagtgtttcctccactggatttcactcagcaacctccctgccaggagttgattgcaaaagatcttcatggcaatgagtggaaatttcgtcacatatttcgcggtcagccaaagcggcatcttctaactactggctggagtgtctttgttagtgcaaagagactcgttgctggtgactcagtcctctttatctggaatgacaataaccagcttcttctgggaattcgccgggcaaatcggccacaaactgtcatgccatcttcagtcttatcgagtgatagcatgcatattggtcttcttgctgcagctgctcatgctgcttcaacaaatagccgctttacaattttctataacccaagggcaagcccttcagagtttgtcataccgcttgcaaaatatgtgaaggcagtgtatcatacgcgtatatctgtgggcatgcgtttcaggatgctttttgagacagaagaatctagtgttaggagatacatgggaacgattaccggaatcagtgatcttgattctgttcggtggccaaattcacactggcgttctgttaaggttggctgggatgaatcaactgctggagagagattgcaaggtaatgtttgtgttctgcagacggtccttattgtggccacttgtatctgtgattgccccggttacctttgttctgtactagtatttcgttgttctgtgactatgaggtcactttgtggaacttgtggttggcttgatcggttgt

SEQ ID NO: 13387 - protein, 404 aa, Panicum virgatum
  misc_feature: Ceres CLONE 1769404
  misc_feature (260)..(343): Pfam Name: Auxin_resp Pfam Description: Auxin response factor
  misc_feature (133)..(238): Pfam Name: B3 Pfam Description: B3 DNA binding domain
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
  misc_feature: Useful for making plants with modulated light quality sensitivity
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 100 in the 10/666,642 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
  misc_feature: The sequence is a functional homolog of SEQ ID NO 298 in the 10/412,699 US patent application
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
  misc_feature: Useful for biocontainment applications
  misc_feature: Useful for making plants with modulated flowering time
  misc_feature: The sequence is a functional homolog of SEQ ID NO 300 in the 10/412,699 US patent application
MRLSSSSGSVLPAQAASPEAVEEHKCLNSELWHACAGPLVSLPAVGSRVVYFPQGHSEQVAASTNKEMESQIPNYPNLPPQLICQLHNVTMHADAETDEVYAQMTLQPLNPQELKDPYLPAELSSANNQPTNYFCKTLTASDTSTHGGFSVPRRAAEKVFPPLDFTQQPPCQELIAKDLHGNEWKFRHIFRGQPKRHLLTTGWSVFVSAKRLVAGDSVLFIWNDNNQLLLGIRRANRPQTVMPSSVLSSDSMHIGLLAAAAHAASTNSRFTIFYNPRASPSEFVIPLAKYVKAVYHTRISVGMRFRMLFETEESSVRRYMGTITGISDLDSVRWPNSHWRSVKVGWDESTAGERLQGNVCVLQTVLIVATCICDCPGYLCSVLVFRCSVTMRSLCGTCGWLDRL

SEQ ID NO: 13388 - DNA, 800 bp, Panicum virgatum
  misc_feature: Ceres CLONE 1769415
  misc_feature: Encodes the peptide sequence at SEQ ID NO. 13389
ttttgaactttgctaagctatttaatgacgagctgactttggataacatgagcagacctcggctagtaaatatgtgtaaatacatggggatccaaccttttggtacagaccactacttacgattcatgcttcgaaagaagctacaagacattaagaatgatgacaagatgattcaagctgagggtttggagtctctttctgaatatgagcttcgacaagcttgtcgtgaacgaggtcaccttggcttgttgtcaaccgaggagatgtgcctagagctcagagactggttggatctatcactcaatcattctgtgccgtcatctcttctaatactctcaagagcttttactgtgtctgggagaatgaaacctgaggaggctgttgtagcaaccttatcttctctgccagatgaagttgtcgatacagttgggactgtactgccttctgaagatcctgtttctgagaggaagagaaaattggaatttctggagatgcaagaggaacttatcaaggaagaggagaaaaggcaagagaaagaagagaaggcgaaattggaggagccaaaggctattgaagcagatttggctctgaaagaaatgattgagcctactgctagggaggaagaggaagtaaagaaagctaaaacgcatgataagaaagagcaactttgtaatatcagtcaagcattggctgtgcttgcatcttcttcttctgttaccaaggagcgccaggagtttttaagccttgtgaacaaggagatagaactatataacaacatgcttgcgaaggtgggtacagat

SEQ ID NO: 13389 - protein, 265 aa, Panicum virgatum
  misc_feature: Ceres CLONE 1769415
  misc_feature (1)..(112): Pfam Name: LETM1 Pfam Description: LETM1-like protein
LNFAKLFNDELTLDNMSRPRLVNMCKYMGIQPFGTDHYLRFMLRKKLQDIKNDDKMIQAEGLESLSEYELRQACRERGHLGLLSTEEMCLELRDWLDLSLNHSVPSSLLILSRAFTVSGRMKPEEAVVATLSSLPDEVVDTVGTVLPSEDPVSERKRKLEFLEMQEELIKEEEKRQEKEEKAKLEEPKAIEADLALKEMIEPTAREEEEVKKAKTHDKKEQLCNISQALAVLASSSSVTKERQEFLSLVNKEIELYNNMLAKVGT

SEQ ID NO: 13390 - DNA, 1045 bp, Panicum virgatum
  misc_feature: Ceres CLONE 1769446
  misc_feature: Encodes the peptide sequence at SEQ ID NO. 13391
aggtcgcactccgcctcggcctcttcgtcctcccccagtcgcagtagcaggcgtcgccgtctccgctgctcggccccgcgccggatcgagggaggggagcgccgcggaccgggaggcgggatgagtctcttcgggctcggacggaaccagaagacattccgccccaagaagagcgctccgtcaggcagcaagggagcacagctccgaaagcacatagatgccactcttggcagtgggaaccttagggaagctgtgaggctgcctcctggagaggacattaatgaatggcttgctgtgaatactgtggatttctttaaccaggttaatctgctgtatggtacactcacggaattctgcacacctgagagctgcccaacaatgactgctggcccaaagtatgagtacagatgggctgatggtgtacagataaagaaacccatagaggtatcagcaccaaaatatgtggagtatctaatggattggattgaaggccaacttgatgatgaatccatatttcctcaaaaacttggcacacagttcccgccaaacttcaaggaagtagtgaagacaatattcaagcgcctgtttcgtgtttatgcccacatatatcactctcactttcagaagattgtcagcctcaaggaggaggctcatcttaacacctgcttcaagcacttcattctgttcacaaatgagtttggcctgattgacaaaaaggagttggctccactccaggagctcatcgaatccatcatcgttccttactgaaggaacgttcgatggtactaaactaatacggatctggagccctcggtgctaatggctgagatattagtctgtttgtgacaatacttcactggcatagagcttgttgttccagttattagacataaaaagaaaggagacttggcattgctaatgctatatttgcttgtacccgtgtgtttctccctgattctatattggccatgtaagtgtgcctgtaagaaagattgtatcagctgcgcgatgtgctaagaaagaaaaacagaaaacagtttggtcc

SEQ ID NO: 13391 - protein, 215 aa, Panicum virgatum
  misc_feature: Ceres CLONE 1769446
  misc_feature (29)..(205): Pfam Name: Mob1_phocein Pfam Description: Mob1/phocein family
MSLFGLGRNQKTFRPKKSAPSGSKGAQLRKHIDATLGSGNLREAVRLPPGEDINEWLAVNTVDFFNQVNLLYGTLTEFCTPESCPTMTAGPKYEYRWADGVQIKKPIEVSAPKYVEYLMDWIEGQLDDESIFPQKLGTQFPPNFKEVVKTIFKRLFRVYAHIYHSHFQKIVSLKEEAHLNTCFKHFILFTNEFGLIDKKELAPLQELIESIIVPY

SEQ ID NO: 13392 - DNA, 801 bp, Panicum virgatum
  misc_feature: Ceres CLONE 1769453
  misc_feature: Encodes the peptide sequence at SEQ ID NO. 13393
aacttgacgcgcctctgaaagatccctgccgccgcccaggcctgcctccattcccccgcctccggtgccgaagggaaatagttttgaggtggtgatggcggacaaggtcaaccaaccaactgtccttcataagctcggtggccagttccatctgagctccagcttctctgaaggtgtacgggcccgtaacatctgcccttctgtctcatcctatgaaaggagttttgccacaaggaattacatgacccagactctttggggcccttcaatgtccgtcagtggtggcataaatgtcccagtggtttcatcctccccgcttttttctaatgctccagctgagaaaggaggcaagaacttcatgattgatttcctcatgggtggtgtttcagccgctgtctcaaagactgctgctgctcccattgagcgtgtgaagctgcttattcagaaccaggatgagatgattaaggctggtaggctgtccgagccatacaagggtattggtgactgcttcaagcgcaccatcaaggatgagggtttctcctccctgtggaggggtaacacagctaatgttattcgctacttccctactcagcccttgaacttcgcattcaaggactacttcaagaggctcttcaacttcaagaaggacagggatggttactggaagtggtttgctggcaaccttgcctctggtggtgctgctggtgcttcctccctgtttttcgtgtactcccttgactatgcgaggacaaggctggccaatgatgccaaggcagccaagggaggaggtgaaaggcaatt

SEQ ID NO: 13393 - protein, 235 aa, Panicum virgatum
  misc_feature: Ceres CLONE 1769453
  misc_feature (87)..(184): Pfam Name: Mito_carr Pfam Description: Mitochondrial carrier protein
MADKVNQPTVLHKLGGQFHLSSSFSEGVRARNICPSVSSYERSFATRNYMTQTLWGPSMSVSGGINVPVVSSSPLFSNAPAEKGGKNFMIDFLMGGVSAAVSKTAAAPIERVKLLIQNQDEMIKAGRLSEPYKGIGDCFKRTIKDEGFSSLWRGNTANVIRYFPTQPLNFAFKDYFKRLFNFKKDRDGYWKWFAGNLASGGAAGASSLFFVYSLDYARTRLANDAKAAKGGGERQ

SEQ ID NO: 13394 - DNA, 719 bp, Panicum virgatum
  misc_feature: Ceres CLONE 1769470
  misc_feature: Encodes the peptide sequence at SEQ ID NO. 13395
accacaccaccaggcaggccaccacaactctctctctttcccccctccaccctcgccgcgagttgctcagtcgcaagcgaggcgcgggccacagagcggggcgagcgttccggctgcgggggggctgcgtcgcgtcgcgtcgcgtcgcgccgcgcggggttcgatccgggacgggaggggaggggaggggagatcgaaatctgccttccatctctctcgctgcctctcctcgcgctcttcctcctggggggcgggagggcctcgcatgcggcggcgcggcggggcaaatgcgggtagcctcgcgggcggcggaggagcgctkakgacgcggcggccggggagcgatgcaggcgacggagcaccaccaccaccagcagcagcagcagcggaggaagggttcaccagagatggacttcttcagtgaatatggtgatgctaacagatacaaaatccaagaggtcattggcaaaggaagttatggtgttgtttgctcagctgttgaccagcatacaggcgacaaggtggcaatcaagaaaatacataatatctttgagcacttatccgatgctgcccggatcctccgtgagatcaaactacttcggctattgcgacatcctgatatagttgagatcaagcatataatgctgcctccatcaaggagggacttcaaagatatctatgttgtgtttgagctgatggatacagacctgcaccaagtc

SEQ ID NO: 13395 - protein, 124 aa, Panicum virgatum
  misc_feature: Ceres CLONE 1769470
  misc_feature: SWISSPROT Homolog: EC 2.7.11.24 Mitogen-activated protein kinase
  misc_feature: Useful for making plants with altered cell wall content and/or composition
MQATEHHHHQQQQQRRKGSPEMDFFSEYGDANRYKIQEVIGKGSYGVVCSAVDQHTGDKVAIKKIHNIFEHLSDAARILREIKLLRLLRHPDIVEIKHIMLPPSRRDFKDIYVVFELMDTDLHQ

SEQ ID NO: 13396 - DNA, 669 bp, Panicum virgatum
  misc_feature: Ceres CLONE 1769470-R
  misc_feature: Encodes the peptide sequence at SEQ ID NO. 13397
catggatgccaaggtagtgcctcagatgtctcctgacttaaggtcttcctactacatacccaaaggtgtcccgaaagctgatgttgtggaaagagctgcgttgcagtccagcatgattcatggaattgccccttttaatggcattgcagctgtaggaggtggaggaggttataataaagtcaatgcagttcaatatggagtttctaggatgtattagttgtaggtgtgcattggcgatctccacaatcctcagcggagttgaagtaataacatggcaaagagcgaaaagatgtcggctgccttactggctctatggcccgaagatagagaccatggaccgaggatcaaggaggacgtgcgatgtctcattgaaattgatgtcaggaaaacaacattcatcatcctgcccatttgatccagcttgttgaaaatggaatgccattaccccacgaaaagggaaaaaaaggagaaaatagcagtgccatcgtttatttgctgctggtaagagtagaagagggggtgcagagaagattacagggaaatctatgtactttgcaagaaaggaaacatgtgggaataaaaatagtgagcttctgtatatacagtgacttgatttatgtattgttgctggtcacagcagcttctttaattcaacgctgaattttgtgt

SEQ ID NO: 13397 - protein, 71 aa, Panicum virgatum
  misc_feature: Ceres CLONE 1769470-R
  misc_feature: SWISSPROT Homolog: EC 2.7.11.24 Mitogen-activated protein kinase
MDAKVVPQMSPDLRSSYYIPKGVPKADVVERAALQSSMIHGIAPFNGIAAVGGGGGYNKVNAVQYGVSRMY

SEQ ID NO: 13398 - DNA, 808 bp, Panicum virgatum
  misc_feature: Ceres CLONE 1769478
  misc_feature: Encodes the peptide sequence at SEQ ID NO. 13399
ggccctttaaaggaccgcctcctccgctcccctccgctcctgctcctcccatcccactcccccgcaggagcggcggcctcggcggcggcggctaggcgtaccccccacctcggcgagcggcaccggcggcggcaaaggcaagatgttcgggcgcgcgccgaagaagagcgacaacaccaagtactacgagatcctcggggtgcccaagtccgcgtcccaggacgacctcaagaaggcctaccgcaaggccgccatcaagaaccaccccgacaagggcggcgaccccgagaagttcaaggatttttttcaagcttatgaggttttgagtgacccagagaagcgtgagatttatgatcagtatggtgaagatgccctcaaggaaggaatgggtggaggaggagcccatgtagatccatttgacatcttctcatcattctttgggccctctttcggaggaggtggtggcagcagcagaggcagaaggcaaaggaggggagaagatgttgtgcacccacttaaagtttctctagaggatctttacaatggtacctcaaagaagctctcgctttcgcgtagtgtcatctgctcgaagtgcaagggcaagggctccaagtctggtgcttcaatgaggtgcccaggttgccagggttcaggtatgaaggtcaccatccgccagctgggtccttccatgatacagcagatgcagacggcttgcaatgagtgcaaggggactggagagagcatcagtgagaaggatcgctgccccgggtgcaagggtgagaaggttggtcaggagaagaaagttccg

SEQ ID NO: 13399 - protein, 221 aa, Panicum virgatum
  misc_feature: Ceres CLONE 1769478
  misc_feature (135)..(221): Pfam Name: DnaJ_CXXCXGXG Pfam Description: DnaJ central domain (4 repeats)
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKDFFQAYEVLSDPEKREIYDQYGEDALKEGMGGGGAHVDPFDIFSSFFGPSFGGGGGSSRGRRQRRGEDVVHPLKVSLEDLYNGTSKKLSLSRSVICSKCKGKGSKSGASMRCPGCQGSGMKVTIRQLGPSMIQQMQTACNECKGTGESISEKDRCPGCKGEKVGQEKKV

SEQ ID NO: 13400 - DNA, 561 bp, Panicum virgatum
  misc_feature: Ceres CLONE 1769478-R
cggggtcggtatcaagcggataagtattgaggaagtacaggttcagctgagacatgtcctgggggataatgtctatcttgtctcagtggatgagtttggacactcagaggagcgagaaccgtgcgatgctgcagcgggattcattcgctctgagccaatgtaaaaggtgtgggcgctggaaacacgtggagtgggaagttgggtcattgagaagtaggtttcaagattgaaggaaaggagaggcggggtcaacctccctaggcccaggaggcgtttgtggcggaattcgacatacgatgaggagcgctttgggcggtttttacttcactgtaggcagaaaacgtagtcatgaagaggaatgacaccagtttgttcatagccagggtttgaggtggattttatgacccagggaggtttttgtggttttttcgtaggaggaggggttcagacgaggaacattttggatagtaccccacgggggggtaggcaagtactcttttcagtaggaagcaaaaattgagaatcaggatgtagccagtgccagtatttatgagtttcacc

SEQ ID NO: 13401 - DNA, 620 bp, Panicum virgatum
  misc_feature: Ceres CLONE 1769481-R
  misc_feature: Encodes the peptide sequence at SEQ ID NO. 13402
ctgaacggcatcgcgctccgcgtgccgaccccgaacgtgtccgtggtggacctggtgatcaacaccgagaagaagggcatcaccgccgacgacgtcaacggcgcgttccgcgaggccgccgccggcccgctcaatggcgtcctcgacgtctgcaacgcgccgctcgtgtccgtcgacttcaggtgctccgacgtgtcctccaccatcgactcctcgctcaccatggtcatgggcgacgacatggtcaaggtcgtcgcctggtacgacaacgagtggggatacagccagcgcgtggtcaatttggcgcacctggtggcggccaagtggccgggcgcggcgacggcgggcagcggcgaccccctggaggacttctgcaaggacaaccccgccaccgacgagtgcaaggtgtacgaggcataaggcctccgtgttctgttgttcggaagcgtacattacgatcgatcaggaagagggcagagtaactttgctgtcactgcccgcccggtgttcttccgtagagagtacacacacactaactttgttgttcagaaatgcatctttgtttctgtgtgtgaggtgtaatcatcactgaactcgtacaggcttcagatttcatttcc

SEQ ID NO: 13402 - protein, 139 aa, Panicum virgatum
  misc_feature: Ceres CLONE 1769481-R
  misc_feature (1)..(88): Pfam Name: Gp_dh_C Pfam Description: Glyceraldehyde 3-phosphate dehydrogenase, C-terminal domain
  misc_feature: SWISSPROT Homolog: EC 1.2.1.13 Glyceraldehyde-3-phosphate dehydrogenase (NADP(+)) (phosphorylating)
LNGIALRVPTPNVSVVDLVINTEKKGITADDVNGAFREAAAGPLNGVLDVCNAPLVSVDFRCSDVSSTIDSSLTMVMGDDMVKVVAWYDNEWGYSQRVVNLAHLVAAKWPGAATAGSGDPLEDFCKDNPATDECKVYEA

SEQ ID NO: 13403 - DNA, 194 bp, Panicum virgatum
  misc_feature: Ceres CLONE 1769481
acgccccaccagcaccgccgccagggaggcgcccccccccgacgcgcgcggcgcgcagcccgccgccaaggccaccggggagaacgcggcgagggcgcccgccgaggccaagcacaaggaggcgagcaacgggcgcgggcgcaacggccggaacccccgccggggccggcacgttcgcaaggaccccccgcacg

SEQ ID NO: 13404 - DNA, 1453 bp, Panicum virgatum
  misc_feature: Ceres CLONE 1769489
  misc_feature: Encodes the peptide sequence at SEQ ID NO. 13405
acccggtttcctcacaaattccctccattgaagacgattccccttcttccggtcctcaacccactgggtccgcgtcccatcagactcgtggacgacaccgccgcggccagcttctccggtcaccgtgtgtgtcgtcgcacaaaacttgcggtggcgaagcctgctgcgtccttccccggcggcggcgccatggcgttcacgctgctgtaccccaccaagtcgtcgacgcgcgcgccgtggagcaccagcttcttccgccacaagttcccggccaccgcggcctccttctgatcaggctagctccggccgccggcgacacacctctgtgtttctagaggaggtggaggagcatacatacgtgcaccgattcacgtgagtgtgcgcgtacaaagatacgttgttgtttttttacttcgttgttagtagtaaattggcacaaacatggattccggccgcaacatgatcagctccgcggtgccattccgcgccgccggcgaagacggcgggcaggtgtttctcttcggcggcggcggcggcggcgggggcttccttcgaggcgcgccggtggtgggggccgccggggcggcgaacggctggcggcgcggcaagcggccgttccagctaacggcggcgcacgaggagctgcagctccagctcgagctcggagacgatgacctggccggcttcgacttcgagctgcacggcggtggggcgcaggagcggacgaagcgccggctgacggcggagcaggtgcgggagctggagctgagcttcgaggaggagaagcggaagctggagcccgagcgcaagagcgagctggcgcggaggctcgggatcgcgccgcggcaggtggccgtgtggttccagaaccgccgcgcgcgctggaaggccaagcagctcgagcaggacttcgaccgcctcagggccgcccacgacgagctcctcgcgggccgcgacgcgctcctggccgacaacgatcgcctccggtcacaggtaatcacgctggctgacaagctgcaagccaaggagtcgtcggtgccagccgctgctctgcaggcagcaccctacgctcctttcgaacaagatcagctctgcaccgagaccgcgaccacggccggcgcggcgccgccggcgggctacgacacggggggagccggcgacagcccggagtcctacttggctggcgcgcgctcaccaccgtcgtcatcagaggacgattgcggtggcggcgatggtgacggcggcgccttctacctccccgacccggacacgttgctcgccgcggctgcccaagaggacggggcgcagctcagcaactgggcatggctgtggaacgagcagcagtattaacctagctagtgttgcattgtactgtataaatttgggcttcgcgtatttttggtattgatactgtatcttctgatgataaattgaagctttattacactgttcg

SEQ ID NO: 13405 - protein, 302 aa, Panicum virgatum
  misc_feature: Ceres CLONE 1769489
  misc_feature (94)..(150): Pfam Name: Homeobox Pfam Description: Homeobox domain
  misc_feature (151)..(195): Pfam Name: HALZ Pfam Description: Homeobox associated leucine zipper
MDSGRNMISSAVPFRAAGEDGGQVFLFGGGGGGGGFLRGAPVVGAAGAANGWRRGKRPFQLTAAHEELQLQLELGDDDLAGFDFELHGGGAQERTKRRLTAEQVRELELSFEEEKRKLEPERKSELARRLGIAPRQVAVWFQNRRARWKAKQLEQDFDRLRAAHDELLAGRDALLADNDRLRSQVITLADKLQAKESSVPAAALQAAPYAPFEQDQLCTETATTAGAAPPAGYDTGGAGDSPESYLAGARSPPSSSEDDCGGGDGDGGAFYLPDPDTLLAAAAQEDGAQLSNWAWLWNEQQY

SEQ ID NO: 13406 - DNA, 776 bp, Panicum virgatum
  misc_feature: Ceres CLONE 1769497
  misc_feature: Encodes the peptide sequence at SEQ ID NO. 13407
atgatggtgtgctactgcaccatgtgcttgtcatcaacagagcctagggctggtgaagcccatggaggagatgctgatggcggccaacgcgggcgccgccgtgaacacgagccagggctccaatccgaacccgccggcgccgtcgtcggcggctgggggcggcgccgccctgcgcgcccccgcaccgccggccgtggcgggcgtgggtagcacggagcggcgcgcgcggccgcagaaggagaaggcgctcaactgcccgcggtgcaactccaccaataccaagttctgctactacaacaactacagcctccagcagccgcgctacttctgcaagacgtgccgccgctactggacggagggcggctccctccggaacgtgcccgtcggcggcggctcgcggaagaacaagcgctccacctcctcgtccgcgtccgcgtccgcctccacctccgcctcggtcacgagctcgtctatggtcaccacagcgggggcggcgtccaagaacccgaagctggcgcacgagggcgcgcaggacctcaatctggcgttcccgcaccacggcggcctgcacgtgcccgagttcgcggcgttcccgagcctggagagcagcaacgtgtgcaactccggcggcgcaatggcgggcaacggccggggcggcggcggcggcgcagggcccgcggtaggcgctttctcggccatggaactgctgcggagctccggctgctacatgccgctgcaggtgccgatgccgatgccgggagactacgcggcggcag

SEQ ID NO: 13407 - protein, 238 aa, Panicum virgatum
  misc_feature: Ceres CLONE 1769497
  misc_feature (58)..(120): Pfam Name: zf-Dof Pfam Description: Dof domain, zinc finger
MEEMLMAANAGAAVNTSQGSNPNPPAPSSAAGGGAALRAPAPPAVAGVGSTERRARPQKEKALNCPRCNSTNTKFCYYNNYSLQQPRYFCKTCRRYWTEGGSLRNVPVGGGSRKNKRSTSSSASASASTSASVTSSSMVTTAGAASKNPKLAHEGAQDLNLAFPHHGGLHVPEFAAFPSLESSNVCNSGGAMAGNGRGGGGGAGPAVGAFSAMELLRSSGCYMPLQVPMPMPGDYAAA

SEQ ID NO: 13408 - DNA, 1926 bp, Panicum virgatum
  misc_feature: Ceres CLONE 1769503
  misc_feature: Encodes the peptide sequence at SEQ ID NO. 13409
aaaagacaacgtctactgtcagtcacttgatagcagacatctcacctacctggctcacagctcctcgctcgatacaaataaccatgttgcaccacgacctgcgatccatctctccccagagcgcgcagagatgaatccgttgttcctgttcatagaggtgctccctgtcctctgcttcctcatcctctactaccaccacctgcaatccaagaaaacgagccctttggagccgaccgaatggccgatagtggggcatctccccggcctgatcgccaacatccaccacttccacgactgggccaccggcatcctcaccggcacgagctacaacttcgaagcccgcggggggctcaccggcttgcgctacttcatcacctgcaacccctccaacgtgcgccacatcttcacgtccaacttcgccaactaccctaagggcgacgagttcgccgtgatcttcgacgtgctcggcggcggcatcttcaacgccgacggggagtcgtggcgccgccagcgggtgaaggcccagatgctcatggccgtcccacggttccggaccttcacgacgcggtgcagccgcgacaaggtggagaagagcctcctgcctttcctcgcccacgccgccgacgagggaacgccgtgcgacctgcacgacgtgttcctgaggctcacgttcgacatgacgtgcacccttgtgttcggcgtcgaccctggctgcctggcgatcggcctgcccgtggttcccttcgcgcgcgccatggacgacgcgctggagacgcttttcctccggcacatcacgcccatggcgtgctggaagctgatgaacaggctggaggtgggccaggagaagaagatggccgccgctcggaggacgatcgaccgcttcgtcgccgacaccgtcgcgaaacgccgggccgacaagctcgagcaaggcatcggcgactcggccgacctgctgtcgtccttcatcttcaacgaggactccagcgacaacgatgacgtgttcttgcgtgacacgacggtgaacctcttgctcgccggccgcgacacgacgggggcggcgctgtcgtggttcttctacctcgtctccacgaacccacgcgtcgagcagaaactactggacgagctcgcgcccgtcgcctcgcggaagggtgccgacgacgcggccagcggcggcatggtgacgttcgatgcgagcgagctgggcaacctggtgtacctgcacgccgccctgtgcgagtgcctgaggctgtacccatcggtcccgttcgagcataaggcggtggtcgccgacgacgtgctgccgagcgggaaggagatgaaggcgggcgacaaggtgcttgtgttcagctactccatgggcaggatggagggcgtgtggggcaaggactgcgctgagttccggcccgagaggtggctcatcagcgacgaggcggcagggacgaagaagaagaagctgcggtacgagccgtcgtacaagttcatctccttcaacgccgggccgcggacgtgcctgggcaaggagatggcgttcgtgcagatgaagaccgcggcggcggccgtgctgtggaacttcgccgtcgagctcgtgccggggcacgccgtggagcccaagctgtccatcatactccacatgaagaatgggctcgccgtcagggtcagaagaaggaacgccggcgtcgcgcgtcacggctaagctagccgctcctcacgaagcacacgtctcctcgatcggccatgtgagcactagctactatatgttattactagccggctggaatccaatctacccaccagctagcacgtgttgcgtgacacgtatatctcatcagtacgcacgtgtctccgtagcatctacgttcatgcgtatgctactttggtgtcgttacactatactagccgaaaataaggggcttccatctacgccat

SEQ ID NO: 13409 - protein, 520 aa, Panicum virgatum
  misc_feature: Ceres CLONE 1769503
  misc_feature (31)..(508): Pfam Name: p450 Pfam Description: Cytochrome P450
  misc_feature: SWISSPROT Homolog: EC 1.14.13.21 Flavonoid 3'-monooxygenase
MNPLFLFIEVLPVLCFLILYYHHLQSKKTSPLEPTEWPIVGHLPGLIANIHHFHDWATGILTGTSYNFEARGGLTGLRYFITCNPSNVRHIFTSNFANYPKGDEFAVIFDVLGGGIFNADGESWRRQRVKAQMLMAVPRFRTFTTRCSRDKVEKSLLPFLAHAADEGTPCDLHDVFLRLTFDMTCTLVFGVDPGCLAIGLPVVPFARAMDDALETLFLRHITPMACWKLMNRLEVGQEKKMAAARRTIDRFVADTVAKRRADKLEQGIGDSADLLSSFIFNEDSSDNDDVFLRDTTVNLLLAGRDTTGAALSWFFYLVSTNPRVEQKLLDELAPVASRKGADDAASGGMVTFDASELGNLVYLHAALCECLRLYPSVPFEHKAVVADDVLPSGKEMKAGDKVLVFSYSMGRMEGVWGKDCAEFRPERWLISDEAAGTKKKKLRYEPSYKFISFNAGPRTCLGKEMAFVQMKTAAAAVLWNFAVELVPGHAVEPKLSIILHMKNGLAVRVRRRNAGVARHG

SEQ ID NO: 13410 - DNA, 786 bp, Panicum virgatum
  misc_feature: Ceres CLONE 1769506
  misc_feature: Encodes the peptide sequence at SEQ ID NO. 13411
attcagctgagtgtgctcgatcatcaagcaatcaacaaagcctcccaattatcctttcatcagatcatcttccttcttccaagatgtcttgcagctgcggatcaagctgcaactgcggctccaactgcaagtgcggcaagatgtaccctgaccttgaggagaagagcagcggcggcgctcaggccaccatcgtcctcggcgtggccccggagaagaaggccggccagttcgaggcggcggcagagtccggcgagaccgcccacgcctgcaagtgcggtaacagctgcagctgcgacccctgcaactgctgatttcgatggggaacgtcagaacacacctgcatgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtgtctgtatgtgttgatcattgcaaagaaaccatgcaggcatacatctttgcatgtgtctctgtaatgatcggtccagagtgatgaatatataaaactggtttgctttatcaaaagccagaagctgctgcagcatccatccatccttcccatcctgctctcgagctccaagcctcaaaccgtccgcgcctgctcaggctcagctagccggggacgaattaaccgagcagcatccatggcggccgtgttggtggcgaggcaggggcgcgagctgcagcgc

SEQ ID NO: 13411 - protein, 75 aa, Panicum virgatum; identical to SEQ ID NO: 12809
  misc_feature: Ceres CLONE 1769506
  misc_feature (1)..(75): Pfam Name: Metallothio_2 Pfam Description: Metallothionein

SEQ ID NO: 13412 - DNA, 829 bp, Panicum virgatum
  misc_feature: Ceres CLONE 1769517
  misc_feature: Encodes the peptide sequence at SEQ ID NO. 13413
gatcccccttgacccgacttcccgcaggctgttcgacgcttcgccccgcccgcgcgcagccacgccatggccgcctccgtctccgctgccgccaaggcctccgccgccttcgcccacaaggtgaagtccgcgatgacgatgacggagaagatcctggcgcgggcgtcggagcgcgcgggcctggagcccggggagaacgtctgggtggacgtcgacgtgctcatgacgcacgacgtctgcggccccggcaccatcggcatcttcaagaaggagttcggggaggacgccaaggtctgggaccgcgagaaggtcgtcatcatcccggaccactacatcttcaccagcgacgagcgggccaaccgcaatgttgatatcctcagggacttctgtatggagcagaacatcaagtacttctatgacatcaaggacctcagcaatttcaaggctaatccagactacaaaggcgtctgccacgttgcacttgctcaagaaggccactgccgaccgggcgaggttctccttggtactgattctcatacatgcaatgctggagccttcggtcaatttgcaacgggaattggaaacactgatgcaggttttgtattgggcactggaaaggctcttctcaaggtgccaccaactataaggtttgtactagatggagaaatgccaccttatttactcgcaaaggatctgattttgcaaattattggtgagatttctgtatctggtgcaacctacaagtccatggagtttgttggatcaactgtggaaagtctaaatatggaagagcgaatgacattgtgcaacatggttattgaagctggtg

SEQ ID NO: 13413 - protein, 254 aa, Panicum virgatum
  misc_feature: Ceres CLONE 1769517
  misc_feature: SWISSPROT Homolog: EC 4.2.1.33 3-isopropylmalate dehydratase
MAASVSAAAKASAAFAHKVKSAMTMTEKILARASERAGLEPGENVWVDVDVLMTHDVCGPGTIGIFKKEFGEDAKVWDREKVVIIPDHYIFTSDERANRNVDILRDFCMEQNIKYFYDIKDLSNFKANPDYKGVCHVALAQEGHCRPGEVLLGTDSHTCNAGAFGQFATGIGNTDAGFVLGTGKALLKVPPTIRFVLDGEMPPYLLAKDLILQIIGEISVSGATYKSMEFVGSTVESLNMEERMTLCNMVIEAG

SEQ ID NO: 13414 - DNA, 1235 bp, Panicum virgatum
  misc_feature: Ceres CLONE 1769522
  misc_feature: Encodes the peptide sequence at SEQ ID NO. 13415
attccaattccccattcagatccgccgatttcttcttcggttcttctccttcttcccacagcggccgccgcagcagcacagggtactcgagtgagtgaccgcccgaccgattctcgaggatgctggccatcttccagaagcaggtggcgcacgcgccgcaggagctcaacagcccccggagcggcggcgccaagcccaggagccccaacgagatcctccgggacttccacgccgcgcaccctgccgacgccttctccgcctccttcgggggcggcgccgcgctcgcctgcgtcgccgcgcgcgcctgccctgctgccggggccggccaccaccagcgcatgttctgcggcctcgacgacatctactgcgtcttcctcggccgcctcgacaacctcagcgccctcatccgccagtacggcctctgcaacaagtccaccaacgaggcgctgctcgtcatcgaggcctaccgcaccctgcgcgaccgcgggccctaccccgccgaccaggtcgtcaaggacctcgccggctcattcgccttcgtcgtcttcgacaacaagtccggcgccgtattcgcagccctgagcgccgacggcggcgtgcctctgttctggggcatcgcggcggacggctccgtggtcatctgcgaggaccgggagatcgtcaagcgcgggtgcggcaagtcgtacgcgcccttccccgtggggtgcatgttccacagcgagggcgggctcaagagcttcgagcaccccatgaacaggctcaaggcgttgccccgggtcgacagcgagggcgtcatgtgcggcgccaccttcaaggtcgacaccttcaccaagatcaactccatgccacgtgtcggcagcgccaccaactgggccgcctgggacgaccaagccatctaggagtagatcatattttcaccgtctctttaattaagagcgccgctgctcacgcacgcaccagatagccatatccgcgccctttctttctcccttcttcgtcgctcgatgtttctttcctttccttccactaatgtatctgctggctacctgctagtgcttccattggaaggccatggtctcatcaagaccacgtacggaagcataacgcctttgttttactgcatgcttgtcgtcctcttcttccggctccttgtgctggcacattgtacatttccctgtgcttggggcttttaggcttggctgttgaacattatcaataagagtttgcttcaatcg

SEQ ID NO: 13415 - protein, 259 aa, Panicum virgatum
  misc_feature: Ceres CLONE 1769522
  misc_feature: SWISSPROT Homolog: EC 6.3.5.4 Asparagine synthase (glutamine-hydrolyzing)
MLAIFQKQVAHAPQELNSPRSGGAKPRSPNEILRDFHAAHPADAFSASFGGGAALACVAARACPAAGAGHHQRMFCGLDDIYCVFLGRLDNLSALIRQYGLCNKSTNEALLVIEAYRTLRDRGPYPADQVVKDLAGSFAFVVFDNKSGAVFAALSADGGVPLFWGIAADGSVVICEDREIVKRGCGKSYAPFPVGCMFHSEGGLKSFEHPMNRLKALPRVDSEGVMCGATFKVDTFTKINSMPRVGSATNWAAWDDQAI

SEQ ID NO: 13416 - DNA, 783 bp, Panicum virgatum
  misc_feature: Ceres CLONE 1769530
  misc_feature: Encodes the peptide sequence at SEQ ID NO. 13417
tcacactgacaccgcgcgtggccatgttcgctgcgcaccgagaccacctcctcgccgcactgcacggcgtcctcggcgccgccacgctcctcctctgcctcctcgccgagctcctcgtcttcgcgctccggcgccacgccgcgttctacctcgcccccgtggccgcgatgctcctctccggccacctccgccgccgcgccgcggcggcggagatcggcctcgtcgacttctcgtgcctgaagccgccacaccggctgcgcatccccgtggcggggctgctggagcacttccgcctcatcggctgcttcgacgacgccagcgtcgagttcatgaccaaggtcatcgaggccagcggcatgggcaacgagacctacttcccgccctctctgcactacatcccgccggcggccacgcacgccggcgccgtccaggaggcgcacatgctcttcttccccacgctcgacgacctcttcgccaggactggcgtcccgccgtccgccgtcggggcgctcgtcgtcaactgcagcggcttctgcccggccccgtcgctcgccgccatcatcgcccgccgctaccgcatgcccagcgacgtcaggaccttcaacctctccggaatgggctgcgccgcgggcgccgtgggcgtcgacgtcgccaggggcgtcctgctcgcgcacgccgttccctacgccgtcgtcgtcagcgccgagatcgtcaccatcggctggtacagcggcaaggaccagggcaagctgctcctcaactgctacttccgcacgggctgct

SEQ ID NO: 13417 - protein, 253 aa, Panicum virgatum
  misc_feature: Ceres CLONE 1769530
  misc_feature (54)..(253): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MFAAHRDHLLAALHGVLGAATLLLCLLAELLVFALRRHAAFYLAPVAAMLLSGHLRRRAAAAEIGLVDFSCLKPPHRLRIPVAGLLEHFRLIGCFDDASVEFMTKVIEASGMGNETYFPPSLHYIPPAATHAGAVQEAHMLFFPTLDDLFARTGVPPSAVGALVVNCSGFCPAPSLAAIIARRYRMPSDVRTFNLSGMGCAAGAVGVDVARGVLLAHAVPYAVVVSAEIVTIGWYSGKDQGKLLLNCYFRTGC

SEQ ID NO: 13418 - DNA, 639 bp, Panicum virgatum
  misc_feature: Ceres CLONE 1769540
  misc_feature: Encodes the peptide sequence at SEQ ID NO. 13419
tggaggtggcggcggcggaggcgtcgtcagaggccggcaacggcagccagctggtgatgcccgaagacggctacgagtggaagaagtacggacagaagttcatcaagaacatccagaaaatcaggagctacttccggtgccggcacaggcagtgcggcgccaagaagaaggtggagtggcacccgagagacaccagcggggccctccgcgtcgtctacgagggcgcgcaccagcacggctccccgccgtcgtcgtcagcggcggcggcggccgccgccgccgccgcctccaacaagtacgagctgggcgcgcagtacttcggcggggctcggccgcagtgacccaggaaccctcgatgtacgtgagcgttgggatggggaagaaattccggcggcggcggcatggatctggtctgtcctgctcctgcacccatctctttcacagcggcaggtggccggcgctgtcagcgccgccgtggccatcaggtggcggtgccggttgacgccttgcgccggtgcaatgtgatgttgagtggggaataattgttgctagtccgatcaactctgcggtctggtacctgtagctgtagtgccgtactacgccagtatgcacgaaataagcctgtgtttagatgttttg

SEQ ID NO: 13419 - protein, 112 aa, Panicum virgatum
  misc_feature: Ceres CLONE 1769540
  misc_feature (20)..(80): Pfam Name: WRKY Pfam Description: WRKY DNA -binding domain
EVAAAEASSEAGNGSQLVMPEDGYEWKKYGQKFIKNIQKIRSYFRCRHRQCGAKKKVEWHPRDTSGALRVVYEGAHQHGSPPSSSAAAAAAAAAASNKYELGAQYFGGARPQ

SEQ ID NO: 13420 - DNA, 839 bp, Panicum virgatum
  misc_feature: Ceres CLONE 1769544
  misc_feature: Encodes the peptide sequence at SEQ ID NO. 13421
attcccccacacagcaccactgcaacttacacagcatttgcttaattagctaataagcacgaccctatcggtactaatggcggctttgatgatgaagaacaagaagcagatgccggcggtggtggcgttggccgttgtggtggcggcggcggcgctggtggcgtcggcgtcggcggccatcacgtgcgggcaggtgggttcggcgctggctccgtgcatcccgtacgcgacggggaaggcgagcgcgctgccgtcgtcgtgctgcggcggcgtgcgcagcctcaacagcgcggcgcgcacgagctcggaccggcaggcggcatgccggtgcctcaagagcctggccagcaccgtcaagtcggtgaacatgggcaccgtcgccaccatccccgtcaagtgcggcgtctccgtgccattccccatcagcatgtccactgactgcaacaaggtcaactaataaattgtgcatcaatataataatcctaccatctgatgaggaagctcagctcgatccgctcagaagctagctgctagctagcgagctttcaggagaataaaataaagttgaggcatcatcagcaggcagcagcacatcatctatatatattattgttgtactcgatctgtgtgtacgtgcgcgtacacatacatgcatgcttatacgatcgatgtatatatatgtgctgcttctctcaaaaaaaagcacagacgacagcgagccaagtgtactactcccagtgaagccgcactagctagccacaccagcagcttgacaagctagctagctagctaggccgcagccatgtcggaggagaagcaccaccacttcttccaccacc

SEQ ID NO: 13421 - protein, 126 aa, Panicum virgatum
  misc_feature: Ceres CLONE 1769544
  misc_feature (37)..(122): Pfam Name: Tryp_alpha_amyl Pfam Description: Protease inhibitor/seed storage/LTP family
MAALMMKNKKQMPAVVALAVVVAAAALVASASAAITCGQVGSALAPCIPYATGKASALPSSCCGGVRSLNSAARTSSDRQAACRCLKSLASTVKSVNMGTVATIPVKCGVSVPFPISMSTDCNKVN

SEQ ID NO: 13422 - DNA, 801 bp, Panicum virgatum
  misc_feature: Ceres CLONE 1769553
  misc_feature: Encodes the peptide sequence at SEQ ID NO. 13423
cttggttggttggttcgttcgttggttcgtcgcctccgtccccaggaagagcgattcgtcggtgacaccccgcgagcatgctgtccttgcgctgccacgccgccgcgccggcgacccgcggcgtcgcatgtgaacatggggggcgctcctcgtttcctctgcgacggagataaataagatcgacggagaaaaaaaaggattcttgaagcgattgcggcggccgaataggagggagggaggccggccggcggcgggctcgcctgcgttctctgcgatgaagtacgtctccgggccgtacttcgagccggacttcgatccgctcctcgatcgcttcggcactcccggggtcgtcgtcgacaacgagacgcgcgaggactgcacgctcgtgaaggttgacagcgtgaaccgggacggcgtgctgctggagatggtgcagctgctcaccgatctcgacctcgtcatctccaagtcctacatctcctccgacggcggctggctcatggatgtgttccacgtcacggaccagatcgggcgcaagctgacggacccgtcactccccgagttcatccagcgggcgctcgtgccgtcccaccggcccggcaacggcccgtcgcccaggttcacgacgtgcctcggcaacgtgatcggccccggcggccccgacgtgtcggactgcgccgccctcgagttcacggtgcacgaccggccggggctcctgtcgtccatcacctccgtgctggccgacaacgggtgccacgtcgagtcggggcaggcgtggacgcacaacgggcgcgccgcggg

SEQ ID NO: 13423 - protein, 175 aa, Panicum virgatum
  misc_feature: Ceres CLONE 1769553
  misc_feature: SWISSPROT Homolog: EC 2.7.7.59 [Protein-PII] uridylyltransferase
MKYVSGPYFEPDFDPLLDRFGTPGVVVDNETREDCTLVKVDSVNRDGVLLEMVQLLTDLDLVISKSYISSDGGWLMDVFHVTDQIGRKLTDPSLPEFIQRALVPSHRPGNGPSPRFTTCLGNVIGPGGPDVSDCAALEFTVHDRPGLLSSITSVLADNGCHVESGQAWTHNGRAA

SEQ ID NO: 13424 - DNA, 776 bp, Panicum virgatum
  misc_feature: Ceres CLONE 1769558
  misc_feature: Encodes the peptide sequence at SEQ ID NO. 13425
tgttgttaagagctgctgtggtagaagaaagaagaagaacaagagttacatggatagccaaagccgtattatgaagagaacagaatcttcggctcccatcttcaacatggaagacatcgaagagggtattgaaggttatgaggatgaaaggtcagtgcttatgtcccagaggaaattggagaaacgctttggccagtccccaattttcattgcatccacctttatgactcaaggtggcataccaccttcaacaaacccagcatctctactaaaggaagctattcatgtcatcagctgtgggtatgaggacaaaactgaatggggcaaagagattggctggatctatggttcagttactgaggatattttgactgggtttaaaatgcacgcaagaggctggcagtcaatctactgcatgccaccaaggccttgtttcaagggttctgcaccaatcaatctttctgatcgtcttaatcaggtgctccgttgggctcttgggtcagttgaaattctgcttagcagacattgtcctatctggtatggctacaatgggcggttgaagcttctggagaggctggcttacatcaacaccatcgtttatccaatcacatccattccacttatcgcctattgtgtgcttcctgctatctgtctccttaccaataaatttatcattcctgagatcagtaattatgctgggatgttcttcattcttcttttcgcctccatttttgctactggtatattggagctcagatggagtggtgttggcattg

SEQ ID NO: 13425 - protein, 258 aa, Panicum virgatum
  misc_feature: Ceres CLONE 1769558
  misc_feature: SWISSPROT Homolog: EC 2.4.1.12 Cellulose synthase (UDP-forming)
  misc_feature: Useful for making plants with altered cell wall content and/or composition
  misc_feature: Useful for making plants with modulated biomass
  misc_feature: The sequence is a functional homolog of SEQ ID NO 6 in US patent 7285702
  misc_feature: Useful for making plants with altered carbohydrate content
  misc_feature: The sequence is a functional homolog of SEQ ID NO 26 in US patent 7312377
  misc_feature: The sequence is a functional homolog of SEQ ID NO 2 in US patent 7049481
VVKSCCGRRKKKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGI

SEQ ID NO: 13426 - DNA, 571 bp, Panicum virgatum
  misc_feature: Ceres CLONE 1769563
  misc_feature: Encodes the peptide sequence at SEQ ID NO. 13427
atctcccaccataactctctcaccccccctttacgcctgcctgtctgtccctcccgctctgctccgcacactcggcgcaggtgcagcgtccctgctctgctccccacccggcgcccgcattgctgccggagagcggaggcggaccaccggccgcggcggcggaaccaggaggaggaggggcaggaagagaggcggcaggatgttcgggcgggacccgtggggcgggccgctggagatctccaacgccgactcggcgacggacgacgaccggagccgggacctggaccgggcggcgctgatgcggcagctggacgagacgcagcagagctggctcctagccggcccgggcgaccaggcgggcaagaagaagaagaagtacgtcgacctcggctgcgtcgtcctcgaccgcaagatcttcatgtggaccgtcggcaccatcctcggcctcggcgtcttcatcgacttcatcatgatgatagtcaagctcgtcccgcacaagcgcccgccgccgccgccgcccgattacttggatccatttggcgtgttcgagctaagtgagagatgatgttag

SEQ ID NO: 13427 - protein, 121 aa, Panicum virgatum
  misc_feature: Ceres CLONE 1769563
  misc_feature: SWISSPROT Homolog: EC 3.2.1.4 Cellulase
  misc_feature: Useful for making plants with altered cell wall content and/or composition
  misc_feature: Useful for making plants with altered carbohydrate content
MFGRDPWGGPLEISNADSATDDDRSRDLDRAALMRQLDETQQSWLLAGPGDQAGKKKKKYVDLGCVVLDRKIFMWTVGTILGLGVFIDFIMMIVKLVPHKRPPPPPPDYLDPFGVFELSER

SEQ ID NO: 13428 - DNA, 707 bp, Panicum virgatum
  misc_feature: Ceres CLONE 1769565
  misc_feature: Encodes the peptide sequence at SEQ ID NO. 13429
gcctcacacaaacgcatcgagctcagactcagagaactgagaagccaaagaagaacctctccctctcgtttcctgcacgaatccggcttccatccatcgatcggaacaccacacactgccagccggacgcagccgatcaagggcaatgggcgagctgatccccgggttgccggaggaagtggcgcgggagtgcctcgtccgggtgggcttcgaccagctgcccgtggtgcgccgcatctcgcgccagtggaagtcggagttggagtcgccggactaccaccgcctgcgccgggccgaggggctggcgcgcccggtgctcgcgctggtccaggcgagccccgcgccgccggccgacggcgacgcgggcacggctgcggacaagcagcgctcctcggcggcgggccccgcgaactcgtaccggatggtgctgctggacccggaggagggccggtgggcgccgctgccggcgccgcccgggccggcggggagcctgcccctgttctgccaggtggccgccgtgggcggcggcgggcaggggcggaagcggctggtggtcgtcggcggctgggacccggagacgtgggcgccggtggacgcggtgctcgtgtacgacttcctgaccggcgcgtggcgccgcggcgcgccgatgccgggcccccgccggtccttcttcgcctgcgcggccgtcggcggggccgtgtacgtgg

SEQ ID NO: 13429 - protein, 187 aa, Panicum virgatum
  misc_feature: Ceres CLONE 1769565
  misc_feature (118)..(169): Pfam Name: Kelch_1 Pfam Description: Kelch motif
  misc_feature (3)..(50): Pfam Name: F-box Pfam Description: F-box domain
MGELIPGLPEEVARECLVRVGFDQLPVVRRISRQWKSELESPDYHRLRRAEGLARPVLALVQASPAPPADGDAGTAADKQRSSAAGPANSYRMVLLDPEEGRWAPLPAPPGPAGSLPLFCQVAAVGGGGQGRKRLVVVGGWDPETWAPVDAVLVYDFLTGAWRRGAPMPGPRRSFFACAAVGGAVYV

SEQ ID NO: 13430 - DNA, 829 bp, Panicum virgatum
  misc_feature: Ceres CLONE 1769566
  misc_feature: Encodes the peptide sequence at SEQ ID NO. 13431
acccatatataccgcccttgctgattcgcagtgcagcaaagcaaagcagcagaggcggcttcgccctgcccctgcccgacgccttggtgccgcgcgccatggccggcaccaagagcaggtcctccgccaaggccggctcgcctctgctcggcaagtacgagctcggcggcctcctgggccgcggcaccttcgccaaggtctaccacgcgcgctgcctcgcggggggcgaccccgtggccgtcaaggtgctcgacaagcccgggctggccgccacgggcatggcggcgcgcgtcctgcgcgaggtctccgccatgcgccgcctccgccaccccaacgtgctccgcctccacgaggtgctcgccacgcgctccaaggtgtacctcgtcatggagctggcccccggcggggacctcctgtcccgcctcgccgccctgcccgcgcgccggctccccgagcccgccgcgcgccgcgtcttcctgcagctggtgtcggcgctcatctacagccacgcgcgcggggtgttccaccgcgacgtcaagccgcagaacgtgctcctcgacgccgacggcaacctcaaggtctccgacttcggcctcgccgcgctcccggactcgctccgcgacgacggccgcctgcacaccgcctgcggcacccccgccttcgccgcgcccgaggtgctccgccgcaaggcctacgacggcgccaaggccgacgcctggtcctgcggcgtcatcctcttcgtcctcctcgcgggccacctccccttcgacgacgccaacatcgccgacatgtgccgcagggcgcaccgccgcgagtacgtggtcccgcg

SEQ ID NO: 13431 - protein, 243 aa, Panicum virgatum
  misc_feature: Ceres CLONE 1769566
  misc_feature (20)..(241): Pfam Name: Pkinase Pfam Description: Protein kinase domain
  misc_feature: SWISSPROT Homolog: EC 2.7.11.1 Non-specific serine/threonine protein kinase
MAGTKSRSSAKAGSPLLGKYELGGLLGRGTFAKVYHARCLAGGDPVAVKVLDKPGLAATGMAARVLREVSAMRRLRHPNVLRLHEVLATRSKVYLVMELAPGGDLLSRLAALPARRLPEPAARRVFLQLVSALIYSHARGVFHRDVKPQNVLLDADGNLKVSDFGLAALPDSLRDDGRLHTACGTPAFAAPEVLRRKAYDGAKADAWSCGVILFVLLAGHLPFDDANIADMCRRAHRREYVVP

SEQ ID NO: 13432 - DNA, 2417 bp, Panicum virgatum
  misc_feature: Ceres CLONE 1769568
  misc_feature: Encodes the peptide sequence at SEQ ID NO. 13433
agctagcttcccccattccagctccagcaaccagatgcgctcccccgtgagagccctaccgccgccatccgcagcgctcctcccccggcccgtccccgccgccgggtagcccgatccgacggcccccgccgcccccatgggccgcggcgccgccgccgcgatgccgccgtggcacgcgctcccggacgaggtctgggagcatgccttctccttcctccccgcgtactcggaccggggcgccgccgcggccgcctgccgctcctggcttcgcgccgagcgccgctcacgccgccgcctcgccgtcgccaactgctacgctgcatccccgcaggacgccgtcgaccggttcccgtccgtacgcgccgtcgaggtcaagggcaagcctcacttcgcggacttcgggctcgtgccgcccggctggggcgccgccgccgcaccatgggtcgccgccgctgccgacgggtggccgctgctcgaggagttcagcttcaagcgcatggtcgtcaccgacgactgcctcgagatgatcgcggcctccttcaggaacttccaggtgctgcgcctcgtatcctgcgagggattcagcaccgccgggctcgctgccattgccgccggctgcaggaatctaagagaacttgacctgcaggagaatgagattgaggattgctctattaattggctcagtctctttccagaatccttcacttctttggtaactctaaatttttcatgcttagaaggggatgtcaatatagctgtacttgaacgactaataaccagatgccgtaacctcaagactctcaaggtcaacaattctatacctcttgacttgcttgctagcctccttcgcaaggctcctcagattgtagagctcggaacaggaagattctctgcggattaccatctgagtctcttttcaaaacttgaagcagcatttgctggttgtaaaagcctaagaaggctttctggggcttgggatgctgttccagagtacctgccagcattttattgcgtatgtgagggcctcacatcactaaatctgagttatgctactgtacgaggccctgagctgattaaattcattagcagatgcaagaatctgcaactcttatgggtgatggatttaattgaggaccacggtcttgctattgtggcatcatcttgtaataaattgcaggaattgcgggtcttcccttcttctccttttgatgcagccgagcaggtttcattgactgaaagaggtcttgttgatgtctctgccagttgcccaatgttggaatcagtcctatacttctgcagacggatgaccaatgaggctcttattactattgcaaagaatcggcccaacttcacttgcttccgcctatgcatattagagccacacacaccagattacatcacgcatcagcctcttgatgcaggttttagtgccattgtggaatcatgcaagggccttaggcggctttctgtctcaggccttctcacagaccgtctatttaaatccatcggagcacatgctgatcgtctcgagatgctttcaatagcctttgctggcaacagtgacttgggccttcattacatcctttctggctgcaagagcttgaagaaactggagatcagggactgcccatttggtgataagcctttgctggcaaatgctgccaagctggagacaatgcgatccctttggatgtcgtcgtgctcactgaccctgggcgcatgcagacagcttgcacgcaagatgccccgccttagtgtggaggtcatgaatgatcctcgacgggcatgctccttggactcgcttacggatgagagccctatcgagacattgtatgtctaccggacaattgcaggtccaaggtcggacacaccagcctgcgtccagattgtttagggggtggcgacctgtagtatgggaagatactatggagtatccattttcagtctctcagcacctcccttgcataacatggatagtctccttgaagttgatgggctggtgatctggtatcataatctctgttcagatgggaaactgttgctgcgagtttaagggcgagactcgggacccctttcaggtgttaataactgcagggaggagactggacgagttacagaaaccactagatagcgtcttgagaaaacttgggtttgttttcttagcgtgtttagttctttttatgtataaaaaatatggaatcattccaatgtcgcaatgtacttatactatcggaacaattgtaccaggagcttctgcttttttgacctcccctctctagtctctaatcatgggctgttgctccaacttgtagtgatatgtgaatgaagaataattcaagcttgtctcgagaactgtacctcaccgagggtttatcctcctgtgatttcggggtgaaatttaaattgcttctgaatcc

SEQ ID NO: 13433 - protein, 585 aa, Panicum virgatum
  misc_feature: Ceres CLONE 1769568
  misc_feature: Useful for making plants with altered carbohydrate content
MGRGAAAAMPPWHALPDEVWEHAFSFLPAYSDRGAAAAACRSWLRAERRSRRRLAVANCYAASPQDAVDRFPSVRAVEVKGKPHFADFGLVPPGWGAAAAPWVAAAADGWPLLEEFSFKRMVVTDDCLEMIAASFRNFQVLRLVSCEGFSTAGLAAIAAGCRNLRELDLQENEIEDCSINWLSLFPESFTSLVTLNFSCLEGDVNIAVLERLITRCRNLKTLKVNNSIPLDLLASLLRKAPQIVELGTGRFSADYHLSLFSKLEAAFAGCKSLRRLSGAWDAVPEYLPAFYCVCEGLTSLNLSYATVRGPELIKFISRCKNLQLLWVMDLIEDHGLAIVASSCNKLQELRVFPSSPFDAAEQVSLTERGLVDVSASCPMLESVLYFCRRMTNEALITIAKNRPNFTCFRLCILEPHTPDYITHQPLDAGFSAIVESCKGLRRLSVSGLLTDRLFKSIGAHADRLEMLSIAFAGNSDLGLHYILSGCKSLKKLEIRDCPFGDKPLLANAAKLETMRSLWMSSCSLTLGACRQLARKMPRLSVEVMNDPRRACSLDSLTDESPIETLYVYRTIAGPRSDTPACVQIV

SEQ ID NO: 13434 - DNA, 996 bp, Panicum virgatum
  misc_feature: Ceres CLONE 1769573
  misc_feature: Encodes the peptide sequence at SEQ ID NO. 13435
aggtctctatctaaccactaaaccaccggcgcgctctgcatcgttaaccctcccttgtcccactaacccaaccatgatttgcctcaaagccttctcatcccctctccacctcccgacgctccgccgcctcgccccttcctcttcctccctccgcgtcgccgccgccgccatgtcctcctccgcggtcgccgccccggtcgagcacatcgtgctcctcaaggtccgtccggaggcggtcgcctcgggcgccgccgcggcgatggtctccacgctgcaggcgctcgccacgcaggtcccgggcctggcctacatccacgcgggccccgtcctccgcctccgctccccggccgccgatgcgctgggccccacgcacctcctccactcccgctacgccaccaagcaggacctggcgacctacgcggcgcacccggcgcacgtggccgccgtgcaggggcacgtgctccccaacgcgctcgacaccaccgccatcgactgggtcaacgccgcggagctcccgtcccccgtgaatcccggcagcgccgtgcggctcacgctcgccaaggtgaaggagggggtggaggtcccgcagctcgtggagaaggtggccgcggcgaccaaggccgccggggaggccaagggcgccaaggtgagcctcggggagaacttctcccccgcgcgggccaaggggtaccagttcggaatggtggcggtgttcgacagcgtggaggagctcgacgcggtggaaggggacggtaaggtggaggaggccaaggccgcggtcaggccgctgctcgacgaggtcctggtcctggacttcgttgccgggcctgctgccggcgaggctccaacgccggcgagcctctgagagatttcaggtgcgggttcagtttcgagtgtgctggcgatttgggaataatagactgtttgtggttgtcatgttgtgaaattgggagtggcagtgcgatgaataagaattgcttcccttgattgaggatc

SEQ ID NO: 13435 - protein, 263 aa, Panicum virgatum
  misc_feature: Ceres CLONE 1769573
  misc_feature (42)..(143): Pfam Name: Dabb Pfam Description: Stress responsive A/B Barrel Domain
  misc_feature (156)..(250): Pfam Name: Dabb Pfam Description: Stress responsive A/B Barrel Domain
MICLKAFSSPLHLPTLRRLAPSSSSLRVAAAAMSSSAVAAPVEHIVLLKVRPEAVASGAAAAMVSTLQALATQVPGLAYIHAGPVLRLRSPAADALGPTHLLHSRYATKQDLATYAAHPAHVAAVQGHVLPNALDTTAIDWVNAAELPSPVNPGSAVRLTLAKVKEGVEVPQLVEKVAAATKAAGEAKGAKVSLGENFSPARAKGYQFGMVAVFDSVEELDAVEGDGKVEEAKAAVRPLLDEVLVLDFVAGPAAGEAPTPASL

SEQ ID NO: 13436 - DNA, 790 bp, Panicum virgatum
  misc_feature: Ceres CLONE 1769579
  misc_feature: Encodes the peptide sequence at SEQ ID NO. 13437
acaacagccgacaaccagacgcgcgagggttttcccttccacaaccccccgcctccgcccgcgagaagtcggctgcgctccgcctccgccgccggccctcgctcctcggttaactaatcatccacactcagtcaagatgtctgacagccatgagactgataggaacattgagatttggaagattaagaagctgatcaaggcattggagtccgccagaggcaatggcacaagcatgatctctcttatcatgcctccacgtgatcagattgctcgagtggctaagatgttaggtgatgaatatggtactgcttcaaacatcaagagtagagttaatcgtcaatctgtgttggctgctatcacctcagctcaacagaggttgaagctctacaacaaagtgcctccgaatggattggttctctacactggaaccattgttactgaagatggaaaggaaaagaaagttactattgattttgagcccttcaagcctattaatgtgtcgctatacctttgtgacaacaagttccacactgaggctctaaatgagctcttagaatctgatgacaagtttgggttcattgtcatggatggtaatggtactcttttcggcacactaagtggcaatacccgtgaagtgcttcacaagttcactgttgatctcccaaagaagcatggtagaggaggacagtctgctttgcgttttgctcggcttcggatggagaaacgccacaactatgtccgcaaaacagctgagcttgctacacagtttttcatcaatccagctactagt

SEQ ID NO: 13437 - protein, 217 aa, Panicum virgatum
  misc_feature: Ceres CLONE 1769579
  misc_feature (6)..(140): Pfam Name: eRF1_1 Pfam Description: eRF1 domain 1
  misc_feature (144)..(217): Pfam Name: eRF1_2 Pfam Description: eRF1 domain 2
MSDSHETDRNIEIWKIKKLIKALESARGNGTSMISLIMPPRDQIARVAKMLGDEYGTASNIKSRVNRQSVLAAITSAQQRLKLYNKVPPNGLVLYTGTIVTEDGKEKKVTIDFEPFKPINVSLYLCDNKFHTEALNELLESDDKFGFIVMDGNGTLFGTLSGNTREVLHKFTVDLPKKHGRGGQSALRFARLRMEKRHNYVRKTAELATQFFINPAT

SEQ ID NO: 13438 - DNA, 2132 bp, Panicum virgatum
  misc_feature: Ceres CLONE 1769580
  misc_feature: Encodes the peptide sequence at SEQ ID NO. 13439
ggccaccactgcggcactgccccgtcccccgaatccccgaccccgatggcgacatcgccgccgcagaaccctagctccggcgacccctccgatgcctccagcctcaccgccgccgcgctcgacgtgcccgcgcgcgcttggaaatccctcgtctcgcgcctccctcccctcccggacacctccggtctcctggccgccgtctccgacctccagcgccgctacttcggcgtcccccgccgccgccggcgcagacgcgcagctctgccgctcccgctccgccctgcggccgcgcactctgctcggattgctggagagatgcccaaagcctttgtcatcttagatgatgttgtgcaacacaccctgactaatttgcacagtattcacaaaagcttactattttggcaggccaaggctgagggaacaaattctcagaaagtgtactttatgatctttgagagaggtccaagggcctttgttgatgcaacatatcaaacactcactagacttgggagcaatggacgtccaatccaatacgttctgcattctgcatctgatacagtgtcaacgaaactagctgccctggcaagtatgcaacactgcttggctgcttttcttgcagagattcattctgaagttgatagatgcagagaagggttaactgcaaactcagataaatcactacgtacattattcattgttttaaataccacattctccaaactggaggtatcacttagaaatgctggcaaggggcaagatgaactattcacacatgatggaaactcatatgaactgtttgggaaattaccagaagttgatttagagagtcaagaatggacagagtccttattaacagatggtataagtttaatctatgaaaacattcagaagttagatagttttctgtcctctcagctctcaagccataaaaaaccaaacagattgaccatatactggttaccctacacatgtggggcattgggtctctctgtatgttctctatggcttttacgccatagcaacttgatgggaagtcctgatattgataattggattcaagacgctaaggagtctgtggctggattttgggatgagcatgttgagaaaccaatcatttccattagagatgagctttttgagacattcaaacaaagagataaaggtgtaatggaaaatcaagaggtccaactaacagaagattcattgcgcaggatgctagtagccttctgtgagcaaacagaaggtcgaaagttgccagaagatttacctgtgcaggcaatgttggagactctcacgaagagatatgaaaaggaattggtccacccgattcagaatctgttcagtggagaattagcccgtgccatgctcattcagattcaaaagcttaagctggatcttgaatcgggactactggaaatggatcagattcttagggcaaatgctataaacttcgctgttcttgcagctcttcctgcttttggtctttcgcttctgctgcttatgttactgcgaacatggattcagcgtgaccatggtgcagagggtagaggtaatattgcacgatgtcagcggaggctgcttcttgtcgatgtagagagaaggcttatggagtttcagcactacagggataacggaatggaggaagaggcacggtgcaagtttggattactactttacaccctagataggctatgcaaagttgttgagtcacatgcaaaagaaacaggcgaatggttaagattgagagaagacatttttgatctggcaaagctcgacatggggctgccagacaagatggtcgttgtgtcacgactgaggtggatgtataactgcttgcttccattctcatctagccgtttgccgcgtctctagttttcttgtgtggcgaactggatatcatgtttttgttttggccactctgcgcaagttctacagtgatctactctgggatttagtaaggcagttttggatattttgacacggaatacctgagcttttttggcccgtgcactctgacggaagaatggttctttcggatgttaaatcagagggtgaaaatgtaaagaggtgtattcccgccccagtttctgaaaaattcttgacttgttaaatcgcagggtgtattcccgcct

SEQ ID NO: 13439 - protein, 608 aa, Panicum virgatum
  misc_feature: Ceres CLONE 1769580
  misc_feature (315)..(594): Pfam Name: NCA2 Pfam Description: ATP synthase regulation protein NCA2
MATSPPQNPSSGDPSDASSLTAAALDVPARAWKSLVSRLPPLPDTSGLLAAVSDLQRRYFGVPRRRRRRRAALPLPLRPAAAHSARIAGEMPKAFVILDDVVQHTLTNLHSIHKSLLFWQAKAEGTNSQKVYFMIFERGPRAFVDATYQTLTRLGSNGRPIQYVLHSASDTVSTKLAALASMQHCLAAFLAEIHSEVDRCREGLTANSDKSLRTLFIVLNTTFSKLEVSLRNAGKGQDELFTHDGNSYELFGKLPEVDLESQEWTESLLTDGISLIYENIQKLDSFLSSQLSSHKKPNRLTIYWLPYTCGALGLSVCSLWLLRHSNLMGSPDIDNWIQDAKESVAGFWDEHVEKPIISIRDELFETFKQRDKGVMENQEVQLTEDSLRRMLVAFCEQTEGRKLPEDLPVQAMLETLTKRYEKELVHPIQNLFSGELARAMLIQIQKLKLDLESGLLEMDQILRANAINFAVLAALPAFGLSLLLLMLLRTWIQRDHGAEGRGNIARCQRRLLLVDVERRLMEFQHYRDNGMEEEARCKFGLLLYTLDRLCKVVESHAKETGEWLRLREDIFDLAKLDMGLPDKMVVVSRLRWMYNCLLPFSSSRLPRL

SEQ ID NO: 13440 - DNA, 467 bp, Panicum virgatum
  misc_feature: Ceres CLONE 1769608
  misc_feature: Encodes the peptide sequence at SEQ ID NO. 13441
aaaatattctttccttccgctcaccacccccggcatctcgcgcttcaccaccccgctcgctcttcactcccacccacgagcggctccgctcagctccactggcggcgagatgcggagacagatccctcccgtctcccgcctcgtacacctcgcggcggctatcgcgctgctcgccgccgccgcggcggaggctgcggcgcggcggccgggggtcgtcgcggtcaacgtgacgggcgtgctctcggcgttcccggacctcgccgacttcacgcggctgctggcgtccagccccgtgctggccgagctcgcgggccggtcgtcgctgacgctgctcgccgtgccgaacggcaacctcccgcagtcgccgtcggcgttcgcggtcacgtccggcgccgacgtcgcggacgagctccgggaccacgtcctccgtcggtaccggggcaccgccgatctcccccggctgcagg

SEQ ID NO: 13441 - protein, 119 aa, Panicum virgatum
  misc_feature: Ceres CLONE 1769608
  misc_feature: Useful for making plants with altered carbohydrate content
MRRQIPPVSRLVHLAAAIALLAAAAAEAAARRPGVVAVNVTGVLSAFPDLADFTRLLASSPVLAELAGRSSLTLLAVPNGNLPQSPSAFAVTSGADVADELRDHVLRRYRGTADLPRLQ

SEQ ID NO: 13442 - DNA, 1692 bp, Panicum virgatum
  misc_feature: Ceres CLONE 1769622
  misc_feature: Encodes the peptide sequence at SEQ ID NO. 13443
gcgtccttggcaacttgccattttcctcgcgtccaggccccagccagtctgtcttggtcgccggtggacgacgacgcccaagtcatcgacaacgcccgtcggaacacgggaacgaggcaaagcctgcacttcttcaagctcggaagctggcagtccaccatggactcttcttgcccattggaaagtcctcgcattttccctgttggggcagatttcttcgttacagttctccgataccattttttttctgcaagggcaatcaaacgagagggcccacactgccaccacttaagccggcttaacccccctggcttgagctgccgggcaaccatcactcctcccgcgtcaacacccccgtcaaacctccccaccctcccaaacctttcccagtttcccctcgccggagccggccgcgatgctgtcgctcgccgcccgcgtggccgtaccggccgccgcgctgctgttcctcctggcggcgcccgcctcggcgaccaacttcacctgcgcctcgccgggcacctcctgccggtccgccatcggctacgcggtgcccaacgccaccacctacgcggagctcgccgcccgcttcaacgccaccacgacgctcgccgagctcctcggcgccaacggcctccccgccggcacgcccccctccgcgcccgtcgcggccaaggccaccgtccgcgtccccttcggctgccgctgcgggaggaacggggtggcccactccgacggcgggcccgtctacgtggtgcagccgcaggacgggctggaccacatcgcgcgcgacgtcttcggcgccttcgtcacctaccaggagatcgccaccgccaacggcatcaaggacgtcaacctcatctaccccggccagaagctgctgatcccgctgccctgcacctgcgatccggtggacggcgccgccgtcatgcacttcgcatacagcgtcgccaagggggaagatacggccggcatcgccgccaggttcggggtgaacgagcgcacgctgctgactctgaacaagatcgccgaccccaaggacctgcagcaggggcagatcctggatgtccccctacctgtttgccattcgtcgatcagcaacacctcggctgatcacaatctgctcgtcccgaacggcagctacgcgctcaccgccggagactgcatgcgttgcagctgcagtgcaaacaactacgagcagctagactgttctccagttcagcgcagagggtgcccggccgtgctgccctgcgatgggggcctgaagcttgggcagacgacgaacggcaatggttgcgagtccaagatttgtgcgtacagcggctactccaacaccacgtcgctcagaatacacaccgctcttgtaactgcaaaccagacagcgtgcgaccagaaggggggagcagcgagaacggtgtttgccgggtccatgtggagaatgtccgtgatctccttccacatggtgctcatcctgatctgcttcctttgattgctgtagaggttagaactcgagatggtatccgatttgtgtcgcggtgagattgttgtttaacttgtgtgttgtccatatgttaggtctggtttatccagattttgttggcgattggtgtatatgtttgaataaagcaaagctgagcttgcatccggaagtggttacattttaaaccgcataatccaataataaacaatccccac

SEQ ID NO: 13443 - protein, 356 aa, Panicum virgatum
  misc_feature: Ceres CLONE 1769622
  misc_feature (111)..(157): Pfam Name: LysM Pfam Description: LysM domain
  misc_feature (175)..(218): Pfam Name: LysM Pfam Description: LysM domain
  misc_feature: SWISSPROT Homolog: EC 3.5.1.28 N-acetylmuramoyl-L-alanine amidase
MLSLAARVAVPAAALLFLLAAPASATNFTCASPGTSCRSAIGYAVPNATTYAELAARFNATTTLAELLGANGLPAGTPPSAPVAAKATVRVPFGCRCGRNGVAHSDGGPVYVVQPQDGLDHIARDVFGAFVTYQEIATANGIKDVNLIYPGQKLLIPLPCTCDPVDGAAVMHFAYSVAKGEDTAGIAARFGVNERTLLTLNKIADPKDLQQGQILDVPLPVCHSSISNTSADHNLLVPNGSYALTAGDCMRCSCSANNYEQLDCSPVQRRGCPAVLPCDGGLKLGQTTNGNGCESKICAYSGYSNTTSLRIHTALVTANQTACDQKGGAARTVFAGSMWRMSVISFHMVLILICFL

SEQ ID NO: 13444 - DNA, 798 bp, Panicum virgatum
  misc_feature: Ceres CLONE 1769626
  misc_feature: Encodes the peptide sequence at SEQ ID NO. 13445
cacctcgccggatacgacagcgtcaaggaggaagacttgaagcaattcaggcaatgggggagcaggactcccggtcaccccgagaactttgagactccaggagttgaagttaccactggaccccttggtcagggtattgccaatgctgttgggttggcacttgccgagaagcacctggctgctcgcttcaacaagcctgacagtgagattgtcgaccactacacgtatgttattttgggagacggttgccaaatggagggtattgccaatgaagcttgctccttggctggacattggggtcttggcaagctgattgctttctacgatgacaaccacatttccattgatggagatacagagatcgcgttcacagaggatgtgagcacccgttttgaggctcttgggtggcatacaatctgggtcaagaacggaaacaatggctatgatgacattcgtgcagccattaaggaagcaaaggcagttactgacaagcctaccttaatcaaggtgactaccacaattggttttggatctccaaacaaggccaactcatacagcgttcacggaagtgcattgggcagcaaagaggtcgaagcaaccaggcaaaaccttggatggccctatgagccattctttgtgccggaggatgtcaagagccactggagccgccacacacccgaaggtgctgcacttgaggctgaatggaatgctaagtttgcagagtatgagaacaagtacgcagaggatgcagcaaccttgaaaagtatcatctcaggggagttccctgctggctgggct

SEQ ID NO: 13445 - protein, 265 aa, Panicum virgatum
  misc_feature: Ceres CLONE 1769626
  misc_feature (1)..(262): Pfam Name: Transketolase_N Pfam Description: Transketolase, thiamine diphosphate binding domain
  misc_feature: SWISSPROT Homolog: EC 2.2.1.1 Transketolase
  misc_feature: Useful for making plants with modulated biomass
HLAGYDSVKEEDLKQFRQWGSRTPGHPENFETPGVEVTTGPLGQGIANAVGLALAEKHLAARFNKPDSEIVDHYTYVILGDGCQMEGIANEACSLAGHWGLGKLIAFYDDNHISIDGDTEIAFTEDVSTRFEALGWHTIWVKNGNNGYDDIRAAIKEAKAVTDKPTLIKVTTTIGFGSPNKANSYSVHGSALGSKEVEATRQNLGWPYEPFFVPEDVKSHWSRHTPEGAALEAEWNAKFAEYENKYAEDAATLKSIISGEFPAGW

SEQ ID NO: 13446 - DNA, 1591 bp, Panicum virgatum
  misc_feature: Ceres CLONE 1769628
  misc_feature: Encodes the peptide sequence at SEQ ID NO. 13447
cccgatttttttttccggcctataacttcgcccccgttcccccctgtgcgcccccgtccgtcgtcttcgcgaggtcgaaccccaaggcgaggcagcgaaaccctcaagggctagtgcgaggggagagagagcgcgcgaggcggccaagggcgagatgaagctcaacgtcaagaccctcaagggcaccagcttcgagatcgaggcgagccccgaggagacggttgctggggtgaagcggatcatcgagacaaatcagggtcagagtgtctaccccgcggacagtcagttgctcatataccaagggaaaattctcaaggatgacaccactttggaaagcaacaaggttgccgagaacagcttccttgttataatgctgtccaaggctaaggcatcgtcaagtggaccttctaccgctactcctgcaaaagctcctgcaactccggcccaacctgctacgcctgcagcccctgctgcttcagttgcaagatcaacacctccacaagcacctgttgccacggcagtaacggcacctccaagtgcacagccttcacctgctcctgctccagctgctactactgctgcatctgatgctgatgtatacggtcaggcagcatcgaatcttgtctctggcaacactctagaacagactatccaacagattcttgacatgggtggtggtacgtgggaacgtgatactgttgtccgtgctctacgagctgcatataataaccctgagagggcaattgattacctgtattctggaattcctgaggatgttgaggccccgcctgtggcccgggcacctgcttctggccaacaaacaaatccacaggctccttcacttgctcaggctacagttgcaccaccagtgcagccatccgctgcctctgcagggcctaatgcaaatcctctaaacctttttcctcagggtgttccaagtggtggggccaatccagctgctggtgctggtgcaggagctggtgccctcgatgccttgcgacagcttccacagtttcaagcactgcttcagttggtccaggctaatcctcaaatcttacagccaatgcttcaagagctaggcaaacaaaacccacaaatcctacggttgattcaggaaaatcaggctgagtttctccgcttggtgaatgaaagtcctgagggtggtgctggaggaaacatactaggtcaactagcagcagcaatgccacaagcggtgacagttactccggaggaacgggaggctatccagcggctcgagggaatggggttcaatcgtgagcttgtgctggaggttttctttgcgtgcaacaaggacgaggaacttgctgccaactacctcctggatcacggccatgagttcgacgagccgccgcaatagatgctagattggtgatatcgtgggggtggaggtgggggggaaacccagggagaagcagagcagctcagtgtcgttcttttattccttctggcagttgagtaatacctggtcgtctatgcagtgctgctgactatcttttatttccatatatgtgtcggaaatgctttctaagtacatattaattccatatttcgtgccctcggggtgttgtgc

SEQ ID NO: 13447 - protein, 407 aa, Panicum virgatum
  misc_feature: Ceres CLONE 1769628
  misc_feature (278)..(336): Pfam Name: XPC-binding Pfam Description: XPC-binding domain
  misc_feature (161)..(200): Pfam Name: UBA Pfam Description: UBA/TS-N domain
  misc_feature (359)..(395): Pfam Name: UBA Pfam Description: UBA/TS-N domain
  misc_feature (6)..(78): Pfam Name: ubiquitin Pfam Description: Ubiquitin family
MKLNVKTLKGTSFEIEASPEETVAGVKRIIETNQGQSVYPADSQLLIYQGKILKDDTTLESNKVAENSFLVIMLSKAKASSSGPSTATPAKAPATPAQPATPAAPAASVARSTPPQAPVATAVTAPPSAQPSPAPAPAATTAASDADVYGQAASNLVSGNTLEQTIQQILDMGGGTWERDTVVRALRAAYNNPERAIDYLYSGIPEDVEAPPVARAPASGQQTNPQAPSLAQATVAPPVQPSAASAGPNANPLNLFPQGVPSGGANPAAGAGAGAGALDALRQLPQFQALLQLVQANPQILQPMLQELGKQNPQILRLIQENQAEFLRLVNESPEGGAGGNILGQLAAAMPQAVTVTPEEREAIQRLEGMGFNRELVLEVFFACNKDEELAANYLLDHGHEFDEPPQ

SEQ ID NO: 13448 - DNA, 800 bp, Panicum virgatum
  misc_feature: Ceres CLONE 1769635
  misc_feature: Encodes the peptide sequence at SEQ ID NO. 13449
acgcctgcctggctgtctgtccctcccgctctgctccgcacactcggtgcaggtgaagcgtcgtcccctgctctgctccccaccccacccagcgcccgcattgccgccggtgagcggaggcggaccggccgcggcggcgcgggggaggaaccaggaggaggggcgggaagagaggcggcaggatgttcgggcgggacccgtggggcgggccgctggagatctccaacgccgactcggcgacggacgacgaccggagccgggacctggaccgggcggcgctgatgcggcagctcgacgagacgcagcagagctggctcctcgccggcccgggcgaccaggcgggcaagaagaagaagaagtacgtcgacctcggctgcgtcgtcctcgaccgcaagatcttcatgtggaccgtcggcaccatcctcggcctcggcgtcttcatcggcttcgtcatgatgatcgtcaaactcgtaccgcacaagcgcccgccgccgccgccgcccgaccagtacacgcaggcgctgcacaaggcgctcatgttcttcaacgcccagcgatctggtccgctgcccaagcacaacggcgtcagctggaggggcaattcctgcatgaaggatggtctctcggacagcaccgtccggcggagcttggtcgggggcttctacgatgcaggggacgccatcaagttcaactaccccatggcctggtccatgaccatgctcagctggagtgtgatcgagtacaaggccaagtatgaggccatcggcgagctcgaccatatcaaggagctgatcaagtgg

SEQ ID NO: 13449 - protein, 205 aa, Panicum virgatum
  misc_feature: Ceres CLONE 1769635
  misc_feature: SWISSPROT Homolog: EC 3.2.1.4 Cellulase
  misc_feature: Useful for making plants with altered cell wall content and/or composition
  misc_feature: Useful for making plants with altered carbohydrate content
MFGRDPWGGPLEISNADSATDDDRSRDLDRAALMRQLDETQQSWLLAGPGDQAGKKKKKYVDLGCVVLDRKIFMWTVGTILGLGVFIGFVMMIVKLVPHKRPPPPPPDQYTQALHKALMFFNAQRSGPLPKHNGVSWRGNSCMKDGLSDSTVRRSLVGGFYDAGDAIKFNYPMAWSMTMLSWSVIEYKAKYEAIGELDHIKELIK

SEQ ID NO: 13450 - DNA, 622 bp, Panicum virgatum
  misc_feature: Ceres CLONE 1769635-R
  misc_feature: Encodes the peptide sequence at SEQ ID NO. 13451
cctaatattctcgtcggagcaatggtggctggccctgacaggcatgatggtttcaaagatgtccgcacaaactacaattacacagagcctactcttgcagcaaatgctggtttggtcgcagcactgatttctatagctgatataccaactggaaggtacagcatcgataagaacacaatcttctctgcaattcctcctatgttcccaacacctccaccgccgccatcagcatggaaaccataaagagacagacctctgaatattttccaagcatcaaactgggaagtggagcaacatatgatcgtttggtgcagcaaaggccagaaacagaatatcagatgacataagcttatagagcttctatttctgtaccagtttgacagatcagtataaaatcttctgtcaaacatagatcggaagttgtgtgcaccgcgtgaagctaatttttggggtccttgttgctattggcattccagctcatgtgtgaagttatttttgtagaaatggcacctttacaaaaaaaatttataggagtgacttttcatcatagtaaagaatttgtgtgacctctatgcttgcttcattttgatcctgtcattttatatttaaaagttcctatttc

SEQ ID NO: 13451 - protein, 80 aa, Panicum virgatum
  misc_feature: Ceres CLONE 1769635-R
  misc_feature: SWISSPROT Homolog: EC 3.2.1.4 Cellulase
  misc_feature: Useful for making plants with altered cell wall content and/or composition
  misc_feature: Useful for making plants with altered carbohydrate content
PNILVGAMVAGPDRHDGFKDVRTNYNYTEPTLAANAGLVAALISIADIPTGRYSIDKNTIFSAIPPMFPTPPPPPSAWKP

SEQ ID NO: 13452 - DNA, 821 bp, Panicum virgatum
  misc_feature: Ceres CLONE 1769645
  misc_feature: Encodes the peptide sequence at SEQ ID NO. 13453
gataacctcacctcggcggcgtcttcacaaacgccggccattgcacgctcgcctccgtaccggatccgttcgagagagaggttcgcttgatccgaaggcttcgcgcgcgggatcttgaggcgaggcgaggaggaagatgagggagtgcatctcggtccacatcgggcaggctggcatccaggtcggcaacgcgtgctgggagctttactgcctcgagcacggcatccagcctgatggccatatgcccggagataagactgtgggacactatgatgatgccttcaccaccttcttcagccagactggcgcagggaagtatgtgcctcgtgcaatcttcgttgatcttgaacccactgtgatcgatgaggtgcgcactggcatgtaccgtcagcttttccaccctgagcagctcatcagtggcaaggaggatgctgccaacaacttcgcccgtggccactatacaattggcaaggagattgttgacctgtgccttgaccgcatccgcaagcttgctgacaactgcactggccttcaggggttcctggtcttcaatgctgttggtggtggcactggttctggccttggttcactcctcctcgagcgcctatctgtggactacggcaagaaatccaaactgggcttcaccgtatacccttctccccaggtgtcaacctctgttgttgagccctacaacagcgtgctctccacccattcactcttggagcacactgatgtctccatcctgctcgacaacgaggccatctatgacatctgcaggcgctccctggacattgagaggcccaactactccaacctgaatc

SEQ ID NO: 13453 - protein, 228 aa, Panicum virgatum
  misc_feature: Ceres CLONE 1769645
  misc_feature (47)..(227): Pfam Name: Tubulin Pfam Description: Tubulin/FtsZ family, GTPase domain
  misc_feature: Useful for making plants with altered cell wall content and/or composition
MRECISVHIGQAGIQVGNACWELYCLEHGIQPDGHMPGDKTVGHYDDAFTTFFSQTGAGKYVPRAIFVDLEPTVIDEVRTGMYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPNYSNLN

SEQ ID NO: 13454 - DNA, 789 bp, Panicum virgatum
  misc_feature: Ceres CLONE 1769646
  misc_feature: Encodes the peptide sequence at SEQ ID NO. 13455
aggccacgccatttccccgaccaccaccgaccgacgaatcccgcgcccggctgctcgcctgctcccaccaccccccacccgcatcggcgacgacagatccaggccggccggccggcgtgaaggcgcgcgatgggcggccgcaagcgcgcgctcctggtggggatcaactacccgggcaccaaggccgagctcaagggctgccacatcgacgtcgaccgcatgcgccgcagcctcgtcgaccgcttcggcttcgacgagaacgacatccgggtcctctccgacaaggaccgcgcggggccgcagcccacgggggccaacatccgccgcgccctcgcccgcctcgtcgccgacgcccgccctggggacttcctcttcttccactacagcgggcacggcacgcggctgcccgccgagacaggccagcaagacgacaccggctacgacgagtgcatcgtgccatgcgacatgaacctcatcacagatcaggattttagagacctcgtgcagaaggtccctgatggctgcctatttaccatagtttctgactcttgccacagtggtggcctactggacagtgctaaggagcagataggtaatagcaccaggcagaataagacccagtcctgtgaacctgaagagcgacctgattctggttctggcagcggcttccggtcattcctcaaggagactgtccgcgatgtgttcgagtcagagggaatccacatccctcatagccgccatagccatagccaccatggaggtgacgaccaggatgaggcttctgaacag

SEQ ID NO: 13455 - protein, 219 aa, Panicum virgatum
  misc_feature: Ceres CLONE 1769646
  misc_feature (5)..(203): Pfam Name: Peptidase_C14 Pfam Description: Caspase domain
MGGRKRALLVGINYPGTKAELKGCHIDVDRMRRSLVDRFGFDENDIRVLSDKDRAGPQPTGANIRRALARLVADARPGDFLFFHYSGHGTRLPAETGQQDDTGYDECIVPCDMNLITDQDFRDLVQKVPDGCLFTIVSDSCHSGGLLDSAKEQIGNSTRQNKTQSCEPEERPDSGSGSGFRSFLKETVRDVFESEGIHIPHSRHSHSHHGGDDQDEASE

SEQ ID NO: 13456 - DNA, 1285 bp, Panicum virgatum
  misc_feature: Ceres CLONE 1769648
  misc_feature: Encodes the peptide sequence at SEQ ID NO. 13457
ggtaccatctcgctcgttggtcagtcgccgtctgctcgatccccaccatccccaccggcagcaccggccggccgccgcggtgagcggaaagcagccatggcctccaagcagatggaggagatccagcggaagctgtccctgctcgccaacccgcgggccaacgcccccgcgcagtccctcctcttcgccggcgtcgagcgctaccgcctcctcgagtggctgttcttccggctcctaggcgacagatcgccgttcacgcagcagaactggcagggggatagcctggaccgcgatgaggagaacaacagaatccaacacctggcggagatagctaacttcctgggcatcactccttcagtggacaccgaagcgattcagggtagaagcagctatgaggagcgggtggaactgctccgtctcattgtcgatctagtggaagctagttgctatgccgacaatccagaatggagtgttgatgagcaattggcgaaggatgtgcaactcgtagactcaattgctgagaaacaagcccaaattttttcagaggagtgcaagctttttcctgcagatgttcaaatacaatcaatataccctttacccgatattgcagaactagagttgaagctctctgagtatacaaaaaagatgtccaatttgcagcagatggttcaggaattggcatcaaagtatgattacaacccaaatgaagactatgctgagacagagttgaagttgagggaatatttgcaatcatttttggaaacggttaaatccttcaatacaatatatactaaggaaattcatccttggacccacatgatggaggtgccacaactgcatggctttggtccagccgctaatcgcctgttagaggcatataacacccttttaaagttcctaggaaatctgaggagtctgcgagattcatatactgcaatggctgctgggtcactgtcggcgtctaatgagccttcgtcagtcgccaaaattatttcagactgcgaatctgcactgacatttttgaatcacagcctttccatcctttcaacttccctggcacgggagcaaggggaaacactatgattctacagcaccggtggtctatcaggatacagttccagggaacctatcgaagcctgtagtgattcaattgcttttagtttcaggtgaggcatgtagtaaaggttttgtgccatttgttggcgtgctcctatggctgtagtttgtaactcaagagattgaaataacttactaaaaattatatctagagttcttttggaggttc

SEQ ID NO: 13457 - protein, 328 aa, Panicum virgatum
  misc_feature: Ceres CLONE 1769648
  misc_feature (1)..(324): Pfam Name: Plant_NMP1 Pfam Description: Plant nuclear matrix protein 1 (NMP1)
MASKQMEEIQRKLSLLANPRANAPAQSLLFAGVERYRLLEWLFFRLLGDRSPFTQQNWQGDSLDRDEENNRIQHLAEIANFLGITPSVDTEAIQGRSSYEERVELLRLIVDLVEASCYADNPEWSVDEQLAKDVQLVDSIAEKQAQIFSEECKLFPADVQIQSIYPLPDIAELELKLSEYTKKMSNLQQMVQELASKYDYNPNEDYAETELKLREYLQSFLETVKSFNTIYTKEIHPWTHMMEVPQLHGFGPAANRLLEAYNTLLKFLGNLRSLRDSYTAMAAGSLSASNEPSSVAKIISDCESALTFLNHSLSILSTSLAREQGETL

SEQ ID NO: 13458 - DNA, 768 bp, Panicum virgatum
  misc_feature: Ceres CLONE 1769653
  misc_feature: Encodes the peptide sequence at SEQ ID NO. 13459
gtccacttccacctcctcctcatccccgtccttgcctgcgttttcgctgcggattggagcggcaagggctcacttctctccggctgcggcctgacgatgccggaggcaaatgcgggtgcgctggcgcaggcggagcagaggaagaagaattcaccagagatggatttcttcagtgaatatggtgacgccaacagatacaaaattcaggaaataattggcaaaggaagctacggggttgtttgctcagctattgaccaacaaactagtgagaaggtagcaatcaagaaaatacagaatatctttgagcatctgtccgatgccgctaggatcctccgagagatcaagctcctccggcttctaaggcatcctgatattgttgagatcaaacatgtaatgttacctccatcaaggagggacttcagagatatttatgttgtttttgagcttatggataccgaccttcaccaagttattaaggctaatgatgacttaacaaaggaacaccatcagttctttctctatcagatgctgcgtgcattgaaatatattcatactgctaatgtctatcatcgtgatttaaagccaaaaaatatactagcaaatgctaactgcaaactcaagatatgtgatttcggattagcaagggttgcatttaatgattctcctaccacagtcctctggacggactatgttgctactagatggtacagagctcctgagctgtgcgggtctttctttactaagtattcaccagctattgatatgtgg

SEQ ID NO: 13459 - protein, 223 aa, Panicum virgatum
  misc_feature: Ceres CLONE 1769653
  misc_feature (34)..(223): Pfam Name: Pkinase Pfam Description: Protein kinase domain
  misc_feature: SWISSPROT Homolog: EC 2.7.11.24 Mitogen-activated protein kinase
  misc_feature: Useful for making plants with altered cell wall content and/or composition
MPEANAGALAQAEQRKKNSPEMDFFSEYGDANRYKIQEIIGKGSYGVVCSAIDQQTSEKVAIKKIQNIFEHLSDAARILREIKLLRLLRHPDIVEIKHVMLPPSRRDFRDIYVVFELMDTDLHQVIKANDDLTKEHHQFFLYQMLRALKYIHTANVYHRDLKPKNILANANCKLKICDFGLARVAFNDSPTTVLWTDYVATRWYRAPELCGSFFTKYSPAIDM

SEQ ID NO: 13460 - DNA, 646 bp, Panicum virgatum
  misc_feature: Ceres CLONE 1769653-R
  misc_feature: Encodes the peptide sequence at SEQ ID NO. 13461
gcatgccacggaagccaaggtagcacctgagatggcccgggacatgtggccgtcgccgtactatgtctcgaggggtgtacccaaagctgatctaacagaaagggccgccccccaaaggagcatgctgcacaacgttgcttcctttaatggcttcacggcggtcgctggtgggtacagcaaggccggcgttcttcactatggagtcacgagcttgtactagagcagtgcccctgataataagatgggaaccggagcgcagctccactgccccttccccccacttggaagttcggagcacggactggaggtgcatacccgatcaacgatgcaggcgtccgggaaggattttcaggctgggaaaatggcgagcgccaactttcgttgctcttgtttggtgagcgatgggccggtgatctcgcgccaatgttgtgatcttcctgatgccgcaaagagtgaagaggagggcggggttgaaaattctcacagcccctttcgaaggaaggggagaattacccgtctttaaaaaaggggtggccaaaaattgtggatatgtgtacagtgcaacgcttaattttgtatttaaccattttgaacgttctgcttccagttctgcacatttgaatcatatcattatgtttataggttc

SEQ ID NO: 13461 - protein, 72 aa, Panicum virgatum
  misc_feature: Ceres CLONE 1769653-R
  misc_feature: SWISSPROT Homolog: EC 2.7.11.24 Mitogen-activated protein kinase
HATEAKVAPEMARDMWPSPYYVSRGVPKADLTERAAPQRSMLHNVASFNGFTAVAGGYSKAGVLHYGVTSLY

SEQ ID NO: 13462 - DNA, 1915 bp, Panicum virgatum
  misc_feature: Ceres CLONE 1769658
  misc_feature: Encodes the peptide sequence at SEQ ID NO. 13463
atactatctgctagcggcgcacacacaaagcagagccaagagctgtatactatctgctagcggcgcacacacaaagcaacaatccttgttgatcggcgacgcgcccgccatggagctcaacctcgtgtcgtgggggtcgctcctcctcctcgcgctctccgccgcctacgtctactgcacgacgcggagccggtcgccgcagcggctgccgccgtccccgccggggtggccggtgatcgggcacctgcacctgctgtccggcgggatgccgcaccacgtcatgaccgacctggcgcgggccatgcgcgcgccgctgctcgggctgcgcataggcagcgtgcgcgccgtggtgatctgcaagccggacctggcccgcgccgcgctcaccaccaacgacgccgcgctcgcgtcgcggccgcacctgctgtcgggccagttcctgtccttcggctgctccgacgtcacgttcgcgcccgcgggcgcctaccaccgcatggcgcgccgggtggtcgtctccgagctcctctcggcgcgccgggtggcgacgtacggcgccgtccgggtcaaggagctccgccgcctcctcgcgcacctcaccaagaacacctccccggaccggcccctggacctcagcgagtgcttcctcaacctggccaacgacgtgctctgccgcgtcgccttcggccgccgcttcccgcacggcaagggggacaagctcggcgccgtgctcgccgaggcgcaggaccttttcgccggcttcaccatcggagacttcttcccggagctcgagcccgtcgccagcaccgtcaccggcctccgccgccggctcaagagctgcctggccgacctccgcgaggtctgcgacgagatcgtcgacgagcacctcagcggcaagcgcccgcacatccccggcgaccgcgacgaggacttcgtcgacgtcctcctccgagtccagaagtcccccgacctcgaggtcccactcaccgatgacaacctcaaggccctcgtcctggacatgttcgtcgccggcacggacacgacgttcgcgacgctggagtgggtgatgacggagctggtccggcacccccgcatcctcaagaaggcgcaggacgaggtgcggcgcgtcgtcggcggcaagggccgcgtggaggaggcggacctcggcgagctccactacatgcgcgccatcatcaaggagacgttccggctccacccggccgtcccgctgctggtgccgcgggagtccgtggccccctgcacgctcggcggctacgacatcccggccaagacccgcgtcttcatcaacaccttcgccatgggccgggacccggagatctgggagaacccgctcgagtactcgccggagcgcttcgagaatggcggcggcgagatcgacctcaaggacccggacttcaagctgctcccgttcggcggcggccggaggggctgccctggctacaccttcgcgctcgccactgtgcaggtgtcgctggccagcctgctgtaccacttcgagtgggcgctgccggccggcgtgcgcgccgaggacgtcaacctcgacgaggccttcggcctcgccaccaggaagaaggagccgctggtcgtggtcgtcaggaagcgcgaggggtacgagtttaagggggaggagctcaacgaggtttaagattaattattattttaatggttcaggtctttgttcttattaattagtgcaattgtgcaaacaagtgtcatgtcttgggagtggtcgccattaaccttttgtagagtacatgagagtagtcgtggtcacgtagcaggcaagggacgaccaatacaacaaggaaccttgcttgtaaaacaatttctattgtaacacttcggttggttggtgacctggtgggcaataataaagaccatttctttctttctacag

SEQ ID NO: 13463 - protein, 517 aa, Panicum virgatum
  misc_feature: Ceres CLONE 1769658
  misc_feature (34)..(500): Pfam Name: p450 Pfam Description: Cytochrome P450
  misc_feature: SWISSPROT Homolog: EC 1.14.13.68 4-hydroxyphenylacetaldehyde oxime monooxygenase
MELNLVSWGSLLLLALSAAYVYCTTRSRSPQRLPPSPPGWPVIGHLHLLSGGMPHHVMTDLARAMRAPLLGLRIGSVRAVVICKPDLARAALTTNDAALASRPHLLSGQFLSFGCSDVTFAPAGAYHRMARRVVVSELLSARRVATYGAVRVKELRRLLAHLTKNTSPDRPLDLSECFLNLANDVLCRVAFGRRFPHGKGDKLGAVLAEAQDLFAGFTIGDFFPELEPVASTVTGLRRRLKSCLADLREVCDEIVDEHLSGKRPHIPGDRDEDFVDVLLRVQKSPDLEVPLTDDNLKALVLDMFVAGTDTTFATLEWVMTELVRHPRILKKAQDEVRRVVGGKGRVEEADLGELHYMRAIIKETFRLHPAVPLLVPRESVAPCTLGGYDIPAKTRVFINTFAMGRDPEIWENPLEYSPERFENGGGEIDLKDPDFKLLPFGGGRRGCPGYTFALATVQVSLASLLYHFEWALPAGVRAEDVNLDEAFGLATRKKEPLVVVVRKREGYEFKGEELNEV

SEQ ID NO: 13464 - DNA, 1553 bp, Panicum virgatum
  misc_feature: Ceres CLONE 1769660
  misc_feature: Encodes the peptide sequence at SEQ ID NO. 13465
acagatagtgcacccatttcctctgcacaaatgatcacccagatcaatggtgctgctgcagctgttgttgcagcatttctggtcttctccactcacctctacttcccaaccactgctcatctctactgcccagccactccattgccccaaggcctctctgatctcacagaaccttcctttccattctgcccgcttacaggcagttccgtctgtaacgatcatcagtatggctgtaagtacaacccgctatgcgacgacttcccaccggacttccctccacctgacacacccatggtgacggtattctgtgtcgaccccaatggctgctgcgacttcacaacagtgcaggccgcggtcaatgccgttccaaatcacagcaggaagaggaatgttgtttggatcaacaagggcatctactttgagaaggtgacggtcccagcatccaagcccaacatcacatttcaagggcaggggtttgacattacagcgattgcttggaacgacaccgccaaatcagcaaacggcacgttctatagtgcctcagtctccattttcgcatcaggattcattgcgaaaaacataagcttcattaatgtagcaccaatcccaaggcctggtgctgttgacgcacaggcagtggcaatccggattaatggtgaccaagcagcgttctggggctgtggcttcttcggagcacaagacacactctgtgatgatagaggccggcattacttcaaggaatgtttcatccagggctccattgacttcatctttggagatgctaggtcactctatgaaaattgcagattgatatccattgcagatccagtgccttcaggacaaagatcaattacaggttcagtcactgcacatggtcgggtatcagaagatgataacactggctactcatttgtcaaatgtagcataggtggcacaggttggatatggcttggccgagcatggagaccatattctcgggtcgtctttgcctacacatcaatgtcagacatcatagcctctgaaggatggaatgactggaatgatccctcaagagatcagactgtattttatggagagtacaagtgtacaggtgatggtgcaaacctggcagatagagtgccatatgctcagaagcttagtgatgtgcaagttttaccttacttgagcacatctttcatcgatggagatcaatggctgaaaccataccgtgactcactaatatctgcttgaagcaattctaggtagaggacaacagtgtcacagacttgcaacagggaaaaatattacatgaaagcatctcataatcaacatttgagcagcacatgagaatgcaacacacattaatgccaggggagaaaggaggcaacttcaagtgctgcattacaataatcggtgcttgcataacatacaatagtcaagagttgactaatataaacatcctatttgcaatatagttgtcatgttgaaataaaaattgggcagatctcatcttcctgtattctgattgttgcttccaacaactactatgcctagaatgaaatctcacttggtgc

SEQ ID NO: 13465 - protein, 399 aa, Panicum virgatum
  misc_feature: Ceres CLONE 1769660
  misc_feature (94)..(386): Pfam Name: Pectinesterase Pfam Description: Pectinesterase
  misc_feature: SWISSPROT Homolog: EC 3.1.1.11 Pectinesterase
  misc_feature: Useful for making plants with altered carbohydrate content
  misc_feature: Useful for making plants with altered cell wall content and/or composition
MITQINGAAAAVVAAFLVFSTHLYFPTTAHLYCPATPLPQGLSDLTEPSFPFCPLTGSSVCNDHQYGCKYNPLCDDFPPDFPPPDTPMVTVFCVDPNGCCDFTTVQAAVNAVPNHSRKRNVVWINKGIYFEKVTVPASKPNITFQGQGFDITAIAWNDTAKSANGTFYSASVSIFASGFIAKNISFINVAPIPRPGAVDAQAVAIRINGDQAAFWGCGFFGAQDTLCDDRGRHYFKECFIQGSIDFIFGDARSLYENCRLISIADPVPSGQRSITGSVTAHGRVSEDDNTGYSFVKCSIGGTGWIWLGRAWRPYSRVVFAYTSMSDIIASEGWNDWNDPSRDQTVFYGEYKCTGDGANLADRVPYAQKLSDVQVLPYLSTSFIDGDQWLKPYRDSLISA

SEQ ID NO: 13466 - DNA, 815 bp, Panicum virgatum
  misc_feature: Ceres CLONE 1769662
  misc_feature: Encodes the peptide sequence at SEQ ID NO. 13467
tgaaatcgaggctcaaacaattttctaggatgaatagattcaaaagaagggctctaagggtgattgctgatcatttgtctgctgaggaagttgaagacataaaggagatgttcaagactatggacactgacaatgatgggattgtatcttatgaagaactaaagactggaatagcaaaacttggttctcatcttgcggaatcggaagtgcagatgctcattgaagctgtggatacaaatggtaggggagcacttgattacggagaatttttggctgtctcgcttcatttacaaaggatggcaaatgacgagcaccttcggcgggccttcctattttttgacaaggatggcaatggcttcattgagccggaggagcttcgagaggctcttgtggacgatggagcagctgatagcatggaagtggtgaatgacatattgcacgaagttgacactgataaggatggcaagattagctatgacgaattcgtagcaatgatgaagactggtacagattggagaaaggcatcccggcactactcaagaggaagatttaacagccttagcatgaagcttataaaggacgggtcagtaaaattgggtgttgagtgaaaactgcgaccatcgtccatatgtatgcatgtagttaggcccttggcctccccactaagcagcagatctttggccctcctttttcccatgattatcttgcgtgaaaatttagataggtgaaccctcctgattggcttacctgtgtaattagccctcccggtttcgctgacgagcaccgagcccgaaaatgttgtaccaggtgctgcc

SEQ ID NO: 13467 - protein, 201 aa, Panicum virgatum
  misc_feature: Ceres CLONE 1769662
  misc_feature (32)..(60): Pfam Name: efhand Pfam Description: EF hand
  misc_feature (140)..(168): Pfam Name: efhand Pfam Description: EF hand
  misc_feature (104)..(132): Pfam Name: efhand Pfam Description: EF hand
  misc_feature: SWISSPROT Homolog: EC 2.7.11.1 Non-specific serine/threonine protein kinase
KSRLKQFSRMNRFKRRALRVIADHLSAEEVEDIKEMFKTMDTDNDGIVSYEELKTGIAKLGSHLAESEVQMLIEAVDTNGRGALDYGEFLAVSLHLQRMANDEHLRRAFLFFDKDGNGFIEPEELREALVDDGAADSMEVVNDILHEVDTDKDGKISYDEFVAMMKTGTDWRKASRHYSRGRFNSLSMKLIKDGSVKLGVE

SEQ ID NO: 13468 - DNA, 2916 bp, Panicum virgatum
  misc_feature: Ceres CLONE 1769664
  misc_feature: Encodes the peptide sequence at SEQ ID NO. 13469
accgatccactcctacagcctccggtctccccggcgtcccgactccgagccccgccgcgaagcctcaccggcatggcgacagccagtggcgccccgccgccggcaatggacgagaaggcccggcgcacgcgcgacctcctcgccagcttctacaacaccgacccctctgcggccgctggcgccggggtcgcgtcccccgcgtccctggcgcggccctcccccaccgcggctcctgcgtcgcccctggactccatcaactccacctccttcgatcccgagaactacatgaatgttctggtgcaacaatccaatctggaaggtcttctacagaggcatgtgaagatggctgctgagatcaagaatctagacacagacttacagatgctagtgtatgagaattataacaagtttattagtgcaactgacactataaaaaggatgaagactaacattgttggaatggaggcaaatatggagcaactcctttcaaagataacatcagtgcagtcaaaaagtgacacagtgaatacatctcttttcgacaaaagggaaaacatagagaaattacaccgtacacgcaatttgctccgaaaagttcaatttatatatgaccttccaagtcggcttaataaatgcatcaagaccgaagcatatgctgatgctgtcaggttttttactggagcaaaacctatttttgaggcctacggagatacttcctttcaagactgtaaaaaggcttctgaggaggcaatggatttagtcatacaacatcttcaggaaaagttatactcagattctgaacctattgaagcaagagcagaagctgtagttctccttaaacaattgaactttccagtggacaacctaaaatctaatctactcgaaaagttagaagactgtctcttgaatctccagaatgagtctacacaggcttcaatcagcgacatttcaaagacattccgtgcttatttaataatatttcctgattcagaaaaacgtctcattgaacttgcacaagcgttgttctcaaaccgatatgaaacagtcagagagaatctgaagaaaagaattccgtcaacggatctgctggcaatgctacgatccttgtgggaggatgcaaccgccatcgatgaagttattccagaggctgcgttaccagctttttctttggagacaacacgagacattattaggcaacacatagcgactgcctttcttcatcttcaaagtgaaatatcagatgccttggtcagaacacattcaacatcaaatgagaaactagaagagttgcaattgcaaaatgctatggatacaatcaaaatcagagtatctcaaggatgtatagatctcctgcaggaatttcatcattttatagatggcaatacagagttgcttctaaagttgagagatttgattattgattgggtacaagaaggttttcaaaaaaaatttcagaaactcgatcggcattttcatgtgctctctgggagaagcaagagttttccacaagagtctagtgctctggattctgtgcaaattgataaggtcccaacagttttggtgcttatgcttgcacaactctgtgtttacattgaacaaacaactattcctaaagtcacagaggagctggcttcttcattttctggaggtggtgcacgtagttatgaatacggaccacctttcgtacctggagagatatgtcgtctatatcgttcatctggggagaaattcttacaccattacataaatatgaagactcagaagatctccaaacttcttaataagcgatttacgacacctgtttggataaagcacaaggaaccacgggaagtaaacatgtttgttgatctacttctccttgagttcaatggtgtggtatctgaagtcaagcagatcttgcctggtctaattcgtcgacatcgacattctgatagcactggcagcacaacttcctccagaagcaatccaatgcgagaagacatgttgaaccgatcaaacacaaaccgtgctagaagtcagtttttggaaaaccacctagcaaagttatttgagcagaaaatggaaatattcaccaaagttgaatacacacaggaacctgtaatatctactgtcctcaagctctgcctgaaaagcttgcaagaatttgtccgtcttcaaactttcaacagaagtggatttcagcagattcagcttgatatggaatttctcaagagctcccttaaggagtttgtggatgatgaagcagctattagctttttactcaaagaggtgaacaatgctgcccatgagagatgtcttgacccaatccctcttgagccccccatattggataaactcataaatgcaaaacttgccaaaattaaagagcaaaacccaaatatgcagtagttatgcaagattggtaacattaactaccattcagttccatccaattgaatgtgcactctttcgagtgaggtgtgtaactgcatatggttttgggatgcagcacgttgtcaaccatatgtaaatctggagtcacttgaactgaaaaatacacagcaaatttatactagtatacttaatttgaggtggttgacctctcagcaatcccctttcgcttgtcaagcgaccatcaaattgttcctctacattgtcttgagttcagctatgtgtcaggagagttctggtctgatattaatcaaacaggcattgtaagttgttgaatgaagataggtaaatacagtattctgaggacactgcacgtgtaaaaattatgtaagcattctttaactctacttcacatgaacttgtattaagtgatgtcatttatatttcatgaagggcttattggcagttgtactttcaccctattaacagattggctactatgatcaagcacctgatgggcaactactctatcgttactctttttgg

SEQ ID NO: 13469 - protein, 771 aa, Panicum virgatum
  misc_feature: Ceres CLONE 1769664
  misc_feature (61)..(147): Pfam Name: Vps51 Pfam Description: Vps51/Vps67
MATASGAPPPAMDEKARRTRDLLASFYNTDPSAAAGAGVASPASLARPSPTAAPASPLDSINSTSFDPENYMNVLVQQSNLEGLLQRHVKMAAEIKNLDTDLQMLVYENYNKFISATDTIKRMKTNIVGMEANMEQLLSKITSVQSKSDTVNTSLFDKRENIEKLHRTRNLLRKVQFIYDLPSRLNKCIKTEAYADAVRFFTGAKPIFEAYGDTSFQDCKKASEEAMDLVIQHLQEKLYSDSEPIEARAEAVVLLKQLNFPVDNLKSNLLEKLEDCLLNLQNESTQASISDISKTFRAYLIIFPDSEKRLIELAQALFSNRYETVRENLKKRIPSTDLLAMLRSLWEDATAIDEVIPEAALPAFSLETTRDIIRQHIATAFLHLQSEISDALVRTHSTSNEKLEELQLQNAMDTIKIRVSQGCIDLLQEFHHFIDGNTELLLKLRDLIIDWVQEGFQKKFQKLDRHFHVLSGRSKSFPQESSALDSVQIDKVPTVLVLMLAQLCVYIEQTTIPKVTEELASSFSGGGARSYEYGPPFVPGEICRLYRSSGEKFLHHYINMKTQKISKLLNKRFTTPVWIKHKEPREVNMFVDLLLLEFNGVVSEVKQILPGLIRRHRHSDSTGSTTSSRSNPMREDMLNRSNTNRARSQFLENHLAKLFEQKMEIFTKVEYTQEPVISTVLKLCLKSLQEFVRLQTFNRSGFQQIQLDMEFLKSSLKEFVDDEAAISFLLKEVNNAAHERCLDPIPLEPPILDKLINAKLAKIKEQNPNMQ

SEQ ID NO: 13470 - DNA, 853 bp, Panicum virgatum
  misc_feature: Ceres CLONE 1769665
  misc_feature: Encodes the peptide sequence at SEQ ID NO. 13471
tctacagtggcggatgagacagggtgcaaaaatgcctgcttgaacaactgctcatgtggtgcctatgttcacacaactacaacagggtgtctagtctggggtgacaaactaattgacctccatgagttgccgactggggcatataccctaaacctgaagcttcctgcttctgagttacgagtacatcacgccgtttggagaatagccacgataatatctgccgtggttctttttgttttgttagcttgccttgttctgtggtggaagcgtggcagaaatattaaagatgcagtgcatagaagttggaggtcaaggcagtcatctacctggtcccagcagaatagtgccatgctagatatctcacagtctattcgttttgatgatgaagtggaggatggaaaaagccatgaactcaaagtatactccctggaccgcataaaagctgctacaagcaattttagtgactccaacaagcttggagaaggaggatttggtcctgtctatatgggaacattacctgggggagaagaagtagccgtgaagaggctttgtaggaattcaggtcaaggccttgaagaattcaagaatgaggtcatacttattgcaaagttgcagcaccgcaatcttgtaagactactaggatgctgcatacagaatgaagagaagatcttggtgtatgagtacatgcctaacaaaagtctagatgcattcctgttcaatcctgaaaagcaagggcttctagactggagtaaacggtttgatataattgaaggcatcgctagagggctgctatatctccaccgggactcaaggctacgtgttgtccaccgtgatctcaaggccagcaacatcc

SEQ ID NO: 13471 - protein, 284 aa, Panicum virgatum
  misc_feature: Ceres CLONE 1769665
  misc_feature (153)..(279): Pfam Name: Pkinase_Tyr Pfam Description: Protein tyrosine kinase
  misc_feature (1)..(40): Pfam Name: PAN_2 Pfam Description: PAN-like domain
  misc_feature: SWISSPROT Homolog: EC 2.7.11.1 Non-specific serine/threonine protein kinase
STVADETGCKNACLNNCSCGAYVHTTTTGCLVWGDKLIDLHELPTGAYTLNLKLPASELRVHHAVWRIATIISAVVLFVLLACLVLWWKRGRNIKDAVHRSWRSRQSSTWSQQNSAMLDISQSIRFDDEVEDGKSHELKVYSLDRIKAATSNFSDSNKLGEGGFGPVYMGTLPGGEEVAVKRLCRNSGQGLEEFKNEVILIAKLQHRNLVRLLGCCIQNEEKILVYEYMPNKSLDAFLFNPEKQGLLDWSKRFDIIEGIARGLLYLHRDSRLRVVHRDLKASNI

SEQ ID NO: 13472 - DNA, 1513 bp, Panicum virgatum
  misc_feature: Ceres CLONE 1769667
  misc_feature: Encodes the peptide sequence at SEQ ID NO. 13473
gcaccaccgccgcccaaccgaacccacgcttactgcttctcctcgcaatacagctacataaaactaaccgccgccactccgcacctaggccgaagccgcaatcccccgagcgagctagctccaatggcggccgcctcgtcgttacgcgccgcgcctttcgccgccgcagcgccagtggggtccgctggtctcggatctgcctgaggcaaggctagcgcgctcggagctttgctggcattggagcggctttgccgtttcggcagcggcggggagatagctcgttgctgcggcggggcgaccaggtcctgtgcggggaatttggcttcgcggcgggcggcggcatccaaacccagcagataagaccgttattgtcacagtgcagaatatggctttcaagattcagcgcttgtctttcattgccattacagtttttgcttcactccttcatccttgtgtgtccattgagttccgccgtgaactctccagctggaccactggcatcgctacgtggtatggtgatcctaatggcgctggaagtgaaggtggtgcatgtgggtaccagtatactgttgaccaaccaccattctcgtccttgattgctgctggcagccctttcatctacgactctggaaatgggtgtggttcttgctaccaggtggtatgctctggcaatcaagcttgctctggataccctgtgactgttgtcatcaccgatcagggccctggtggtggtccgtgcctgagccaagcaagtgatggcatgtgcctaaatgagggagcccactttgacatgagtgggacggcatttggtgccatggcaaagcctggaatggccaatcagctccgtggtgctggcatcctacaaatccaatacactcgggtgcagtgcgaatggcctggagtggatgtaaccttctcagtggactccggttcgaacccaaactatctggccgtggtcattgagtatgaggacagtgatagtgacctatcggccgtggacatcatgcagagctcgatggggcagtgggttccgatgcagcattcgtggggtgcagtgtggaggcttgactctggctccacccttcagggcccgttccatatccgcctgacgttcaactcaggcagggtgctcatcgccagcaacgccatacctgcagggtggaatgccggcatttcataccggtcaggaggcgttgcagtgaccactgaccagggccaggccgaggagtgctggctgccggggctacaaggcagcaggtgcatttagcgatttggtgaatcaccttctactgttgtttgtggtattggcgttgtgaattctgatgcaaatgcagcttttgtagttttatgatgcagattaggaaccctgatggacttagttgtgtgttttgatattttcttgtagctgaggcctaaaatgatggagtacccaaggtgttgtaggcgtttttgttgtggtctaggccccgtttagttcccttcaaaattccaaaactttacaagattccccatc

SEQ ID NO: 13473 - protein, 293 aa, Panicum virgatum
  misc_feature: Ceres CLONE 1769667
  misc_feature (175)..(256): Pfam Name: Pollen_allerg_1 Pfam Description: Pollen allergen
  misc_feature (71)..(163): Pfam Name: DPBB_1 Pfam Description: Rare lipoprotein A (RlpA)-like double-psi beta-barrel
  misc_feature: Useful for making plants with altered carbohydrate content
MAFKIQRLSFIAITVFASLLHPCVSIEFRRELSSWTTGIATWYGDPNGAGSEGGACGYQYTVDQPPFSSLIAAGSPFIYDSGNGCGSCYQVVCSGNQACSGYPVTVVITDQGPGGGPCLSQASDGMCLNEGAHFDMSGTAFGAMAKPGMANQLRGAGILQIQYTRVQCEWPGVDVTFSVDSGSNPNYLAVVIEYEDSDSDLSAVDIMQSSMGQWVPMQHSWGAVWRLDSGSTLQGPFHIRLTFNSGRVLIASNAIPAGWNAGISYRSGGVAVTTDQGQAEECWLPGLQGSRCI

SEQ ID NO: 13474 - DNA, 1807 bp, Panicum virgatum
  misc_feature: Ceres CLONE 1769668
  misc_feature: Encodes the peptide sequence at SEQ ID NO. 13475
actcacaaccagccaaaagcttccgcttctcacctcacgcgctagctagctagctgcacacccaagcatcacacgccgccccccggcaggcatggagaagaagcgggtggtcatcgtcggagccggcgtcagcggcctcacggtgtgcaagcacctggtggagctcggctgccggcctaccgtcttcgaggcggacaccgtgctgggcggcgtgtgggcgcgcgcgccggcgtgcaccgagctccagacgccgcggcccatgtaccagtactccgacttcccatggccggagaacgtgacggaggtgttcccgaaccaccgccaggtggtggcgtacctcgacgcggacgcgcgccacttcggcgtgctcggctgcatccgcttcggccaccgggtggtcggcatggagtaccacggcgtcggcgaaaaggatatcgccgcgtgggaggagtgggctgggaacggacaggcgttcggctccggcgccggcgagtggcgcctgtcggtggccgacgccgacggacacgttcagacacacaaagcagactttgtcgttctttgcatggggaggttcagtggtgtgcccaacatacccacattcccagaaggcaaaggtccagaagcatttgatgggcaggtcatccactccatggactatgccaaaatgggcacaagtaaagctaaggagatgatcaggggcaagcgtgtgactgtcgttggctacttgaaatcagcacttgatattgccgctgaatgtgccgaagtaaatggcactgctcacccatgtacaatgctggtcagaacaaagcactggatcttaccggactacttcgcctggggcttccacgtctcaaagctctatctcaaccgtttcgctaaactcctcatccacaagcctggcgaaggccttctcctgtcaatcttggccacccttctgactcccttgaggtgggccttctccaagttcggggagagctactactccatcccgatgaagaagcacggcatggtgcctgaccacagcctgttcgaggcgctggctgcggccaccatcgccatcacgcccaaggaccactacaagcggctcgaagaaggcagcatcgtgctcaagaagtccaagacgttcagcttctgcaaggaaggcgtgctcgtggagggcgagccgtcgccggtcaagagcgacatcgtcatcttcgggaccgggttcaagggcgacgacaagatcacggacatgttcacttcagactacttccagagtgttgcggttgggtcagaatccactactgtgcctctctacagggagtgcatacatcctaagatccctcagcttgctgtgatcggatattccgagagcattgcgaacatgtacacgtcggacattcgggccaagtggttggcgcgcttcttggacggcggcttcagactaccgaacgttgctgcaatgcagaaggatgttctggaatgggagaagtacatgaagagatactctggaagatactttcgccggtccagcatcctgctcgtgcacacttggtacaacgaccagctctgccgcgacatggggtgcaatccgaggaggaaaaaagggttcttctctgaactgtttgaggtctatggccctggtgattatgctaacctactctccaactccaagcccaaggaacagtagaacttgtgtttaaattcctttggcacctacggatcacttctctgagatatatatacagcgaatgtacaatgtgtgtgtattgtcacatgtgtgatgaccatctttgcattgatctaaatgatgtaaagctttcctggc

SEQ ID NO: 13475 - protein, 525 aa, Panicum virgatum
  misc_feature: Ceres CLONE 1769668
  misc_feature (3)..(509): Pfam Name: FMO-like Pfam Description: Flavin-binding monooxygenase-like
  misc_feature: SWISSPROT Homolog: EC 1.14.13.8 Flavin-containing monooxygenase
MEKKRVVIVGAGVSGLTVCKHLVELGCRPTVFEADTVLGGVWARAPACTELQTPRPMYQYSDFPWPENVTEVFPNHRQVVAYLDADARHFGVLGCIRFGHRVVGMEYHGVGEKDIAAWEEWAGNGQAFGSGAGEWRLSVADADGHVQTHKADFVVLCMGRFSGVPNIPTFPEGKGPEAFDGQVIHSMDYAKMGTSKAKEMIRGKRVTVVGYLKSALDIAAECAEVNGTAHPCTMLVRTKHWILPDYFAWGFHVSKLYLNRFAKLLIHKPGEGLLLSILATLLTPLRWAFSKFGESYYSIPMKKHGMVPDHSLFEALAAATIAITPKDHYKRLEEGSIVLKKSKTFSFCKEGVLVEGEPSPVKSDIVIFGTGFKGDDKITDMFTSDYFQSVAVGSESTTVPLYRECIHPKIPQLAVIGYSESIANMYTSDIRAKWLARFLDGGFRLPNVAAMQKDVLEWEKYMKRYSGRYFRRSSILLVHTWYNDQLCRDMGCNPRRKKGFFSELFEVYGPGDYANLLSNSKPKEQ

SEQ ID NO: 13476 - DNA, 1241 bp, Panicum virgatum
  misc_feature: Ceres CLONE 1769673
  misc_feature: Encodes the peptide sequence at SEQ ID NO. 13477
atatactccctgcaggagcgagagcgagccgattcgcccacgacggctgcctcctgctctgctcttctctgcttcctccctccccacgcgagcgctctctcctctgcttcccctcctccccgcgactccgcccggctctagggttttgccccctatcgatcgaaatggtggaggtggaggaggtcgggaacaagatgcagtcgcagatgcgcctccatccagagccggaggacgacgccgacctcccgctccccgccctcttcgacagggcgtcccggctccacggcctcgcctccagctccgccctcgaccaggaagggatccggaagggggtcgagctgctgcggcgctgcgacgagatggtcagcaagctcggcctcttctccaccaacgagacaaaggaagacgtctccaccgccaacctcactgtgctgctgctgcttcgcataatctgctctgctctccgattcctcctgagcagctgcggttggatctcggatcggtgatcacattaacaatggtgaaggctgttcctgtgcttggtaacagcgagggtgtcaagggcaccatctacttcacccaagagggagatggccccaccactgtcaccggaagtgtctctggcctcaagcctggcttccatgggttccatgtgcatgcacttggtgacacaacaaatggctgcatgtcaactggaccgcattacaaccctgcgggcaaggagcatggagcaccagaagatgagaaccggcatgctggtgatctcggaaatgtcaccgccggagatgatggtgttgctaacttcactgttaccgacagccagatcccactgactgggccaaactcaatcattggcagagctgttgttgttcatgctgatcctgatgatcttggaaagggtgggcacgagctgagcaagagcactggaaacgctggtggccgtgttgcctgcgggatcatcggactccagggctgagagtgatcaccgaactcaagtgccgaaagtgtcgtcgtccccgctgtcaccactcaccactggaccagcctgagcatcctctggatatgtgaaataagagcgcctgatctatgatcggcgtgtttgtgttctcgctcctgtagcacctaccgatgaactgaaacctgtgttggtgtaacgctgtttcacctggacctgtgtttcatacatttcgctttgagaacgcctggaccgatctatggaaataagaaggcacttgttgcgg

SEQ ID NO: 13477 - protein, 152 aa, Panicum virgatum
  misc_feature: Ceres CLONE 1769673
  misc_feature (1)..(152): Pfam Name: Sod_Cu Pfam Description: Copper/zinc superoxide dismutase (SODC)
  misc_feature: SWISSPROT Homolog: EC 1.15.1.1 Superoxide dismutase
MVKAVPVLGNSEGVKGTIYFTQEGDGPTTVTGSVSGLKPGFHGFHVHALGDTTNGCMSTGPHYNPAGKEHGAPEDENRHAGDLGNVTAGDDGVANFTVTDSQIPLTGPNSIIGRAVVVHADPDDLGKGGHELSKSTGNAGGRVACGIIGLQG

SEQ ID NO: 13478 - DNA, 1419 bp, Panicum virgatum
  misc_feature: Ceres CLONE 1769674
  misc_feature: Encodes the peptide sequence at SEQ ID NO. 13479
atccgatccgatccatggacagccaggtatctagagggtagcagcagcagcaggtcgagatcgatcgatggcccagcaggcagcagtccaggtgcagcccagcagcaccttggagatgatgatgaagaagccgcaggccagcagctgctgctccgaggacatggcggacctggagctcgcgctggagccgaccacggtgccgcgtcaggactctctgtacagggacgcgacgagggcgggcggcggcggcgggaacctgcacgacgggcagcaggacgggtgggcgcggactctgcggctggccttccagtgcgtgggcgtgctctacggcgacatcgggacgtcgccgctgtacgtgtactcgagcaccttcaccggcggcatccgccacaccgacgacctcctgggcgtgctctcgctcatcatctacagcttcctcctcttcaccatcatcaagtacgtctacatcgcgctcagggcaaacgacgacggggacggcggtacgttcgcgctctactcgctcatctcccgtcacgccaaggtgagccttgtgcccaaccaccaggccgaggacgagctgatgcacatcgacggcggcgacgacgaggccgtgctggcggccaagccgtcgctccgcggcagcgtgcggcggcggacggtgcagctggcgtcgccgagggagcagcgtgcgcagtgggtgaagcagctgctggagacgagcaagcccgtgcgcatctcgctcttcctgctcaccgtcctcgccacggccatggtcatcagcgacgcctgcctcacgccggccatctccgtgctctccgccgtcggggggctcaaagagaaagcgccaaacctcacaacagttgtgcagacaatgacgtggccggtacaatgatttatatatgctgggcaaacctattagaaataccaatatttcgttgccaataattaatctatgttcccatcaaaaaaataattaatctatgtattatctttttacatattgattgatggtcaagttgcattgtcaggccaattatgaattaggatggtagatattaaaggtcgtttgtgaattattatggtggttttagatttgttacatagatgtatggtggttttgatcagagctagagctatcgatgggcaacacgctcttaatttcaatggcagtattattaggatgggcctgtaacttgacatggatgatgatgatggatcctccaataacaattggttaagcagtctgcgtccttgtgataaattgcctgttgcgttgcgtacacacctccgatcaaattgcgtgttgattgattatatatattaattactcgtattagctagtgggtccaatactccaatgtaagaaattattcaagggataactagtgtatacatataattaatcattctttttttttc

SEQ ID NO: 13479 - protein, 274 aa, Panicum virgatum
  misc_feature: Ceres CLONE 1769674
  misc_feature (77)..(274): Pfam Name: K_trans Pfam Description: K+ potassium transporter
MAQQAAVQVQPSSTLEMMMKKPQASSCCSEDMADLELALEPTTVPRQDSLYRDATRAGGGGGNLHDGQQDGWARTLRLAFQCVGVLYGDIGTSPLYVYSSTFTGGIRHTDDLLGVLSLIIYSFLLFTIIKYVYIALRANDDGDGGTFALYSLISRHAKVSLVPNHQAEDELMHIDGGDDEAVLAAKPSLRGSVRRRTVQLASPREQRAQWVKQLLETSKPVRISLFLLTVLATAMVISDACLTPAISVLSAVGGLKEKAPNLTTVVQTMTWPVQ

SEQ ID NO: 13480 - DNA, 1998 bp, Panicum virgatum
  misc_feature: Ceres CLONE 1769678
  misc_feature: Encodes the peptide sequence at SEQ ID NO. 13481
gagccggggaaggctacagcggcggcaggcgggccagcagcagagcgcagcgcaccgcggggtagcaggaggaccgccgctcggaaagtgcggagccgtttcgtctcccccctctctagctacctcttccagggcttgcctccgcccgtccactcgcccacgcctcgcgctccagggggaggtgagtctcgatcgctgttgctggtggtggtagcgcgcgctagccccgataagagagggacgaacgaagccccgcgtgcttgatcgatcgcccccgcccccgccggggttctactcctacgcgtcctcctccacgtcctcctactccccgcacagccccacagggctgccgcacgtcgcggcgcacggccacggccccgccccgccgctcgcggcgcagatcccgacgcagaacttcgcgctctcgctctcctccacgtcctccaacccgccgccgccggccccgcagcagcagcagcagcccaggaggccgcacccgcacggcgcccccgcggggcccttcgggcccttcaccggctacgcggcggtcctcggccgctcccggttcctcgtccccgcggagaagctgctcgaggagatctgcgacgtggggcgcgcggccccgcacgtggaccggaccgcctccgacgaggccctgctcgacgcggatccgatggagggcatcgatcacgacatggacggcgccgcctccgacgccgggcccatctccggcgccgagcagcagtggaagaagaccaggctcatctccatgatggaagaggtctgcaagaggtaccgcctgtactaccagcaggtccagactgtcatcaactcgtccgagacggtcgccgggttcagcaacgctgccccgttcgccgcgatggcgctgagggccatggcgaagcacttcaagtgcctcaagggcatgatactgagccagctgcggaacacgtccaaggctgctgccgggaaagaggggctcagcaaggacatcgccatgttcgggctcgccagtggcagcgctgccgtcctccagagagcgggcagtgtggcggcgttcggccagccgcacaacagctggcggccgcagcgagggctcccagagcgtgctgtctctgtgctccactcttggctgtttgagcacttcctgcatccatatcctactgatggtgacaagcaaatgctagctaaacagacaggcttaacgcggaaccaggtatcgaattggttcatcaatgcaagagtccggctatggaaaccgatggtggaagaaatccacaaccttgagatgaggcaggtccaaaagcatccagcccttgacaagagccagctctccatgcatcaccagacccagcattcgtctgagagcagcaggaagccctcagatccttctgactcccagctcggccaaagcagcagcatcactcggaatcacggcatccctacctctcagggcttcccggatgagctctcccagatgtcccactccatccagcaggggcaggtcaccttcgcatacaacgggctgtcgacaccgcagcatcagcacagcctcgcgtcgtcacagcatcaccagcaggttggatcaatgagcggcatcggcggggcggggaatggtggtgtgtccctcacccttggactccaccagaacaacagggtttgcatcgccgagccactcccagcatccctcccgcccaaccttgcccaccgtttcggcctggaggaggttagcgacgcctacgtgatgggctcgtttggaggtcaggaccggcattttggcaaggcgatcggtggccatttgttgcatgattttgttggctgatatggctgctagtgcgattggtgctcctgcatctgtcagttttctgatggggcataaccttgtattgtaccactactagtatgttagaatggtatataagtggatcacttggtggctttggcttgatcactttgaatcgatttctttggagggtggagaaaaaaaacccgttgctg

SEQ ID NO: 13481 - protein, 382 aa, Panicum virgatum
  misc_feature: Ceres CLONE 1769678
  misc_feature (1)..(88): Pfam Name: POX Pfam Description: Associated with HOX
  misc_feature: Useful for making plants with modulated light quality response
  misc_feature: Useful for making plants with modulated light quality sensitivity
MEGIDHDMDGAASDAGPISGAEQQWKKTRLISMMEEVCKRYRLYYQQVQTVINSSETVAGFSNAAPFAAMALRAMAKHFKCLKGMILSQLRNTSKAAAGKEGLSKDIAMFGLASGSAAVLQRAGSVAAFGQPHNSWRPQRGLPERAVSVLHSWLFEHFLHPYPTDGDKQMLAKQTGLTRNQVSNWFINARVRLWKPMVEEIHNLEMRQVQKHPALDKSQLSMHHQTQHSSESSRKPSDPSDSQLGQSSSITRNHGIPTSQGFPDELSQMSHSIQQGQVTFAYNGLSTPQHQHSLASSQHHQQVGSMSGIGGAGNGGVSLTLGLHQNNRVCIAEPLPASLPPNLAHRFGLEEVSDAYVMGSFGGQDRHFGKAIGGHLLHDFVG

SEQ ID NO: 13482 - DNA, 1136 bp, Panicum virgatum
  misc_feature: Ceres CLONE 1769679
  misc_feature: Encodes the peptide sequence at SEQ ID NO. 13483
acgtaacccctctccaagccttaactccgcagcagagcacgcatcaagaagctagtacgacacgcgcgcacagatggcgtcgacgatcatggccgccacctcccgcgtcctcgccgccaagaccccgttcctcggccagggccgcgccgccgccattgccagcccgctccgcgacgtcgccgccgccgccagcggccggatcaccatgggcaacgacctgtggtacggccccgaccgcgtcaagtacctgggccccttctccgcccagacgccctcctacctcaccggcgagttccccggcgactacggctgggacacggccgggctctccgccgacccggaggcgttcgcgcgcaacagggcgctggaggtgatccacgggcggtgggcgatgctgggcgcgctggggtgcatcaccccggaggtgctcgagaagtgggtgcgcgtggacttcaaggagcccgtctggttcaaggccggcgcgcagatcttctccgagggcgggctcgactacctgggcaaccccaacctggtgcacgcgcagagcatcctcgccgtgctggggttccaggtcgtgctcatgggcctcgtcgagggcttccgcatcaacggcctcgacggcgtcggcgagggcaacaacctctaccccggcggccagtacttcgaccccctgggcctcgccgacgaccccgtcaccttcgccgagctcaaggtcaaggagatcaagaacggccgcctcgccatgttctccatgttcggattcttcgtgcaggccatcgtcaccggcaaggggcccctcgagaacctgctcgaccacctcgacgaccccgtcgccaacaacgcctgggtctacgccaccaagttcgcgcccgggtcttaagctcgacggcggccggcctcttcgtgccggaccaccattgtactgtaggcattacgtttgttttgtaccaccaccaatgaatgcaaatatcgccatctcaggattcagcattgcactggcggagttctgggctttgcattcttatttctgtcagttgtcacttcttgtgtgctcctgaaacagatactgtgcctctacgtatgtatctatgtccacctccttctccgcatttcggttcctcttttcagcttttgac

SEQ ID NO: 13483 - protein, 268 aa, Panicum virgatum
  misc_feature: Ceres CLONE 1769679
  misc_feature (65)..(235): Pfam Name: Chloroa_b-bind Pfam Description: Chlorophyll A-B binding protein
MASTIMAATSRVLAAKTPFLGQGRAAAIASPLRDVAAAASGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVVLMGLVEGFRINGLDGVGEGNNLYPGGQYFDPLGLADDPVTFAELKVKEIKNGRLAMFSMFGFFVQAIVTGKGPLENLLDHLDDPVANNAWVYATKFAPGS

SEQ ID NO: 13484 - DNA, 1485 bp, Panicum virgatum
  misc_feature: Ceres CLONE 1769683
  misc_feature: Encodes the peptide sequence at SEQ ID NO. 13485
aagagtgaaaaaaatatccgcattcttcgtagaagtaaacagagaggcggccgcggccacacagcgcgagtccaccccagaggcccattcctgcacagagccgccgaatcgggaccaatcccgtcgatccttctggccgccgccgccgcggggctctccagaggcgtcctccgattcggccggggccggggggaaccggggacacatggggctcggggcggcggcggggcggctcctgccggaggtggactgggagcgcgaggcctacccggcttacgacgacttcctcgcgctcccggccttcgtcctcttcttccccaccgtccgcttcttcctcgaccgcttcgtcttcgagagggttgcaaggaggcttatacttgggaagggacatcagagagctaataatgaaacagaagaaacaaggaagaagataagaaaattcaaggaatcggcgtggaaatgtgtttatttcctatctggagagcttttatctctgtcagtcacatataatgaaccttggttcaccaataccagatatttttgggtaggacctggagaacaggtttggcctgatcaaaagataaaattgaaacttaaggcggtgtacatgtatgctgctggattctacacatattccatatttgcacttatgttttgggaaacaaggcgttcggactttggtgtgtcgatgtcacatcatgttgctactgttatcctgatcattctatcttatgtgttcagatttgctagagttggctccatagtattggcaattcatgatgcaagtgacgttttcctggaagtagggaagatgtccaagtatagccattgtgattggcttgccaatatttcatttcttctttttgttgtttcatgggttcttctccggctcacatattttccattctggattctgagaagtacaagctatgaggtcttgttgactttggataaaaagaagcacagttttgacggtcccatatactattatgtgttcaactcccttctattttcactacttgttctccacatatattggtgggttttaatataccggatgcttgtgaggcaaatcatgacaaggaatgttggagatgatgttcgatctgactctgaaggagaagatgagcacgaagattgatcggcaccaccatcttatcttgtcttctgtactgcaacgatgctagaagcatcgactccagtgccccgagcttccgcattcttttcctggatttcaagatatgtgcagattatgggaggacgagcattgttcctcacgagatacatcagcgccgagctgcgacttgttctgccttggccgcacaagtgtgttgtaccatgtatgcatgatagtaatacattgagctccagtgcgttaattaggagcagctggataccgaagacaacattcttttgggtgtaaactctgtagagagatgtcaagcgttaccctgtaccgtagcaccaggcaacgtgacgttccag

SEQ ID NO: 13485 - protein, 311 aa, Panicum virgatum
  misc_feature: Ceres CLONE 1769683
  misc_feature (97)..(308): Pfam Name: LAG1 Pfam Description: Longevity-assurance protein (LAG1)
  misc_feature: SWISSPROT Homolog: EC 2.3.1.24 Sphingosine N-acyltransferase
MGLGAAAGRLLPEVDWEREAYPAYDDFLALPAFVLFFPTVRFFLDRFVFERVARRLILGKGHQRANNETEETRKKIRKFKESAWKCVYFLSGELLSLSVTYNEPWFTNTRYFWVGPGEQVWPDQKIKLKLKAVYMYAAGFYTYSIFALMFWETRRSDFGVSMSHHVATVILIILSYVFRFARVGSIVLAIHDASDVFLEVGKMSKYSHCDWLANISFLLFVVSWVLLRLTYFPFWILRSTSYEVLLTLDKKKHSFDGPIYYYVFNSLLFSLLVLHIYWWVLIYRMLVRQIMTRNVGDDVRSDSEGEDEHED

SEQ ID NO: 13486 - DNA, 758 bp, Panicum virgatum
  misc_feature: Ceres CLONE 1769684
  misc_feature: Encodes the peptide sequence at SEQ ID NO. 13487
aaacaaacacaaggcaggctgctgctgcttcctccgactcttgctcgcttgcccctcaactcatggaggcttacttgcttgtggctcccaaaccttccatggcctcgaccgtctctgcaggtgcaaggggtcccgccaggaggtgccttgtcgtcaccgccacagcctccaaggaacccggcacccgctcatcagaaactgtaatgacacgagcacgcggcggcctgttggccgtcgccgtcgccgcagcgagcagcacgccagtgctcccgtgccatgcttgggtgctggcaggcgacctggacccggcgacggccaagacggtggccggcgtggcggggccggcgctgtcggcgctgggcttcctcttcatcctgcggatcgtcatgtcctggtacccgaggctccccgtgacgcagttcccttacgtgctggcgtacgcgcccacggagcccttcctcgccgtcgcccgaaagctcatcccgccgctcggcggcgtcgacgtcacgcccgtcgtctggttcggcctcgtcagcttcctcaacgagatcctcgtcggcccgcagggcctgctcgtcctgctctcgcagcagcagcagctttgatccacatttttgtatctaataaataaccaacgaaaaagaaaagatgatgttttttctataaatcatcagttgtcatttacaaacaaggcacacttcgtgcccctatcaattttgttttgatacaaatactaataatgatttctacacggcacc

SEQ ID NO: 13487 - protein, 180 aa, Panicum virgatum
  misc_feature: Ceres CLONE 1769684
  misc_feature (85)..(167): Pfam Name: YGGT Pfam Description: YGGT family
MEAYLLVAPKPSMASTVSAGARGPARRCLVVTATASKEPGTRSSETVMTRARGGLLAVAVAAASSTPVLPCHAWVLAGDLDPATAKTVAGVAGPALSALGFLFILRIVMSWYPRLPVTQFPYVLAYAPTEPFLAVARKLIPPLGGVDVTPVVWFGLVSFLNEILVGPQGLLVLLSQQQQL

SEQ ID NO: 13488 - DNA, 1715 bp, Panicum virgatum
  misc_feature: Ceres CLONE 1769685
  misc_feature: Encodes the peptide sequence at SEQ ID NO. 13489
atcccttcgcttccacgcaccaatcttgtcccggcgcctgccactgccaggtccaggggacagccacagcccgagcacaaggggggcgccaggacactggtgcgcggcgcgccccggggaagagcagcggcggcagcggcggagcagaacacgccagcgcctcgccggctcgcgccaatggcggctccttcccgagcgtcgtcgtcctcgtcctcgtcgtccgcgcgcctcctcctcctgctgctctccctgctcgggtcctgcgtcgcgctgagccgccaggagtcgtcgtcgtcgtcgacggactcgtgcgccgcggcgaagctcgcggtcgccagcctcgtgcccttcgacaccgcggggttccggtgcgccgccaactggaagcagcaggacttcgtcctccggtacaagaacacggggccgagcgtgtggagcttcgtcctgtcggcgccggacaggggctcgtacgtggcggtcggcttctcggggaagggcgccatggtcgggagcagcgccgtcgccgggtgggcgtccggcggcaggggcgccgtcaagcagtactacctcgccgggaagagccccgacgaggtcgcccccaacaggggcctcctcaagctcgtcaggaacaagtccgccgtcgtctcccactcgggccgcctctacctcgccttccagctcagcaccgactacccgcagccgtacctgatctacgccgtcgggcccgacggcaacctgccgccgtccagcaccctgcagctgccgatgcaccagagcgtggcctcccgcgccttcaactacacctccgggatgtcttccagcttcggccccggcgacgggacgttcccggcggagcggaggcacgggctgctggccatgatggggtggggcgtgctgatgcccatcggcatgatcaccgcgcgctacttccggcagctggacccgtgctggttctacagccacctggccatccaggtgtgcggctacgccatcggcatcgcggccgtcgtcctcggcttccgcctcaacggggacggactcaagaacgtggacgcgcacaaggcgctcggcatcgccatcctcgccatggcgtcgctccaggtgctggcgatcctggcgcggccggacaagacgtccaaggtgcgtcggttctggaactggtaccaccacaacatcgggcgcgcggcgatcctggtggccgtcggcaacgtcttcctgggcctctccatcgcgcaggagaccaacgcctacatcgtctcctacggcgtcttcgtcgccgtctgggtggtcgccgtcgccgccttcgaggtcaagcgctgctacgccgacgacgactgatccgctcgaccgaccgacccccttccaggcaggcaggcagcgataccagagtcgttattctggacaactctggccataggacgaaactgatgggcgtacgcagaatgaagcgttcacggccagtgacgtgacacacatacacacacctgttcttgttccttagctcacaactggacagtgcattcgggaaagcgtgcttggctggctaaaatttgatttttttatttttgttttgggtataggatttgaagcaagggccggactgctgctctagcctagctggacgctctgattcatattcatatttgtacattggtacatggtcgtgtttgtgctgtacttgtacccattcagatgatagttttgttcttcaccct

SEQ ID NO: 13489 - protein, 386 aa, Panicum virgatum
  misc_feature: Ceres CLONE 1769685
  misc_feature (72)..(182): Pfam Name: DOMON Pfam Description: DOMON domain
MAAPSRASSSSSSSSARLLLLLLSLLGSCVALSRQESSSSSTDSCAAAKLAVASLVPFDTAGFRCAANWKQQDFVLRYKNTGPSVWSFVLSAPDRGSYVAVGFSGKGAMVGSSAVAGWASGGRGAVKQYYLAGKSPDEVAPNRGLLKLVRNKSAVVSHSGRLYLAFQLSTDYPQPYLIYAVGPDGNLPPSSTLQLPMHQSVASRAFNYTSGMSSSFGPGDGTFPAERRHGLLAMMGWGVLMPIGMITARYFRQLDPCWFYSHLAIQVCGYAIGIAAVVLGFRLNGDGLKNVDAHKALGIAILAMASLQVLAILARPDKTSKVRRFWNWYHHNIGRAAILVAVGNVFLGLSIAQETNAYIVSYGVFVAVWVVAVAAFEVKRCYADDD

SEQ ID NO: 13490 - DNA, 811 bp, Panicum virgatum
  misc_feature: Ceres CLONE 1769688
  misc_feature: Encodes the peptide sequence at SEQ ID NO. 13491
aagtcccggagcccatccaatccccctttaccccgcggcgcgagcaagggcgacgccggccgcgacggggctccgcctcgacggcggcgtcggcgggaacccggcttccgctccatctcctcactcccccctctgatcgcttctgactcgtgaaaatggcggatgaactacgttctatgtctgtggtccagaaggtccatgggcagtccgtgttgttgagcagaatcacttcttgttctgccatgaataaccctgtattcaacaatgcgtattctgcctacaacatgccccgtaggtcataccaggggatgaatgcaactgttggacttccctccgtcatggcaccatctcctttctttgcttctgccccaaaagagaaaggtttttctggatttatgattgactttctaatgggtggagtttctgctgctgtttccaagacagctgctgctcccattgagcgtgtcaagctgttgattcagaaccaggatgagatgatcaaaagtggtaggctatctgaaccctacaagggtattggggactgctttgcccggacgatgaaagatgagggttttgtctcactgtggaggggcaacacggctaatgtcatccgttacctccccacacaggcattgaactttgccttcaaggaccacttcaagcgcatgttcaactttaagaaggacaaggatggatactggaagtggtttgctggcaacctggcttctggaggagctgctggtgcttgctctctcttctttgtttattctctggactacgctcgcacacgtgtggccaatgatgccaaagc

SEQ ID NO: 13491 - protein, 218 aa, Panicum virgatum
  misc_feature: Ceres CLONE 1769688
  misc_feature (79)..(176): Pfam Name: Mito_carr Pfam Description: Mitochondrial carrier protein
MADELRSMSVVQKVHGQSVLLSRITSCSAMNNPVFNNAYSAYNMPRRSYQGMNATVGLPSVMAPSPFFASAPKEKGFSGFMIDFLMGGVSAAVSKTAAAPIERVKLLIQNQDEMIKSGRLSEPYKGIGDCFARTMKDEGFVSLWRGNTANVIRYLPTQALNFAFKDHFKRMFNFKKDKDGYWKWFAGNLASGGAAGACSLFFVYSLDYARTRVANDAK

SEQ ID NO: 13492 - DNA, 790 bp, Panicum virgatum
  misc_feature: Ceres CLONE 1769691
  misc_feature: Encodes the peptide sequence at SEQ ID NO. 13493
atcatttacagccaaaccaacaccgcgaaatgaagtactagcagcaagtatgcagtacgcacacttattgcgctttgacggttggcacctagacagtgccccaaaggctgacggcttcatccgattggtgtgtgttgtccatttatcttccactctttcccctcgagctctccactagcttaccccttctctgcagtccgggaagcacacggcggaagcaagggattaaagggaccatggggcagaagcatcttctattgctcacttgtttttgggtcctgtcatgtgccttactgcttcatgcttcctccgatggactgctaagaatcaacctcaacaagaagagactggacaagggagctttgactgctgcgaaattggctaggcatgagactcgccttcggagaaggtttgatggttctcgccagtctcttggtgactcaagcgatgacatagttcctttggacaactacctggacactcaatactttggagagattggcatcggcacgccaccacagaacttcactgtgatattcgacactggaagctccaacttgtggattccctcctcaaaatgctatttctcgatagcatgctacttacaccacagatacaggtcagtcaagtcgaagacttacaaaaagaacggggaaacttgcacaataacatatggttctgggcaaattgctggcttcttcagtgaagacaatgtgttggtcggcagtcttattgtaaaaaatcagaagttcattgagacaacccgtgaaaccagccctacctttataat

SEQ ID NO: 13493 - protein, 184 aa, Panicum virgatum
  misc_feature: Ceres CLONE 1769691
  misc_feature (83)..(184): Pfam Name: Asp Pfam Description: Eukaryotic aspartyl protease
  misc_feature: SWISSPROT Homolog: EC 3.4.23.40 Phytepsin
MGQKHLLLLTCFWVLSCALLLHASSDGLLRINLNKKRLDKGALTAAKLARHETRLRRRFDGSRQSLGDSSDDIVPLDNYLDTQYFGEIGIGTPPQNFTVIFDTGSSNLWIPSSKCYFSIACYLHHRYRSVKSKTYKKNGETCTITYGSGQIAGFFSEDNVLVGSLIVKNQKFIETTRETSPTFI

SEQ ID NO: 13494 - DNA, 682 bp, Panicum virgatum
  misc_feature: Ceres CLONE 1769691-R
  misc_feature: Encodes the peptide sequence at SEQ ID NO. 13495
tttgaactatgcgaatcagctctgtgagcgcctccctagccccaatggtgaatcaaccgtcgactgccatcagatctcaaagatgccaaatcttgcattcaccatagcagacaagaccttcaccttaacaccagagcagtacattgtgaagctggagcaagcaggtcaaaccatgtgtatcagtgggttcatggcattcgacataccgcctcctcgtggcccgctctggatccttggagatgttttcatgggcgcgtaccacaccgttttcgacttcggcgagaacaagatcgggttcgccaagtctgcctgaggactggagtcctccacagtagtgacatctcctgtttgtcctcccagtattgtacatatatcgcagactggcataagctgcaaagtttagtagtgtatgcacgcagaagcctgtggggctatccgactaatgcctgtatgtgtttgcaaatggagctgcgctatttatgaagctccgggacatggaatgccatgcgtgtaaataatcagcctgggagtacggtgaggattagggtttttcacctgatctcatcatgtttattggcctcgattagtaagtgggctctatcagcagtagccatttcgggctcgttttagaatgcagctttgcatgatcattatggcaatgaacaatctagagctttactag

SEQ ID NO: 13495 - protein, 103 aa, Panicum virgatum
  misc_feature: Ceres CLONE 1769691-R
  misc_feature: SWISSPROT Homolog: EC 3.4.23.40 Phytepsin
LNYANQLCERLPSPNGESTVDCHQISKMPNLAFTIADKTFTLTPEQYIVKLEQAGQTMCISGFMAFDIPPPRGPLWILGDVFMGAYHTVFDFGENKIGFAKSA

SEQ ID NO: 13496 - DNA, 1054 bp, Panicum virgatum
  misc_feature: Ceres CLONE 1769694
  misc_feature: Encodes the peptide sequence at SEQ ID NO. 13497
atccaccaccacccagccgaacaatctcagctcgccggacacgcagaattgattgaagatggccgcgtcggcgctgcaccagaccaccagcttcctcgggcaggccctggtctcccgccccgccggcggcgccgacgccggcgggcgcatcaccatgcgccgcaccgtgaagagcgcgccccagagcatctggtacggccccgaccgccccaagtacctcggcccgttctccgagcagacgccgtcgtacctgaccggcgagttccccggcgactacgggtgggacacggcggggctgtccgccgacccggagacgttcgcgcgcaaccgcgagctggaggtgatccactcgcggtgggcgatgctgggcgcgctggggtgcgtgttcccggagatcctggccaagaacggcgtcaagttcggcgaggccgtgtggttcaaggccggcgcgcagatcttctccgagggcgggctggactacctggggaacccgaacctggtgcacgcgcagagcatcctggccatctaggcgtgccaggtggtgctcatgggcttcgtcgagggctaccgcgtcggcggcgggccgctcggcgaggggctcgacaaggtgtaccccggcggcgccttcgacccgctgggcctcgccgacgacccggacaccgccgcggagctcaaggtcaaggagctcaagaacggccgcctcgccatgttctccatgttcggcttcttcgtgcaggccatcgtcaccggcaagggccccatcgagaacctcttcgaccacgtcgccgaccccgtcgccaacaacgcctgggcctacgccaccaacttcgtccccggcaaatgaatgctgctctgctctgcttgtccaagaatgcagtaggcgtgtagagttgcacgcgccggcgtatgcttcgtaagctcgtcagattcagatcagatcagcagctgcgtctgcctgcacgtgatgtaaacttgtaaactacgcacagagatgcatgtgtaagatcaatggtgtaccgtaccattcatgagtggatcttgttgtcacttgtcc

SEQ ID NO: 13497 - protein, 156 aa, Panicum virgatum
  misc_feature: Ceres CLONE 1769694
  misc_feature (60)..(151): Pfam Name: Chloroa_b-bind Pfam Description: Chlorophyll A-B binding protein
MAASALHQTTSFLGQALVSRPAGGADAGGRITMRRTVKSAPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAI

SEQ ID NO: 13498 - DNA, 2480 bp, Panicum virgatum
  misc_feature: Ceres CLONE 1769701
  misc_feature: Encodes the peptide sequence at SEQ ID NO. 13499
aatctagtggcctgagcttcgcatttgcagttgcaggcactggtgccctgcgtcgtctagttcttgttcctcggcagttgagctgcacacgccaacttcttgtgcacaagttcttggcattgcattgcagctcatgccatgtgagtagctgaccagagctcactcagtcactcgaagctgcacgccggcagcggcaaaccaacgctagatctctcgagattcggcgatggagcagtcctcctgctacttccctctgcggtgggagagcaccggcgaccagtggtggtacgcgtcgccgatcgactgggcggcggccgacggccactacgacatcgtgcgccagctgctgcacctcgaccccaacctgctcatcaagctcacctccctccgccggatccgccgcctcgaggctctgtgggacgacgacgcccgcttcgccgacgcggccaggcaccgcgcgtccatcgcgcggagcctgctgctggagtgcgagtgcaggaaccaccgccccgccggcggcggcgagaacacgctgctccgggccgggtacggcgggtgggtgttgtacacggcggcgtcggccggggacgtggcgttcgtgcaggagctgctgaacagggacccgctgctcgtcttcggcgagggcgagtacggcgtcacggacatgttctacgcggcggcgaggggagggagcgccgacgtgttcaggctgctgctcgaccacgccatgtcgccgaggtgctcgacgaattgccgggacggcgaaagcagcgcagggcgcggctccgtgttccggctggagatgatgagccgggccgtccatgccgcggcgagaggcgggagcgtggagatgctgagggagctgctcgaggtggggcgctcgggcgtgaccgtgtacctcgacgtccgtggatccaccgtgctgcatgccgctgctgggagaggccagctgcaggttgtcaagtaccttctggcgtctttcaacataatcaattcaactgataatcacgggaacacagcattacatgtagcagcctatcgagggcaccaacctgttgttgaagcattggttgctgcatctccatcaaccttgtcagctgtcaaccatgctggtgatacgtttctccattcagcagttgcgggattcaggaccccaggattcagacggcttgaccaccaaatggagctgatgagatacctcataagcgatagaaccacagatatccagaagatcatcaacttgaaaaacgacgcgggccttaccgccctacacatggctgtggttggctgcgcacacccagacctcgtcgagctcttgatgaccgccccatcgattgacctcaacgccgaagatgctaatggcatgactgcactggcactgctgaagcagcagctgcgttcagcgacatccgaccgcctcatcaagcagatagtctctgccggaggagtcttaaattccagcattctgagaacccggtctgccattgcatcccagattaagatgcaaggggggattgcaagcagtcccggtaccaccttcaaggtatcagatgtagagatcttcttgttctcgggcatcggggctgcagagtctcaaaggccaagctcgtgctccagcaccggcaaggatgaccctgcgcacgcagatgcaaatggcgccgaaaaccatggatcttcggagaagaggctgagctccgcgagtcgtgccaaggaccgtctcaagatgatgctaagatggcctcggcacaaggagaagatgtccaaggcgcttaagaaatcagaggacagcagcccgctggagtccatcaagaagctgggcgagcacggcgtcgagacccccgctcccctgaggcagaagttcaccaagacaacggcgctcaacggcaagcggactctggcggtgaagagctccgccccaggctcttcggccaccaagaagaagctcaacacgaagctgatccacggcatcatggaggcgatgccgcagctagcgccgccgcccgcgcagtcccggtccccgagcgacaccctcccgaggtcctccatgtcgtccaccccgatgccgctggcaaagctgaaggacatctgcctggacgacgaggagattgccatggtgacgccgcccatcggcaggctgagggacatcgtcctggacagcgacgacactacggatgacccgtcgtgctccaactcctccatggacgacggctgtggcggcactgcggagagcacggcccggaagcacgggtgcggcaacgggaggctgatcaacatctgcttcggcgcacagggcctcactgtggaggacacggtgagcgggcagcccacgagcaagatgttcaagcagcaatgcctcagggtgtcatgaatggttggttcttccttgagctccatggttgactgatgcgtgtaccatagcgtgcgtgtgaatcgtgtaatcggattgacatctctacagtgtagagaggcgtgtttgattc

SEQ ID NO: 13499 - protein, 713 aa, Panicum virgatum
  misc_feature: Ceres CLONE 1769701
  misc_feature (261)..(294): Pfam Name: Ank Pfam Description: Ankyrin repeat
  misc_feature: SWISSPROT Homolog: EC 2.7.11.1 Non-specific serine/threonine protein kinase
MEQSSCYFPLRWESTGDQWWYASPIDWAAADGHYDIVRQLLHLDPNLLIKLTSLRRIRRLEALWDDDARFADAARHRASIARSLLLECECRNHRPAGGGENTLLRAGYGGWVLYTAASAGDVAFVQELLNRDPLLVFGEGEYGVTDMFYAAARGGSADVFRLLLDHAMSPRCSTNCRDGESSAGRGSVFRLEMMSRAVHAAARGGSVEMLRELLEVGRSGVTVYLDVRGSTVLHAAAGRGQLQVVKYLLASFNIINSTDNHGNTALHVAAYRGHQPVVEALVAASPSTLSAVNHAGDTFLHSAVAGFRTPGFRRLDHQMELMRYLISDRTTDIQKIINLKNDAGLTALHMAVVGCAHPDLVELLMTAPSIDLNAEDANGMTALALLKQQLRSATSDRLIKQIVSAGGVLNSSILRTRSAIASQIKMQGGIASSPGTTFKVSDVEIFLFSGIGAAESQRPSSCSSTGKDDPAHADANGAENHGSSEKRLSSASRAKDRLKMMLRWPRHKEKMSKALKKSEDSSPLESIKKLGEHGVETPAPLRQKFTKTTALNGKRTLAVKSSAPGSSATKKKLNTKLIHGIMEAMPQLAPPPAQSRSPSDTLPRSSMSSTPMPLAKLKDICLDDEEIAMVTPPIGRLRDIVLDSDDTTDDPSCSNSSMDDGCGGTAESTARKHGCGNGRLINICFGAQGLTVEDTVSGQPTSKMFKQQCLRVS

SEQ ID NO: 13500 - DNA, 708 bp, Panicum virgatum
  misc_feature: Ceres CLONE 1769708
  misc_feature: Encodes the peptide sequence at SEQ ID NO. 13501
  misc_feature (78)..(78): n is a, c, t, g, unknown, or other
gaacacggacgacgcagcgcaggaatcccttaccctccctccctgcggcccggagggacagagagaagcagaaaaagncccctccctccctcgcttcccatggatctccgcctcgcccactagtccactggggagtggtggaggggggatggggctccccgggcggctgctgctgccgctgcttctcggcctcgcttcggcggccgtcgccgtcgccgcggaagcttccgagggcgacgccgatccgctctacaaaacttgtgttgaagaatgccaaaaaacgggctccctcaaagatacttcaattaagcactgtgtcgagcttttttttggcaaacctgcagccaaatcatggtacacgcacgaaccattgtacctgcaatggaaagagtggaactgcaagagtgaatgcagataccactgcatgatggaaagggaaaatgaaaggacagagcttggcttaccgcctgttaagtaccacggcaagtggccgttgaagcgtgcttctgtgtttcaggaacctttatctgccgctctctctgctctcactcttattgtgcagttcaatgggtggttatcgtttttcctattgctgtactataagctacctctacggccagaaactcataagacctactatgagtatactggcttgtggcacatttatgggcttctagccatgaattcttggttctggagtgccatata

SEQ ID NO: 13501 - protein, 186 aa, Panicum virgatum
  misc_feature: Ceres CLONE 1769708
  misc_feature (71)..(186): Pfam Name: Per1 Pfam Description: Per1-like
MGLPGRLLLPLLLGLASAAVAVAAEASEGDADPLYKTCVEECQKTGSLKDTSIKHCVELFFGKPAAKSWYTHEPLYLQWKEWNCKSECRYHCMMERENERTELGLPPVKYHGKWPLKRASVFQEPLSAALSALTLIVQFNGWLSFFLLLYYKLPLRPETHKTYYEYTGLWHIYGLLAMNSWFWSAI

SEQ ID NO: 13502 - DNA, 1763 bp, Panicum virgatum
  misc_feature: Ceres CLONE 1769722
  misc_feature: Encodes the peptide sequence at SEQ ID NO. 13503
agtcctgcagtcctgctgtgcttgcgcgggccaggcggccagccgcttcccagggcctccgactccgagaccggagaacgccgccacgagcttgtgcggcgcccggccgtgcgtcgcggccgcgggccgccgcggcaccgcccttgcgaacggccggctgaagagaggacggcggctgccggctggacggggaaaatgaacccgatgtggctggcggaggggcagccggcatccacggacgcgacggccgccggccaccgagccgatgcgccgcgagctatggaaaccggtcggtaatttccggggggcgtcaccgcgtggccgttgcctcaccgccggccacttgggttcggctcggcctcgttgggcctgggccggactggagctggctgggccggacccggtcggcacatggtcgggtccgaaccgggccagatatttgcgaccccaatctccagcagcgcagccgctcgctccctcttctcgtccgcacaacaccgagcaagcgagaggagacggagagccgggtggcgatggcgggcaccggctgccactcgctcctctcgccgctctcccccaacatcttctcgcaccgtcgagcctccgccgtcggcagcggagcctgccggcccagtaaagtgcgacctcagatcaggtgttgctcgaaagttgatgatgcaaaggtatgtgcagacacgtgcaagagaggcaaggttgtgagtgttgccttatcctcatgtccaattcgtgatgttaacttagcatgtatctgattgcagtaacccgtatagtagttgtaatgttcaagctaagccatcccttagaccctttagtaggttctctcttccaacacaattagagttgaaacacatgaataaggatagagagcctgatctgatttgtgtgtcgtagtgagtggaaggttcttactacaatcatatctttagaatataggcattttatattctcataattgaatttctggttcatctatgaatgattaaattgaaaataccaaaggccccaggtatagctgtccaatagctctagacgcggtgcccgttatattagttccagacttgtaacatttgacagccaaaatcttgccattgaggaatgtacaactttggcctgcattttgagtgagctgattctactcaagcagttatgcaagcccactactgaattcacctttttgtggatgaagaaactagaccttcaagacgaaaatgtcttgtctgcctaggtgctgtaaccataatcagtacaacaggcccaacgatttgtacaccaaacggaatcgccgcagatatgacgaacaagtctgggatacagaaagctgtttgcagaaattgcaacggcagtggtgctgtgatatgtgatatgtgcggtggcacaggaaaatggaaggccctcaacagaaagagggcaaaagatgtttatgaattcacagagtgccccaattgctacggccgagggaagctggtctgccctgtctgtcttggaactgggctgcctaataataagggactcctccggcgaccagaagccaagcagttgctcgataagatgtacaacggcaagatattgccaaggtcgtagttcgtagaccgcacaggcagtcagccacatgattttgcatcagttatcgagtaggaataacattcgcgacaaatgattttgcatgattttgtactaagttcaaagattatatcttggatttagctttcaaattaccacagatacgaagtgacaagtgattc

SEQ ID NO: 13503 - protein, 96 aa, Panicum virgatum
  misc_feature: Ceres CLONE 1769722
  misc_feature (1)..(74): Pfam Name: DnaJ_CXXCXGXG Pfam Description: DnaJ central domain (4 repeats)
MTNKSGIQKAVCRNCNGSGAVICDMCGGTGKWKALNRKRAKDVYEFTECPNCYGRGKLVCPVCLGTGLPNNKGLLRRPEAKQLLDKMYNGKILPRS

SEQ ID NO: 13504 - DNA, 600 bp, Panicum virgatum
  misc_feature: Ceres CLONE 1769727
  misc_feature: Encodes the peptide sequence at SEQ ID NO. 13505
acttctcgcgccgccggaacggaagccgaatcgcccccgcgcggagcagagcggaggagaggagatggcggagaagaagggagcggcggcgaggaaggaggaggtggtcaccagggagtacaccatcaacctccacaagcgcctccacggctgcacattcaagaagaaggcacccaatgccatcaaggagatcaggaagttcgcacagaaggctatgggcaccaccgatgtccgggttgatgtgaagctcaacaagcacatctggagcagcgggatcagaagcgttccgcggagggtgcgtgtgagaatcgcccgtaggaggaacgatgaggaggatgccaaggaggaactctactccctcgtcactgtcgctgagatcccagctgagggtttgaaagggctgggaaccaaggtcatcgacgaagcggattaagctctcacatcctttacatctttagaacgagtgtagcttgtattggcaacagcaaaccttttgtgccccaaagaagttttgaactcttgtactgtgatgcgacatcacaaagttctctatttccttaaatcgaattcaatggttagttatgtgttcatttctttatc

SEQ ID NO: 13505 - protein, 122 aa, Panicum virgatum
  misc_feature: Ceres CLONE 1769727
  misc_feature (10)..(104): Pfam Name: Ribosomal_L31e Pfam Description: Ribosomal protein L31e
MAEKKGAAARKEEVVTREYTINLHKRLHGCTFKKKAPNAIKEIRKFAQKAMGTTDVRVDVKLNKHIWSSGIRSVPRRVRVRIARRRNDEEDAKEELYSLVTVAEIPAEGLKGLGTKVIDEAD

SEQ ID NO: 13506 - DNA, 2088 bp, Panicum virgatum
  misc_feature: Ceres CLONE 1769730
  misc_feature: Encodes the peptide sequence at SEQ ID NO. 13507
gtctctctcgtcctcctcactcagacctctccgcacccccgcgccaatggctgattcgccaaaccctagctccggggacctccccgccggctccgggggctcgccggagaagccggtcctcgcggatcggcgcgtggcggcgctcgccggtgcgggcgcgggcgcgaggtacaaggccatgtcccccgcgcggctgccgatctcgcgggagccctgcctcaccatccccgccgggttcagccccggcgccctcctcgagtcccccgtcctcctcaacaacttcaaggttgaaccctctccaacaactggtactctgagcatggctgcgatcatcaacaagagcacccatctggacatactgccatcacctcgggagaaatcagctggcagtggcaacgaagatggagattctcgggattttgaattcaagcctcatctcagttgtcagccggcggagtcgattcatcagacagcaaatatttcaagtgttccaaatcaacctgttgcaatagttggtccatctgacaagatgcctgctgaagttggtacatcagagatgaaccagatgaatagctctgagaatgctgcccaggagacacaaactgaaaatgtagctgaaaaatcagctgaggatggctataactggcgtaaatatggacagaagcatgtcaagggaagtgaaaaccctagaagttattacaagtgcacacatcctaattgtgaagttaaaaaactattagagcgttcgcttgatggtcagattactgaagttgtttataaagggcttcataatcatcctaagccccaacctaataggaggttagctgctggtgcggttccttcaagccagggtgaagaaagatatgatggtgcggcacctgttgaagacaagccttcaaatatttatcccaacctctgtaatcaagtacattcagctggcatgattgatcctgttccgggtccggctagtgatgatgacggtgatggcggaggtggaagatcataccctggggatgatgctaacgaggatgatgatttggattcaaaacgcaggaaaatggagtccgctggcatcgatgctgctttgatgggtaaaccaaaccgtgagccccgtgttgttgtacaaactgttagtgaagttgatatcttggatgatggatatcgctggcgcaagtatgggcagaaagtagtgaaaggaaaccccaatccacggagttactataagtgcacgcatacaggatgtccggtcaggaagcatgttgagagagcatcgcatgacccaaagtcagtgatcacaacatatgaaggaaaacataaccatgaagtcccagcttccaggaatgcaagtcatgagatgtctgcagctcccatgaagcctgctgtgcatcctattaacagcagcatgccgggccttggtggcatgatgagagcatgcgatgccagggctttcaccaatcaatattctcaggcagctgaaagtgacaccatcagtcttgacctcggagttggaatcagcccgaaccacagcgacgcgacaaaccacatgcagccttcagttccagaaccaatgcagtatcaaatgcaacacatggctcctgtgtacggtagcatgggatttccaggaatgccagtgccaacagtacctggaaatgcagctagcagtgtgtacggatccagagaagaaaaagcaaatgaagggtttactttcaaagccacaccattgggccgttcagctaacttgtgttacagtagtgctggtaacttagtgatgggtccatgagtgtcttaactgatggttatacctccatgaatcacatattaccgtcatcatgaaaatcgcttcaggtgatgctctactgtgcatcatccacacataattgaatcggaggcggtcaaggtatacctgagagctgcagctattacacaggaggtcttttgctgttaggatgtactctctgtatgtgatgctgcagctcaacattcgttgtacagcaaaccagttatgattaattagattatgataatttggctatgtaaacttctttctgtactggaatattggatagaaccaaagagctatccggtggc

SEQ ID NO: 13507 - protein, 577 aa, Panicum virgatum
  misc_feature: Ceres CLONE 1769730
  misc_feature (368)..(427): Pfam Name: WRKY Pfam Description: WRKY DNA -binding domain
  misc_feature (194)..(252): Pfam Name: WRKY Pfam Description: WRKY DNA -binding domain
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MADSPNPSSGDLPAGSGGSPEKPVLADRRVAALAGAGAGARYKAMSPARLPISREPCLTIPAGFSPGALLESPVLLNNFKVEPSPTTGTLSMAAIINKSTHLDILPSPREKSAGSGNEDGDSRDFEFKPHLSCQPAESIHQTANISSVPNQPVAIVGPSDKMPAEVGTSEMNQMNSSENAAQETQTENVAEKSAEDGYNWRKYGQKHVKGSENPRSYYKCTHPNCEVKKLLERSLDGQITEVVYKGLHNHPKPQPNRRLAAGAVPSSQGEERYDGAAPVEDKPSNIYPNLCNQVHSAGMIDPVPGPASDDDGDGGGGRSYPGDDANEDDDLDSKRRKMESAGIDAALMGKPNREPRVVVQTVSEVDILDDGYRWRKYGQKVVKGNPNPRSYYKCTHTGCPVRKHVERASHDPKSVITTYEGKHNHEVPASRNASHEMSAAPMKPAVHPINSSMPGLGGMMRACDARAFTNQYSQAAESDTISLDLGVGISPNHSDATNHMQPSVPEPMQYQMQHMAPVYGSMGFPGMPVPTVPGNAASSVYGSREEKANEGFTFKATPLGRSANLCYSSAGNLVMGP

SEQ ID NO: 13508 - DNA, 819 bp, Panicum virgatum
  misc_feature: Ceres CLONE 1769734
  misc_feature: Encodes the peptide sequence at SEQ ID NO. 13509
ctatccactccgccccccaaataatccccacctccgctgctcccccgcctccgccgcccgccatggcctccctcgcctcggcctccacctccctcctcttcccgcaggcctcctcctccaggagccgcgccgggatctccacctccctgggcttccccgcgcagccggcgcggctccggagccgggcggcggcggcggcgggcgggccgaggcgcgggcgcctgctggtggtgcgcgcggcgaggggcaagttcgagcgcaccaagccgcacgtcaacatcggcaccatcggccacgtcgaccacggcaagaccaccctcaccgccgcgctcaccatggtgctcgcctccgtcggcggcagcgcgcccaagaagtacgacgagatcgacgccgcccccgaggagcgcgcccgcgggatcaccatcaacaccgccaccgtcgagtacgagaccgagacccgccactacgcgcacgtcgactgccccggccacgccgactacgtgaagaacatgatcaccggcgccgcccagatggacggcgccatcctcgtcgtctccggcgccgacgggcccatgccccagaccaaggagcacatcctcctcgccaagcaggtcggcgtcccccagattgtggtcttcctcaacaagaaggacatggtcgacgacgaggagctgctcgagctcgtcgagctcgaggtccgtgagctgctcagcaactacgagtacgacggagacgacgtgccaatcgtctccggctccgccctcaaggcgctcgaggccctcatgggcaacccggccctcaagcgcggcgacgacccct

SEQ ID NO: 13509 - protein, 252 aa, Panicum virgatum
  misc_feature: Ceres CLONE 1769734
  misc_feature (68)..(252): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature: Useful for making plants with modulated oxidative stress sensitivity
MASLASASTSLLFPQASSSRSRAGISTSLGFPAQPARLRSRAAAAAGGPRRGRLLVVRAARGKFERTKPHVNIGTIGHVDHGKTTLTAALTMVLASVGGSAPKKYDEIDAAPEERARGITINTATVEYETETRHYAHVDCPGHADYVKNMITGAAQMDGAILVVSGADGPMPQTKEHILLAKQVGVPQIVVFLNKKDMVDDEELLELVELEVRELLSNYEYDGDDVPIVSGSALKALEALMGNPALKRGDDP

SEQ ID NO: 13510 - DNA, 838 bp, Panicum virgatum
  misc_feature: Ceres CLONE 1769737
  misc_feature: Encodes the peptide sequence at SEQ ID NO. 13511
aagcaaggcatcatcagcagccatggcttcgccctcggtgtccacctcccacctcctcatcaccgcctccctcccaaagcccaagccttcctccctccgcccgccgcgcctccctctcgccaagcccctccccgcggcgctcctcgctctcgccgcggcgcccgctcttgccgctgacgcgccggcgcctcccccggccccgtcccccgcgcccgcccccgagctccaggccgaggcccccaccccgaccgccaaccccttcgccaactccctcctcacggcccccaagccctccgccgccgcggacctccccgagggcgcgcagtggcgctacagcgagttcctctccgccgtcaagcgcggcaaggtcgagcgcgtccgcttctccaaggacggcggcctgctccagctcaccgccgtcgacggccgccgcgccaccgtcgtcgtccccaacgaccccgacctcatcgacatcctcgccaccaacggcgtcgacatctccgtctccgagggcgaagccgccgggcccgggggcttcctcgccttcgtcggcaacctcctcttccccttcatcgccttcgcgggcctcttcttcctcttccgccgcgcgcagggcggcccgggcgcgggtcccggcggcctcggcgggcccatggactttggacgatccaagagcaagttccaggaggtccctgagaccggcgtcaccttcctcgacgtcgccggcgccgatcaggccaagctcgagctgcaggaggtcgtcgatttcctcaagaaccccgacaagtacaccgctctgggtgccaagatccccaagggatgtctcctggtcggcccg

SEQ ID NO: 13511 - protein, 271 aa, Panicum virgatum
  misc_feature: Ceres CLONE 1769737
  misc_feature (100)..(240): Pfam Name: FtsH_ext Pfam Description: FtsH Extracellular
MASPSVSTSHLLITASLPKPKPSSLRPPRLPLAKPLPAALLALAAAPALAADAPAPPPAPSPAPAPELQAEAPTPTANPFANSLLTAPKPSAAADLPEGAQWRYSEFLSAVKRGKVERVRFSKDGGLLQLTAVDGRRATVVVPNDPDLIDILATNGVDISVSEGEAAGPGGFLAFVGNLLFPFIAFAGLFFLFRRAQGGPGAGPGGLGGPMDFGRSKSKFQEVPETGVTFLDVAGADQAKLELQEVVDFLKNPDKYTALGAKIPKGCLLVG

SEQ ID NO: 13512 - DNA, 1764 bp, Panicum virgatum
  misc_feature: Ceres CLONE 1769744
  misc_feature: Encodes the peptide sequence at SEQ ID NO. 13513
tgtcccccacccatttcgtcggcctcctctccttccccccgcctcgtcacccccgaattagcagaagccacgaatccgccgcgcctcgaggtcggccaccggcctccccgagggcgttaccctagcggctctcgctccaccgttgacagggagcgcagccccgccgccgccaggctgcggcgggctggcgtgaccggagctcctcgccgccgctgataagatccaacgggttcctaggttttctttcggggggaggcaggggacgccggtcccgtcgagtggtccggtgagcatggcagggcccaagttcgggtcgttcaagggaaaaaagggggagtcggcggctgctgccggcgccgcggcgcagaggagggacccttacgaggtgctcggggtggggcgtaatgctactgagcaggagatcaagagcgccttccgccgcatggcactcaagtaccatccagataagaatgcagacgaccctatagcctcagagaagttccaagaagctacattctcttacaacatcctgtcagatccagataagaggcgccaatatgattcatctggatttgaggccatcgaagcggatagtcaggaattggagctggatctatcaagtctcaatactgtaaatacagtgtttgctgctctgtttagcaaattaggtgttccaatcaagaccactgtctcggcaacacttttagaggaggcattgaatgggtcagtagagatttctgagcttcagttgggcaagtctgtatgtaggaaggtagaaaagcagacagctcacttctattctgtagacataacagacaaaaaagccaaaatgggcttagtgtgtagagttcattcaactgctaaaagtaaatttaagctgctgtattttgagcctgaggacaatggtggattgagccttgctttacaggaagatagtgcaaagactgggaaagttacttctgcagggatgttctttctaggttttcctgtgtatcgatttgaacagaacaattcggctgctgctgcaaaggatcctgatagcgcattcttttaaagattggatggctttcaaccatgtgaagtaaatgaactgaaagcaggaactcactatttcgctgtctatggtgataatttcttcaaaagtgtgagctatactatagaggttgtatgtgctgaacccttttctgctgaaaaggagaggctacggagtgtggaggcaaagataattgcaaaacgatctgagctgtctaaatttgagtctgagtatcgggaggttttggcaaagttcactgagatgacaagtagatatgctcaagaaatgcaaacgatcgatgatcttctaaaggaaaggaatgcaattcatgcatcctacaccaacaacccaactcttcaacggagttccagtagcagcaaagggaaatcaccatctaaagggtccaaaaatgaggatgatcaaacggtaaagaaggaaaagaaatcgaagagccagcccatggatggatccagaagcgatgacgaggctacaaaaaataagaaggaaaagaaacctaaagatcggattcgaaggaagaagtggttcaacattcatttgaaagtggataagagaaggccctgctgagaactgtaacatattatattgtgtgtgtgttttttttgtttttgtttttgtttttttttgttctgaagatatcgcatgatgccatcacttatctttttttctgctgccattctcaggaaacatgaatgaatcctctttagtctctg

SEQ ID NO: 13513 - protein, 253 aa, Panicum virgatum
  misc_feature: Ceres CLONE 1769744
  misc_feature (28)..(90): Pfam Name: DnaJ Pfam Description: DnaJ domain
MAGPKFGSFKGKKGESAAAAGAAAQRRDPYEVLGVGRNATEQEIKSAFRRMALKYHPDKNADDPIASEKFQEATFSYNILSDPDKRRQYDSSGFEAIEADSQELELDLSSLNTVNTVFAALFSKLGVPIKTTVSATLLEEALNGSVEISELQLGKSVCRKVEKQTAHFYSVDITDKKAKMGLVCRVHSTAKSKFKLLYFEPEDNGGLSLALQEDSAKTGKVTSAGMFFLGFPVYRFEQNNSAAAAKDPDSAFF

SEQ ID NO: 13514 - DNA, 2121 bp, Panicum virgatum
  misc_feature: Ceres CLONE 1769748
  misc_feature: Encodes the peptide sequence at SEQ ID NO. 13515
cttagctcacttcattgcttgcagcttgcccatccacttctgccggagctagctggaccgactcgcccgccagcttcgagtgcagaacgtcctagtcaactcctgcgcaagagagtcgccagcagccatggatgtggagagctccccagcggccgccggggcctccgtggactggcgcggccgcccgtgccgcccgcgccggcacggcggcatgcgcgccgccgtcttcgtcctagtgttccagtcggcgcagacgatggcgctggcggcggtggggagcaacctgatcaccttcgtcttcggcgagctccacttcccgctgtcgcaggcggccaacgtggtgaccaacttcgtcggcaccgtcttcatcctctcgcccctcggcggcttcctctccgactcctacgccggctgcttctggacactcctcgccttcgacaccgtcgagctcgcgggcttgatattactgtcggtacaagcccatctgccacagctcaagtcggcgccgtgcaacatgctcaccatggtcggcagctgcgagcgggccagcggcttcaaggccaccatcttcttcgtggcgctctacctggtggcgcttggctgcggctgcgtcatgcccaacatgaccgcgtacggcgccgaccagttcgccggcgcggcggacaaggacgccaagaggctgccgacctacttcaacctctcctacttcggctactgcgccggcgagctcgtcgcgctgacggcgatcgtctgggcgcagacgcgctacgggatggacgtcggcttcggcctggccgccgccgccatgggggccgggctcatcagcctcgtctccggcgtgctgttctaccggaacaagccgccacggggcagcatcgtcactccgattgcaagggtttttgttgctgcgttcaccaagaggaagcaaatctgcccttccggctcttccaaccctgccaacgccggagccggtgccggtgatccggcggcgaccgtcgacgacaacttccctcacgccaataaattcaggttcttggacaaggcgtgcatcagggtagcgccggagccggacacggagccagagagcccgtggcggctctgcacggcggcggaggtgcggcaggtcaagacgctcctcgccgtgatgcccatcgtggcgtgcaccatcgtcttcaacaccgtgctcgcgcagctgcagaccttctcggtgcagcagggcagcgccatggacaccaggctggcgccgggctcctcctccttttccatcccgccggcgtcgctgcaggccatcccctacaccatgctcctggtgctcgtcccggcctacgagctcctcctcgtcccgctgctgcggcgggtcacgggcacccggtccgggatcaccccgctccagcgcatcggcgtggggctctgcgtggtggcgctgtccatggccgccgccgcgctcgttgagcggcgccgccgggacgcctccgtgtccggcggcgggcggctgtccgtcttctggctcgtgccgcagttcctcgtgttcggcgtgtcggagctcttcaccaacgtggggctcatggagttcttctacaagcaggcggccgccggcacgatgcaggccttcttcatggcgctcttctactgctccttctccttcgacttcttcctcagctccgtgctggtgtcgctggtgaaccgggccacggcgaggggcggccgccgcggctggctcggcgacaacgacctcgacagggacaggctcgacctcttctactgggtgctcgccgcgctcagcgtgctcaacttcttctgctacctgctgtgcgcgaggtggtacaactccggcggcgcgggcggcgccagtgaggccgcctccgacgaggccgcgtccgaggacgacgacgacgacggcaaggggctcatctgaaggaatcaggaacgagcatgatactgaaactgatcgatgtatacgagcatggtcctatatatagaagaagaatggtagatattagcatgcatacaaagtgtgagtgtgacgccaaagatttctaccggaaattggccagagatatcataccacccacattgtgccgtccattcatgttagcgagaaattatatttgtatacatgtc

SEQ ID NO: 13515 - protein, 595 aa, Panicum virgatum
  misc_feature: Ceres CLONE 1769748
  misc_feature (97)..(503): Pfam Name: PTR2 Pfam Description: POT family
MDVESSPAAAGASVDWRGRPCRPRRHGGMRAAVFVLVFQSAQTMALAAVGSNLITFVFGELHFPLSQAANVVTNFVGTVFILSPLGGFLSDSYAGCFWTLLAFDTVELAGLILLSVQAHLPQLKSAPCNMLTMVGSCERASGFKATIFFVALYLVALGCGCVMPNMTAYGADQFAGAADKDAKRLPTYFNLSYFGYCAGELVALTAIVWAQTRYGMDVGFGLAAAAMGAGLISLVSGVLFYRNKPPRGSIVTPIARVFVAAFTKRKQICPSGSSNPANAGAGAGDPAATVDDNFPHANKFRFLDKACIRVAPEPDTEPESPWRLCTAAEVRQVKTLLAVMPIVACTIVFNTVLAQLQTFSVQQGSAMDTRLAPGSSSFSIPPASLQAIPYTMLLVLVPAYELLLVPLLRRVTGTRSGITPLQRIGVGLCVVALSMAAAALVERRRRDASVSGGGRLSVFWLVPQFLVFGVSELFTNVGLMEFFYKQAAAGTMQAFFMALFYCSFSFDFFLSSVLVSLVNRATARGGRRGWLGDNDLDRDRLDLFYWVLAALSVLNFFCYLLCARWYNSGGAGGASEAASDEAASEDDDDDGKGLI

SEQ ID NO: 13516 - DNA, 761 bp, Panicum virgatum
  misc_feature: Ceres CLONE 1769758
  misc_feature: Encodes the peptide sequence at SEQ ID NO. 13517
gccgatcgagagcgagatctgcatcgctttctcgtcccggcccggcgctttcctagggatcgccacgcgcagggggggggggggagcgaaaaagcccttcttggagccctctgcttggcctctccctctctcgtgttgcaaagctgcaggcgggcagcatggccgcaccgccgctgctgctgctggtaggcgcgctggcattgctagcccaggagcaggtggcgcggtgcgacgccgcggcgacgtgcgtcggcgtggccccggcgaagcgccggcccgaggtggtgtccatcgcggacttcggcggcgtgggcgacggccggacgctcaacacgtgggcgttccgcaaggcagtgtaccgcatccagcaccggcggcggcgcggcggcaccgagctgcgcgtgccggcggggacgtggctcaccggcagcttcaacctcaccagccacatgacgctcttcctcgccaggggcgccgtgctcaaggccacgcgggacgccgcggggtggccgctggtggagccgctgccgtcgtacggacgggggcgggagctgccggggccgaggtacgccagcttcatcaacggcaacggcctccgcgacgtcgtcatcacaggtgacaagggagtcatcgacgggcaaggtgaggtgtggtggaacatgtggaggcagaggactcttcagcacacaaggcccaaccttgtggagttcatgcattccactggcattcacatctccaacatcgtcctcaagaactcaccc

SEQ ID NO: 13517 - protein, 200 aa, Panicum virgatum
  misc_feature: Ceres CLONE 1769758
  misc_feature: SWISSPROT Homolog: EC 3.2.1.82 Exo-poly-alpha-galacturonosidase
  misc_feature: Useful for making plants with altered carbohydrate content
  misc_feature: Useful for making plants with altered cell wall content and/or composition
MAAPPLLLLVGALALLAQEQVARCDAAATCVGVAPAKRRPEVVSIADFGGVGDGRTLNTWAFRKAVYRIQHRRRRGGTELRVPAGTWLTGSFNLTSHMTLFLARGAVLKATRDAAGWPLVEPLPSYGRGRELPGPRYASFINGNGLRDVVITGDKGVIDGQGEVWWNMWRQRTLQHTRPNLVEFMHSTGIHISNIVLKNS

SEQ ID NO: 13518 - DNA, 689 bp, Panicum virgatum
  misc_feature: Ceres CLONE 1769759
  misc_feature: Encodes the peptide sequence at SEQ ID NO. 13519
cagcgccgcgggcaaggccagaccgagcgcacaggaagaagatttgcagcggcctggcaggcccggcggcgctggccgccgccgcgagccagcagccgccggcggcgagccaggcgcagcagcaggggggcgccgacaacaccgccggccccaacgccgaggcacgcgggcgccaggccgccacggccgccaccgccaacaaccccggcgacgcgcccgggcgcacccgccaccaaggccaagacggcgccgacaggggcggctactcctccgtcctcctgaccgtgaaccccgccggcggcaacaccgagcgcgacgccccgcccaacaacccgagcctgcgcggcttcgaggtgatcgacgccgccaaggccgccgtggagcgcagctgcccgcgcaccgtctcctgcgccgacatcgtcgccttcgcggcgcgcgacagcgtgaacctcaccggcaacaccttctaccaggtcccctcgggccgccgcgacgggcgcgtgtccaacgcgacggaagccctctccctcccggggcccaacagcacggcacagaacctcaccgacggcttcggccgcaagggcctcagcgccgaggacatggtggtgctctccggctcccacaccatcggccgctcccactgcgcctccttcctgttccggaagcggcagcgggcacgccgccgggac

SEQ ID NO: 13519 - protein, 228 aa, Panicum virgatum
  misc_feature: Ceres CLONE 1769759
  misc_feature (56)..(226): Pfam Name: peroxidase Pfam Description: Peroxidase
  misc_feature: SWISSPROT Homolog: EC 1.11.1.7 Peroxidase
  misc_feature: Useful for making plants with altered carbohydrate content
APRARPDRAHRKKICSGLAGPAALAAAASQQPPAASQAQQQGGADNTAGPNAEARGRQAATAATANNPGDAPGRTRHQGQDGADRGGYSSVLLTVNPAGGNTERDAPPNNPSLRGFEVIDAAKAAVERSCPRTVSCADIVAFAARDSVNLTGNTFYQVPSGRRDGRVSNATEALSLPGPNSTAQNLTDGFGRKGLSAEDMVVLSGSHTIGRSHCASFLFRKRQRARRR

SEQ ID NO: 13520 - DNA, 691 bp, Panicum virgatum
  misc_feature: Ceres CLONE 1769759-R
  misc_feature: Encodes the peptide sequence at SEQ ID NO. 13521
attggctgtgtcccaagatatctatcgattttcaagagtgataacaaagaagattatgagccagagagtggttgcctcaggtggatgaacgagttctcagagtaccacaacaagcttcttgtggaggagctggagaagctgcgcaaagttcatcctgatgtatctatcatctacgctgactattatggagctgcaatggaaattttcctttcccctgaacgatttggtatcgaggaacctttggtggcttgctgcggcggagaaggaacctatggtgtgtctccagctgtagcctgtggatatggggaatacaaggtgtgtgataacccagataagtatggctcatgggatggtttccatccatcggaagctgcatacaaggccattgcaatgggcctccttataggaacatacacacaaccgtcaattgcttccaccaccagttcgtgtccaaagcttactgagctgacctcctctgttggatacaaggttctctacgatttatagtttctgtagctacattcagttttgactgttacagaaatacatgtgttttaaatattttttggattcagacagtatggttaaagatgtaatgattttgatatttttgcctgattacagagccgcgatattgtactgcacttcacagctgttgcccaagtaattggttgggtcttgtttcatcttt

SEQ ID NO: 13521 - protein, 168 aa, Panicum virgatum
  misc_feature: Ceres CLONE 1769759-R
  misc_feature: SWISSPROT Homolog: EC 3.2.1.51 Alpha-L-fucosidase
IGCVPRYLSIFKSDNKEDYEPESGCLRWMNEFSEYHNKLLVEELEKLRKVHPDVSIIYADYYGAAMEIFLSPERFGIEEPLVACCGGEGTYGVSPAVACGYGEYKVCDNPDKYGSWDGFHPSEAAYKAIAMGLLIGTYTQPSIASTTSSCPKLTELTSSVGYKVLYDL

SEQ ID NO: 13522 - DNA, 1829 bp, Panicum virgatum
  misc_feature: Ceres CLONE 1769767
  misc_feature: Encodes the peptide sequence at SEQ ID NO. 13523
agaggcagaagctagccagggtagcgagccgaggagggcgcgcggcgatggcggcggcggcggcagcggccgtggcgaccgtgtcctccccatcccccgcctccaggcggctgctcccctcgtcctcctcctccgcggtcccgtccctcctccggctcccgcggccgggcaggcggctccggcgcgcgctgcgggtcgtctcagcggcggggggcgaggcggacgtgctgccggggccgggggccgaggcggaggcagcggtgccggggaggcttgaggagccgctgggggggagccagctcaacatcggcgggctcgccttccagggcgacgtgggcgggggcttcgccagcggcggcggcggggcgggctccggggcctccggcggcggggacgggaacaagacgctggaccgcgggatcaacacggccatcgtgctcggggccagcacctacgcgctcaccaagctcctcaccgtcgaccaggactactggcatgggtggacgatctttgagatcctccggtacatgcccgaacacaactggtcggcatacgaggaggctctcaaggccaacccggttctggccaagatgatgatcagtggcgtagtctactccctcggtgattggatcgcgcagtgctacgaaggcaagccaatctttgatttcgaccgtgctcggatgttccgatctgggcttgttgggttcactcttcatgggtcactttctcattactattaccatatctgtgaggcactgttcccattcaaggattggtgggttgtccctgcaaaggttgcattcgatcagacgatctggtctgcaatttggaacagcatctactttgtggtcttgggttttcttcggttggaatcacctagcactatctacaaagagctcaagtccacattctggcccatgcttacggctgggtggaagttatggccttttgcgcacttgattacatatggtgtgattcctgttgagcaaaggcttctatgggttgactgtgtggagctagtctgggtcacgatactgtcaacatactcaaatgagaagtcggaggcaaggaattccgatggtatgtgcacaccagatacttcgaagaacaactctagatagcaactagagacaccatggaagcagctttgccattacatcgtttcagggttgatgtaaattgtacaagttctgctgcagcagctctgcaggtgtaaccattttcgttcttttatggatatacatgaaacacaaattgtgcagcatgtgccatagacaattagaaagaaattagcttgttccagaactgcagatgaaattgagttggacggaaatgcagtaatcatggacttgtggtcctggaaattttgccggttgcatgcccggactattctgctgctggttatgttcacaaaaaaaaagactattctgctggttatcagtgtacgaacgagatggtggactggtgtacgcacgagtaagtggaagccgtggaagaaagaccaacttgttaaaacttaaagcggcggtcgccacgttggacatacgggatttctaccaaggaagcaagatgagcattgagggtggacaactggggaggtaccatgtttgtttgctttcacttgaaccaagttttcctttaatgggaaaacaaagcgattctgtacaactgaacaagcagaaaaatagaagaagaaaaaaaagagagactctagtgcaagtgcctacacgccattatgtgatggaacaagcagaagagtggggtgggggtgaaggtggagctcttgtacgtgtgtgtgttttggaagaaacaacgccagtatgttatgc

SEQ ID NO: 13523 - protein, 357 aa, Panicum virgatum
  misc_feature: Ceres CLONE 1769767
  misc_feature (269)..(340): Pfam Name: Mpv17_PMP22 Pfam Description: Mpv17 / PMP22 family
MAAAAAAAVATVSSPSPASRRLLPSSSSSAVPSLLRLPRPGRRLRRALRVVSAAGGEADVLPGPGAEAEAAVPGRLEEPLGGSQLNIGGLAFQGDVGGGFASGGGGAGSGASGGGDGNKTLDRGINTAIVLGASTYALTKLLTVDQDYWHGWTIFEILRYMPEHNWSAYEEALKANPVLAKMMISGVVYSLGDWIAQCYEGKPIFDFDRARMFRSGLVGFTLHGSLSHYYYHICEALFPFKDWWVVPAKVAFDQTIWSAIWNSIYFVVLGFLRLESPSTIYKELKSTFWPMLTAGWKLWPFAHLITYGVIPVEQRLLWVDCVELVWVTILSTYSNEKSEARNSDGMCTPDTSKNNSR

SEQ ID NO: 13524 - DNA, 270 bp, Panicum virgatum
  misc_feature: Ceres CLONE 1769770
  misc_feature: Encodes the peptide sequence at SEQ ID NO. 13525
cgcgccctcctcattccgccccctcatccgccgccatgcgcctcctcgctgtgtcaacttgcggacgcgtggccgttcgcaggccgcgggggcggcggcggccgcggccgagtcctgcggcagcccgcttctggaggttctcccccccgccgggggggggaaggagaccgggcatcatatcctcgccggcgtctacctcaccatccgcgagggcgagattcatgcgatgctggggaagaacggctccgggaagaccaccctgtttttttt

SEQ ID NO: 13525 - protein, 89 aa, Panicum virgatum
  misc_feature: Ceres CLONE 1769770
  misc_feature (50)..(87): SWISSPROT Homolog: EC 3.6.3.17 Monosaccharide-transporting ATPase
  misc_feature (61)..(87): SWISSPROT Homolog: EC 3.6.3.25 Sulfate-transporting ATPase
APSSFRPLIRRHAPPRCVNLRTRGRSQAAGAAAAAAESCGSPLLEVLPPAGGGKETGHHILAGVYLTIREGEIHAMLGKNGSGKTTLFF

SEQ ID NO: 13526 - DNA, 429 bp, Panicum virgatum
  misc_feature: Ceres CLONE 1769770-R
tggtaagcgatggccctgtgtacaggtgaggactgacacgaagcagatacagggcatggggcgtgattatatggggtcggccaccagccagatcatggaattgttgaagacgctgagcatggtgggggggcgtttcgggaaggagctgtagaagaaccggaaggtgacggcgggcatgaagccggagtcctgatattccggcggggaggcgggggaccccgccgggtgcagggttgcccacgggaagccttgtggcgcagtaggccacatcattggagtcggcatcgtgctcgggctcaagaacaaccggcgcgctagaccagatcatcgggtacgtccattgtaaaccttgtatcccttgccaccggccggtgcccacgaaaccatgcatataggtttgttccaagggaaagagctggtgggttcttc

SEQ ID NO: 13527 - DNA, 2201 bp, Panicum virgatum
  misc_feature: Ceres CLONE 1769774
  misc_feature: Encodes the peptide sequence at SEQ ID NO. 13528
atccatccgaccacgaccagacctgctccgttctcttctcctcctgacgccggctaacaggctaaccctagcgtcagcggctagcggcggcgcggcaggggccaggcgccaagcggccagctcaactgggcagcggcggtggtctagtggcatgccggccgggtcggggccagcggcggcacgcggcgcggtggcggcctagcaagtagcagcgagcagcagcggcgtgcgacagcgggcaggagcaggacccgcgcttggcagtcttcctcctcttcggcagttcgactcttccttttcctctctcgcgatctcacctctgcgattctgaaaaaatagaggttgagctgctcgattcaatcaataaagaagggtgaaaggctacgtgagctcttgctgcagctagaacaacttacaccagaatcatggcgagccttgccgattcttttctagcggatcttgatgaactgtcagacaatgaaggctatcctgaagaagacaatgctgaggcagctggtatggaggatgacggtgatgatgatatgcctgaccttgagtctcttaattacgatgatctggatagtgtctcaaagttgcagaagacgcaacgctataatgacataatgcaaaaagttgaagatgcacttcagaaaagcactgacttctccaatcaaggttccatcctggaggaggatccagagtaccagcttattgtggactgcaatgctttatcagtagatattgagaatgagataatcataatccataatttcatacgtgacaagtataggttgaagtttcctgaactggagtccctcgttcatcatccgattgattatgcccgtgttgtcaaaaagattggaaatgagatggacttaacacttgtagatctggaagggcttttaccttctgcaattataatggttgtctcagtgacagcatcaacaacaagtggaaagcctctttctgaggaaaatttgaaaaaaacagttgaagcttgtgacagagcccttacgctcgatgccgcaaagaagaaagtgcttgattttgtagagagtagaatgggttacattgcaccgaacctttctgccattgttggcagtgctgttgcctcaaaactgatgggtactgctggtggtctgggagcacttgcaaaaatgcctgcttgtaatgttcagttacttggtgcaaagaggaaaaatcttgctggattttctactgccacatctcagtttcgagttggctatcttgaacaaactgaagtatttcagagcacacctccagctctgaggactagggcttgcaggcttattgctgcaaagtcaactctagcagcaaggattgattcaattagaggtgatccaactggaaaagctggacggaacttattagaagaaattcgtaagaagattgagaagtggcaagaaccacctcctgcaaagcttccaaagccacttcccgttccggactctgaacctaaaaagaagagagggggtcgtcggcttcgtaaaatgaaagaaagatatgcgcaaactgatatgatgaagcttgcaaaccggatgcaatttgggattccagaggagagctctttaggtgatggcttgggggaaggttatggcatgctcggacaggcaggaagtggcaagctgcgtgtctcagctggacaaaacaaacttgctgctaaagtggcgaagaaattcaaggagaagagctatggtagcagcggtgcaacttcaggattgacatctagtttggcatttacaccagttcagggaatagagttgtcaaatccacaggcccaagggaacccgcttggaggtggaactcaaagtacctacttttctgagaccggtacattttcaaagatccggaggacccaatagaagctgatttccccgttgcaaccatctcatctcatctgcactgcagttgttgaaatcgttgggacattgttgaaaaatccaaaaatccagcatgtgaatgtaccaaagtcttgtttttcaattgaagcaaaatccagagattttatgaaacacggcttagttttgcttcaggcaccttttcaagccgggatgtttgcaaaccactagcctgttcaacctattgctagttgagttgatacgtgtcgtacatagtccctgtgaatcccagtttgtattgtacttcttccgtccataaataactgtcgttttcgcttctcg

SEQ ID NO: 13528 - protein, 485 aa, Panicum virgatum
  misc_feature: Ceres CLONE 1769774
  misc_feature (187)..(335): Pfam Name: Nop Pfam Description: Putative snoRNA binding domain
  misc_feature (95)..(147): Pfam Name: NOSIC Pfam Description: NOSIC (NUC001) domain
MASLADSFLADLDELSDNEGYPEEDNAEAAGMEDDGDDDMPDLESLNYDDLDSVSKLQKTQRYNDIMQKVEDALQKSTDFSNQGSILEEDPEYQLIVDCNALSVDIENEIIIIHNFIRDKYRLKFPELESLVHHPIDYARVVKKIGNEMDLTLVDLEGLLPSAIIMVVSVTASTTSGKPLSEENLKKTVEACDRALTLDAAKKKVLDFVESRMGYIAPNLSAIVGSAVASKLMGTAGGLGALAKMPACNVQLLGAKRKNLAGFSTATSQFRVGYLEQTEVFQSTPPALRTRACRLIAAKSTLAARIDSIRGDPTGKAGRNLLEEIRKKIEKWQEPPPAKLPKPLPVPDSEPKKKRGGRRLRKMKERYAQTDMMKLANRMQFGIPEESSLGDGLGEGYGMLGQAGSGKLRVSAGQNKLAAKVAKKFKEKSYGSSGATSGLTSSLAFTPVQGIELSNPQAQGNPLGGGTQSTYFSETGTFSKIRRTQ

SEQ ID NO: 13529 - DNA, 657 bp, Panicum virgatum
  misc_feature: Ceres CLONE 1769776-R
  misc_feature: Encodes the peptide sequence at SEQ ID NO. 13530
taaggaccacagcggatacataacagtagatgagttggaagaagctctgaagaagtatgatatgggagatgataaaacaataaaagagatcattgctgaagtagatacagatcacgatggaagaattaattaccaggagtttgttgccatgatgaggaacaacagccctgagattgttccgaaccggaggcgcatgttctaactgccgtgtacaatttgagtggacacttttggggatattttgcccttagacatcttctcctggagccattttcttttggggaaagccattaagaaaactacatttgagatccatatctctgcagccaggaccagtttgtaccagaatgggacgcatgatattgggactcaaacctagatgctatggagtctgggtgcagtgtttcaactcactgtacgcataatgccttcgagattgttttgcggctttatctgtatctttccccaccttcaatttagtgtgccccaatgaggtgatcagttaaattgcacaattgagagtgttgtgacttgtgatccatgtgctgttatcctcgtagcctttatattagaactggcattgtaagagggtgtttagcgatcttatctggcaatgttgtatcattgttaataaacacagcacacaaatttggtccg

SEQ ID NO: 13530 - protein, 66 aa, Panicum virgatum
  misc_feature: Ceres CLONE 1769776-R
  misc_feature (26)..(54): Pfam Name: efhand Pfam Description: EF hand
  misc_feature: SWISSPROT Homolog: EC 2.7.11.1 Non-specific serine/threonine protein kinase
KDHSGYITVDELEEALKKYDMGDDKTIKEIIAEVDTDHDGRINYQEFVAMMRNNSPEIVPNRRRMF

SEQ ID NO: 13531 - DNA, 158 bp, Panicum virgatum
  misc_feature: Ceres CLONE 1769776
ggacgaccgccccgacgcccaacccgaagacccagccaagaccgccaagacggcgttttttttggggcggggcaaccacgcccgggacgaggacaacccgacggacgagatgttgcaggaggccaacgagatcgaccaacacggacgcgaacaggcgg

SEQ ID NO: 13532 - DNA, 1856 bp, Panicum virgatum
  misc_feature: Ceres CLONE 1769782
  misc_feature: Encodes the peptide sequence at SEQ ID NO. 13533
ccgaccgcttcactgcaagcctcgccgcccctctccctccctccgtcctcctcgcgcggcgaggaggtaggtagccagctaggctaggctaggccggcggccgccatgtcccccgtcaaggccgaggacctggtgccgcaccccgtcaaggagcagttcggcggcgtcgactactgcatcaccagccccccgccatggctgacgacggtgtttgtgggcttccagcactacctggtcatgctcggcacctccgtcctcatcgccaccatcctcgtcccgctcatgggcggcggccatgctgagaaggcgatcgtgatccagaccatcgtcttcctcgccgggatcaacacgctcctgcaggtccacttcggcacgcggctccccgcggtgatggccggctcctacgcctacatctacgcgatcgccgccatcgccgtcagcccgcgatacctgataatcatcgaccctctcgagaggttcgtgttcacgatgaggtcgctccagggctcgctgatcatcgccggcgtctttcaggtcgtcatcggcttcttcggcatctggagagtcttcataaggttcctgagccccctggcggcggcccccttcgtgacgctctcggggctgggcctcttctacttcaccttccccggggtcgctaaatgcatcgaggtgggtctccccgcccttgttctcctggtgctcttcgcagagtacgccgcccatttcttcgtgaaggggagcttcgtgttcgggcggtgcgccgtgctggtgaccatcgtgatcgtgtgggtctacgccgagatcctgacggcggccggcgcctacaacgagaggggccccgtgacgcagttcagctgccgtaccgatcgttccgggatcatccagggctcaccctgggtcaggtttccgtacccgttccagtgggggtacccgattttcttcttccaggattgcttggccatgatggctgctgcttttgtgtcgctggttgagtccaccggtaccttgatcgtggtgtcaagatactcaggcgcaacattctgcccaccttcagtgttctctcgtggaatcggttgggagggcatatccatcatactggacgggatgtgtggtacattgacaggcacagcagcttcagttgagaatgcaggtctgctggcattgacgcgagttggaagccgacgagttataaagatctcagccttgttcatgattttcttctcattgtttgggaaatttggggcacttcttgcatctattccattgccacttttctctgcactgtactgtgtcctctttgcttattcagttggtgcaggcatctccctacttcagtactgcaacctcaacaccctgagaacaaagttcatcctcagcatctccttgttcctgggactgtccattccacagtacttccgagtctatgagatgttctttggcttcgggccagttcacacccattcggttgcgttcaatgtgatagtcaacgtcatcttctcctcgccagcgaccgtggcagccatactcgcctacctcctggactgcacccacctgtactgggaagctagtgtgaggaaggacaggggttggcactggtgggagaagttcaagtcctacaggcatgactctaggagcgaggagttctacgctctgccttatggcctgagcaagtacttcccctcgttttaggatgcagagaggaggaagatgaagttctatgtgattgatggaaagtagaatttgaacattaattcagggcaacaaagccaatgtaatatcccttagcaagcagttgagagggagctagaagttttgcttataaagcattttggatatcgaagtattgtactttccgg

SEQ ID NO: 13533 - protein, 527 aa, Panicum virgatum
  misc_feature: Ceres CLONE 1769782
  misc_feature (32)..(439): Pfam Name: Xan_ur_permease Pfam Description: Permease family
MSPVKAEDLVPHPVKEQFGGVDYCITSPPPWLTTVFVGFQHYLVMLGTSVLIATILVPLMGGGHAEKAIVIQTIVFLAGINTLLQVHFGTRLPAVMAGSYAYIYAIAAIAVSPRYLIIIDPLERFVFTMRSLQGSLIIAGVFQVVIGFFGIWRVFIRFLSPLAAAPFVTLSGLGLFYFTFPGVAKCIEVGLPALVLLVLFAEYAAHFFVKGSFVFGRCAVLVTIVIVWVYAEILTAAGAYNERGPVTQFSCRTDRSGIIQGSPWVRFPYPFQWGYPIFFFQDCLAMMAAAFVSLVESTGTLIVVSRYSGATFCPPSVFSRGIGWEGISIILDGMCGTLTGTAASVENAGLLALTRVGSRRVIKISALFMIFFSLFGKFGALLASIPLPLFSALYCVLFAYSVGAGISLLQYCNLNTLRTKFILSISLFLGLSIPQYFRVYEMFFGFGPVHTHSVAFNVIVNVIFSSPATVAAILAYLLDCTHLYWEASVRKDRGWHWWEKFKSYRHDSRSEEFYALPYGLSKYFPSF

SEQ ID NO: 13534 - DNA, 651 bp, Panicum virgatum
  misc_feature: Ceres CLONE 1769793
  misc_feature: Encodes the peptide sequence at SEQ ID NO. 13535
atcatcacagaggaagagcgagcggcaatcgaaacagcagcaatggcggcctccatgatctcgtcgtcagctctggtggcgccggccagggcccagggcctgccgtccctcggccgccgcgcctcctccttcgccgtcgtccgcggcaccggcaagaagatcaagaccgacaagcccttcgggattggcggtggcctcaccgtccacgtcgatgcctccgggaggaaggtcaagggcaagggcgtgtaccagttcgtcgacaagtacggcgccaacgtcgacggatacagcccaatctacaaagaggaggactggtctcctttttgtgacgtctacgtcggtggaaccactggacttctgatctgggccgtcttttttttttcccccccccggaggcggtgccctccttgtttacaacaccagcgctctcgccagctaagaacactattcatgcacagtccatgcaagcacttgcggttcatgtaagatcagcttgggggtgtctgtctgtaatctagcctgcagctttgatgtccaatataatgcttggttcatgtaacaatgctactacggctctccatacttttgggacagttattatattaattacttgatgctacatatttagattaatatataactgataacttt

SEQ ID NO: 13535 - protein, 147 aa, Panicum virgatum
  misc_feature: Ceres CLONE 1769793
  misc_feature (35)..(134): Pfam Name: PsbR Pfam Description: Photosystem II 10 kDa polypeptide PsbR
MAASMISSSALVAPARAQGLPSLGRRASSFAVVRGTGKKIKTDKPFGIGGGLTVHVDASGRKVKGKGVYQFVDKYGANVDGYSPIYKEEDWSPFCDVYVGGTTGLLIWAVFFFSPPRRRCPPCLQHQRSRQLRTLFMHSPCKHLRFM

SEQ ID NO: 13536 - DNA, 1679 bp, Panicum virgatum
  misc_feature: Ceres CLONE 1769798
  misc_feature: Encodes the peptide sequence at SEQ ID NO. 13537
aactcttttttttttttggggaacgtgaaggcctcaactctgaacttctcaaggagaagagcaagaaaccaagaagatggccgccgtccccgccgccgcaggcgccccgccccccgtcccggacggcgtctcctcctgcgggagcaccaacgtgcgccgcgccgaccacctccccccgcttccgatcccgctcccctgcatcggcgagcccaccgcggcctcccgcgtctcgccgggctcctccccggcccgctccgaggcctcgcggggcgccccctgctacgccgccgatgcggagccggatccggtgccccaggtcgaggcctccgtggggcggagcacgcagatgctgctcgccatggccgccatgggcgggcgcggcgggcactacggccgccgcccggcctcgtcctacggcagctgcgccgcgtggagcgccggctcgctcaccaagcaccgccccgcgtcgccgtccccgatctgcagccccgtgagcagccgcggcggcggcggggacgaccgcgagccccacggcgcagacgacgacgcctcgttcgtcacgccacagatggaagaagagcaagggaggttgccaaccagagcagatttcatgaaaccttctgctacaccacgaaacatcagaatacagacacccaggctggataggagagttgatgggactaatcaagtgcctccaagattcatccacaaggccacaccagcgagattgatgcgccgagttcgctcctcacataacttccgtcagcgtgtgggtgcaatagatgctatcaatgaatggagattgcccaaagtcagtgaaggggaggacgaaggaggcgatcaaaaggaatggcagactgagactgtgtcgtctcgtatatcctcagctcgtgattggaattttgagtctgatggtgcttttgagggtggcaaccatagtgatcgttcatttggcgattcagacggtgagaactgtccagttccagtgccaaggatggagagatggctcccggcctctgggttaaaatcccaaggcaattttgtccatgccaagttggttgcctggaaggatgcacaggttgcaaacctcatagaaaagctgaaaaggaaagaaaccgatattgacgattggcagaggaacaagatcgcaaaggccaggcagaagatgagaaatactgagttgatcttggagaagaagagagcggaagcgggagagaagatgcaaaaggagataaagcgtgcgcaaaggaaagctgataagaagaaagtcaaggagcaggcagccactaccaatcagatcgctggtgttgagagagcactggtgaagatgtcaaggacaggaaagctcccctggtcactggcttttctgtgatctagctcttcgtttctgcctgtcccagagaagctggtttgccaaaccgtgaaagctattggtgatgcccgcgtggcaagagcaatatgagtgaaatcagctgctaaatacttgaaattagtatatggcgtattaagaaaaaaacaagtgcatatatctgtgattaccccattcttgatgatggaagttttgaacatgacatgaacaactttcttgtacgttgaacgataacatatgcttgactcctgtaaattggaaattttgctgtgtgtgttgtattagtgtacagcagcacttcggctttatg

SEQ ID NO: 13537 - protein, 337 aa, Panicum virgatum
  misc_feature: Ceres CLONE 1769798
  misc_feature (224)..(335): Pfam Name: Remorin_C Pfam Description: Remorin, C-terminal region
MAAMGGRGGHYGRRPASSYGSCAAWSAGSLTKHRPASPSPICSPVSSRGGGGDDREPHGADDDASFVTPQMEEEQGRLPTRADFMKPSATPRNIRIQTPRLDRRVDGTNQVPPRFIHKATPARLMRRVRSSHNFRQRVGAIDAINEWRLPKVSEGEDEGGDQKEWQTETVSSRISSARDWNFESDGAFEGGNHSDRSFGDSDGENCPVPVPRMERWLPASGLKSQGNFVHAKLVAWKDAQVANLIEKLKRKETDIDDWQRNKIAKARQKMRNTELILEKKRAEAGEKMQKEIKRAQRKADKKKVKEQAATTNQIAGVERALVKMSRTGKLPWSLAFL

SEQ ID NO: 13538 - DNA, 884 bp, Panicum virgatum
  misc_feature: Ceres CLONE 1769823
  misc_feature: Encodes the peptide sequence at SEQ ID NO. 13539
aacacgccgcaacgccgcttcccctcaccagtcaccaacgcgcctccaatcccgttcctctcttgcctagggttctagccctctcgccgccgccctccggcgccgaccatgacggccgagaccgcgacgccggaggagcagctccgcgcccagctcgaggagcagctccgcgcccagctcgaggagcagaagatccacgagggagatgacccgattgttgaggatgacgatgatgaggaagatgacgatgatgaggatgacaaggatgacgatgatgctgagggagttgatgctagtgggagatctaagcagagccgcagtgagaaaaagagcaggaaagccatgctgaagcttggcatgaaggcgatcactggtgtaagccgtgtaactgtcaagaaaagcaagaatatgctctttgtcatctccaaaccagatgtcttcaagagccctgcatcagacacctacgtaatctttggggaggccaagattgaggacctgagctcacagctgcagacacaggctgcagagcagttcaaggcaccagacatgagcagcgtcctgtcaaagccagaggtctccacagcggcccaggatgacgatgaagctgtcgatgagactggtgtggaggagaaggacattgagttggtgatgacccaggctaccgtgtcgagggctagggcggtgaaggcgctgaaggcggccgatggggacatagttagtgcaatcatggagctgacaacttagctggtcgtgcgcctacttgtgatatcatgtcagttttatcttgtttaatggatctatgatctgagacacatgttgtcacgttgtgctgttttgcatgttgtgtgattggaaacaaatggaaaacacatgttttgaaagct

SEQ ID NO: 13539 - protein, 211 aa, Panicum virgatum
  misc_feature: Ceres CLONE 1769823
  misc_feature (70)..(129): Pfam Name: NAC Pfam Description: NAC domain
  misc_feature (172)..(209): Pfam Name: UBA Pfam Description: UBA/TS-N domain
MTAETATPEEQLRAQLEEQLRAQLEEQKIHEGDDPIVEDDDDEEDDDDEDDKDDDDAEGVDASGRSKQSRSEKKSRKAMLKLGMKAITGVSRVTVKKSKNMLFVISKPDVFKSPASDTYVIFGEAKIEDLSSQLQTQAAEQFKAPDMSSVLSKPEVSTAAQDDDEAVDETGVEEKDIELVMTQATVSRARAVKALKAADGDIVSAIMELTT

SEQ ID NO: 13540 - DNA, 755 bp, Panicum virgatum
  misc_feature: Ceres CLONE 1769827
  misc_feature: Encodes the peptide sequence at SEQ ID NO. 13541
atccacagagatcaggttgtcttacagttacagttgcagataccccctcaaggaacgttcgaaattctgaacgggtcctcgtccgacaacctgcgatgagcgctgccgtgcccgtgcccgcgccgccgccggtggatcccgccacggcgggggagatggcgcgggaggccgccgcgtggtgcgcgctgcacggcctcgtcgtcggggaccgcgccgacccgagatcagcaacagtccctggcgttggtttggttcatgctccattctccctgctcccagcacatcttcccgaatccatttggaggcaggcgtgtgagttggctaccatatttaacgagcttgtggatcgtgttagcctcgatgggaagttcttgcaagattctttgtccaaaacaaggcaggttgatgatttcacatctagactcttagagattcacaggaaaatgatggaaataaataaggaggagaatattcgcttagggttgcaccgatcagattatatgctggatttagaaacaaattctcttcttcaaatagagctcaacaccatttcaacatcctttcctgggcttggatccttagtaagtgatcttcacaggagcttaattaatcagtatgtacatctattaagtctggaaccaaagagggttcctggaaatgcggctagcagtaaatttgctgaagcattggccagagcatgggctgagttcaatgttgacagtgctgtagttatgatgattgttcagcctgaagaa

SEQ ID NO: 13541 - protein, 219 aa, Panicum virgatum
  misc_feature: Ceres CLONE 1769827
  misc_feature (8)..(219): Pfam Name: GSH_synth_ATP Pfam Description: Eukaryotic glutathione synthase, ATP binding domain
  misc_feature: SWISSPROT Homolog: EC 6.3.2.3 Glutathione synthase
MSAAVPVPAPPPVDPATAGEMAREAAAWCALHGLVVGDRADPRSATVPGVGLVHAPFSLLPAHLPESIWRQACELATIFNELVDRVSLDGKFLQDSLSKTRQVDDFTSRLLEIHRKMMEINKEENIRLGLHRSDYMLDLETNSLLQIELNTISTSFPGLGSLVSDLHRSLINQYVHLLSLEPKRVPGNAASSKFAEALARAWAEFNVDSAVVMMIVQPE

SEQ ID NO: 13542 - DNA, 667 bp, Panicum virgatum
  misc_feature: Ceres CLONE 1769827-R
  misc_feature: Encodes the peptide sequence at SEQ ID NO. 13543
aaactgcaattgaaaagcctgagttatttgtgttgaagcctcaacgtgaaggcggagggaacaatatttatggccttgatttgagagagacacttaccagactccagaaggaaggaggggatgcacttgcagcgtacatacttatgcaaagaatcttcccaaaagcttctcttgcttatctagttcgtggtggtatttgccatgagggtcttgtgatttcggagcttggaatatatggtgcttacttgcggaacaaagataaggtagtaatcaatgagcaaagtggctacttgatgcggacgaaagtttcttcatcagatgaaggcggcgtcgctgcagggtttgctgttttggatagcttatacctgactgacaagtgaggtaacgaaaggagcctcagctacagctttcagcaagcttacatcgacaactgattcaacatcatgttctccattaaacaatgccggagaagctgctgcaggctacagccatatctcatctcgtttgatgatttcctactgcccgttcctagggagagaataagtgtattatgtgtggcttgcatgtacatgaaatccatgaaaacaatgatgaacaatcatgttatatgtagatcatgccaatgacctgcgcaggataatctcagccgcttgctcggcccattgcc

SEQ ID NO: 13543 - protein, 125 aa, Panicum virgatum
  misc_feature: Ceres CLONE 1769827-R
  misc_feature (1)..(123): Pfam Name: GSH_synth_ATP Pfam Description: Eukaryotic glutathione synthase, ATP binding domain
  misc_feature: SWISSPROT Homolog: EC 6.3.2.3 Glutathione synthase
TAIEKPELFVLKPQREGGGNNIYGLDLRETLTRLQKEGGDALAAYILMQRIFPKASLAYLVRGGICHEGLVISELGIYGAYLRNKDKVVINEQSGYLMRTKVSSSDEGGVAAGFAVLDSLYLTDK

SEQ ID NO: 13544 - DNA, 832 bp, Panicum virgatum
  misc_feature: Ceres CLONE 1769852
  misc_feature: Encodes the peptide sequence at SEQ ID NO. 13545
gctgctttcgccgcatccctcctcctcctctcgatctgattcggagcgagatcaacagcaagccaagatgcattcgacgaatctcctgctcgaggagcccatccgcatggcctcaatcctcgagccatccaagaccagcttcttcccggcgatgacgaagatcgttgggacgctcgggcccaagtcgcgctccgtcgacaccatctctgcctgcctcaaggccggcatgtccgttgcgcggttcgatttctcgtggggagacgccgcctaccaccaggagacgctcgagaacctcaagctcgccatcaaggccaccaagaagctatgcgccgtcatgcttgatactgtcggccccgagttgcaggtggtgaacaagaatgaaacaccaatttcccttgaggagaatggcactgttattctcacacctcatcaggggcaagaagcctcctccagcttgctgcccatcaacttctccggactcgccaaggctgtgacaccgggcgcaacaatatttgtggggcaatacttgttcaccggcagtgagactacttcagtttggttggaggtttctgaagttcaaggagatgatgtggtctgtataatcaagaacacagctacattggctgggtcactgttcacactgcattgctcccagattcatattgacttgccaacgctatctgatgaggataaggatgttatcagaaaatggggtgctccaaataagattgactttctctctttgtcttacacaaggcatgctgaagatgtgcggcaggcacgggagttcctctcaaaattgggcgatctcagccaaactcagatttttgcc

SEQ ID NO: 13545 - protein, 254 aa, Panicum virgatum
  misc_feature: Ceres CLONE 1769852
  misc_feature (30)..(254): Pfam Name: PK Pfam Description: Pyruvate kinase, barrel domain
  misc_feature: SWISSPROT Homolog: EC 2.7.1.40 Pyruvate kinase
MHSTNLLLEEPIRMASILEPSKTSFFPAMTKIVGTLGPKSRSVDTISACLKAGMSVARFDFSWGDAAYHQETLENLKLAIKATKKLCAVMLDTVGPELQVVNKNETPISLEENGTVILTPHQGQEASSSLLPINFSGLAKAVTPGATIFVGQYLFTGSETTSVWLEVSEVQGDDVVCIIKNTATLAGSLFTLHCSQIHIDLPTLSDEDKDVIRKWGAPNKIDFLSLSYTRHAEDVRQAREFLSKLGDLSQTQIF

SEQ ID NO: 13546 - DNA, 815 bp, Panicum virgatum
  misc_feature: Ceres CLONE 1769854
  misc_feature: Encodes the peptide sequence at SEQ ID NO. 13547
actccgaaccctaaccaagtcagatctccgcctccgccgccgccggcgagagcaccgaatcagatccgccgcgatggcgttccgccgcatcctatccagcgcggtgcgccgccgctcggccatcgccgcggcggccgggaacgcgcgcgaggcctccacggccgtcgctgcgggccctggggtcctcgctcccgacgcgaccccggtgcgtgcccccgtgatgccgtacgaccgcatcgcagaggccgtgaacgccaggctccggcggctcgagcacccggacccgcgcttcctccgctacgccaatcccgtgccgacccacgccgaccatactgccatcctcgcggcgccggagacccgcgtcaccacgctgcccaacagccttcgcgtcgccacggagtcgtccctcgccgcgcgcacagccacagtcggcgtctggatcgacgcgggcagcaggtacgagaacgaggaggcggccggcgtcgcgcatttcgtcgagcacatgctgttcaagggcacgggcaagcgcagcgcggcgcagctggagaaggagatcgaggacatgggtggccaccttaatgcctacacgtctcgggagcagacaacctactacgcgaaggtgcttgacaaggacgtatctcgtgcgatggaggtcctcgctgacatcttgcagaactctaatctcgatgaggaccgcattgaacgtgagcgcgaagtgatcttaagagagatggaagaggttgagggacaatccgaggaagttatatttgatcatctccatgcaactgcattccagtatacatcccttggcagac

SEQ ID NO: 13547 - protein, 247 aa, Panicum virgatum
  misc_feature: Ceres CLONE 1769854
  misc_feature (105)..(247): Pfam Name: Peptidase_M16 Pfam Description: Insulinase (Peptidase family M16)
  misc_feature: SWISSPROT Homolog: EC 3.4.24.64 Mitochondrial processing peptidase
MAFRRILSSAVRRRSAIAAAAGNAREASTAVAAGPGVLAPDATPVRAPVMPYDRIAEAVNARLRRLEHPDPRFLRYANPVPTHADHTAILAAPETRVTTLPNSLRVATESSLAARTATVGVWIDAGSRYENEEAAGVAHFVEHMLFKGTGKRSAAQLEKEIEDMGGHLNAYTSREQTTYYAKVLDKDVSRAMEVLADILQNSNLDEDRIEREREVILREMEEVEGQSEEVIFDHLHATAFQYTSLGR

SEQ ID NO: 13548 - DNA, 1404 bp, Panicum virgatum
  misc_feature: Ceres CLONE 1769855
  misc_feature: Encodes the peptide sequence at SEQ ID NO. 13549
acgtagtaacacccgatttgtgctgccccttcaaaagccgccggcccaccggcgacacggacggaagacgacactaccgcaccactccaccgcgccggagccgggaaggcagcaggaggaagaaagggcggccggcaccagcagccaacccactgccacgccgcgccggcggacgacggagatgaagaagtgcccgtcggagctgcagctggaggcgttcatccgggaaagcggcgccggcgccgcggagagcaagcccggaagcggaccgagcgagcccggcgggagcggcgtgttttcacccggcggcgtcggcttcggcgactcgaacaccatggatggaagcagttggtggtacgggagcatccgccccgcgaacccagtcgcgtcgcagacggcctccgtctccgctagccccagagcaaccaccccagcgaaccatactcttgaaagcgagtcagactccgacagcgaatcattgtatgaggtagaaggaggttcatgtgagcgaggcaccaaatctatggaaacaaagcgaataaggaggatggtgtccaacagggagtctgctcgacgatccaggcggagaaagcaggcacaattatctgaactcgagtcacaggtcgaacaacttaaaggtgaaaatgcaactctgttcaagcaactttcagaggccaaccagcagttcaccacagcagtcacggacaacagaatcctcaaatcggatgtagaagccttaagagtcaaggtaagtagtttgcctcgcccaaaaatcagttgccacaacaattgaatgatcacacggaactttcaactgtctaaccaaacgcttgaattgcaggtaaagatggcagaagatatggtagcgagaagcgcaatgtcctgcggcctaggtgaccttggtctggcaccatatctgaattcaagaaagttgggccaagctttgaatatgctcacagtcacaggattggatttgctagggagtgaggcattcagaggtccaacggcagctcggcaggttcagaactcaccagtacaaagcactgcaagcctagagagtctggataacaggaagtccagcgaggtgaccagctgtgcggcagacatgtggccttgagattcaggacactgatcagattcaaagcttgctaggcagaaaccgcaccagctcattacctcaaacaattggtgcctctggagcatagcttctgccaagtttccttgaaccatatttctacagaaggctttacacgatcactatgcatcgatcatttgatgtggttatctgatacttctccagtgggaaagataccatttacagaagttgtcatggcaagcagggaatgtggcaaacctcaagtatagtttcaagcataaaatgaccttgtctttgtacaaatctgc

SEQ ID NO: 13549 - protein, 203 aa, Panicum virgatum
  misc_feature: Ceres CLONE 1769855
  misc_feature (114)..(174): Pfam Name: bZIP_1 Pfam Description: bZIP transcription factor
MKKCPSELQLEAFIRESGAGAAESKPGSGPSEPGGSGVFSPGGVGFGDSNTMDGSSWWYGSIRPANPVASQTASVSASPRATTPANHTLESESDSDSESLYEVEGGSCERGTKSMETKRIRRMVSNRESARRSRRRKQAQLSELESQVEQLKGENATLFKQLSEANQQFTTAVTDNRILKSDVEALRVKVSSLPRPKISCHNN

SEQ ID NO: 13550 - DNA, 838 bp, Panicum virgatum
  misc_feature: Ceres CLONE 1769857
  misc_feature: Encodes the peptide sequence at SEQ ID NO. 13551
ctagtctccatccccccatccgccgcccctcaaccctacccagccgccgccgccgccgccgccgcgcggaggcgaccccctaccgccgccaagatgcagatcttcgtgaagaccctgacggggaagaccatcacgttggaggtggagtcctcggacaccatcgacaacgtgaaggccaagatccaggacaaggagggcatccccccggaccagcagcggctcatcttcgccggcaagcagctcgaggacggccgcaccctcgccgactacaacatccagaaggagtccaccctccacctggtgctccgcctccgcggtggcgccaagaagcgcaagaagaagacctacaccaagcccaagaagatcaagcacaagcataagaaggtgaagctcgccgtcctgcagttctacaaggtcgacgacgccactggcaaggtcacccgcctccgcaaggagtgccccaacgccgactgcggcgcgggtaccttcatggccaaccacttcgaccgccactactgcggcaagtgcggcctcacctacgtctacaaccagaagacataatcgcttgcatcgctttgcttagcattacccgcctacctatcatgaaattgagctgttggtttctcgagttggatatcatttagatctgtctgaggttggggcgcaggaaaaaaaaatcatctccaatctccaaccaaactaaccctagcagcagccggcggttagggtttcgagcgagatggcggcggcggcgaggcagcgcgggacggggaagtggttcaacgacaccaagggcttcggcttcacctcccccgaggacggcagcgaggacctcttc

SEQ ID NO: 13551 - protein, 155 aa, Panicum virgatum
  misc_feature: Ceres CLONE 1769857
  misc_feature (6)..(74): Pfam Name: ubiquitin Pfam Description: Ubiquitin family
  misc_feature (101)..(148): Pfam Name: Ribosomal_S27 Pfam Description: Ribosomal protein S27a
  misc_feature: Useful for making plants with modulated cold sensitivity
  misc_feature: Useful for making plants with modulated flowering time
  misc_feature: Useful for making plants with modulated nitrogen use efficiency
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNADCGAGTFMANHFDRHYCGKCGLTYVYNQKT

SEQ ID NO: 13552 - DNA, 675 bp, Panicum virgatum
  misc_feature: Ceres CLONE 1769857-R
  misc_feature: Encodes the peptide sequence at SEQ ID NO. 13553
cgccgacggaggcggcggatacggcgggggaggctacggtggccgtcgcccaatgcggttccaaggtctcgagaggcgtcgccgtcagggcgacgtccagcggcgagggcgcgacggaggacgtgccggagatcgtcaaggctgcccaggacgcgtgggacaaagttgaggacaagtacgccgtggccaccatcggcgtcgccgccatcgtcgcgctctggacagcggcaggagctctcaaggccatcgagaagcttcctctcctgcccggtgtccttgagattgttggaatcggctatactgggtggttcacataccgcaacctcgtcttccagccggacagggaagctcttatcagcaaggtcaagagcacttacaaggagatcaccgggagcagcagctgatcaagcatcatttactagatggatcgttctgtaatcagatgctagaattgcatctgcaagcactgagctgccatgcaagtgaaagtgctaacatttgagactggatcctgtaccgtttctagtcctctgactaagtcactaagtcagagagaaacctctgctgatgagctagtctttttgcttattttgtaatatttataacatatttccagttcctttgcagactactgcacattctgaagtctgaagcatttgtgtgggattaaagcgg

SEQ ID NO: 13553 - protein, 133 aa, Panicum virgatum
  misc_feature: Ceres CLONE 1769857-R
  misc_feature: SWISSPROT Homolog: EC 6.1.1.9 Valine--tRNA ligase
PTEAADTAGEATVAVAQCGSKVSRGVAVRATSSGEGATEDVPEIVKAAQDAWDKVEDKYAVATIGVAAIVALWTAAGALKAIEKLPLLPGVLEIVGIGYTGWFTYRNLVFQPDREALISKVKSTYKEITGSSS

SEQ ID NO: 13554 - DNA, 1929 bp, Panicum virgatum
  misc_feature: Ceres CLONE 1769858
  misc_feature: Encodes the peptide sequence at SEQ ID NO. 13555
aacagagccacgcttatatcaccagctgtccggctcgctccccgcaccaccccacctccccgccgactcctgccaccgcccgctggcatagcgcgtaggccgcgagaggagctccggcgggcggcaggcagcgagggatctcggcgcgcgcgcgtttgcagcgcaggcggcatgaagctcccgctgtggccggggctggcgcccgcggcggggccgcccgacgcggcgccggagccggccaagccgtcgctgccggccgcgtggctgctgctgcacgcgctcttctgcgccacctccatggccgtcgggttccgcttctcgcgcctcatcgtctacctcctcttcctcccgacgccgcccatcaacccggccgcgcagctcgtctcgctcgtgtccccgcccgtcatgctcgccgccggcaacgccacggccacgatcaccaccaccacgacgaccaccaccaccgtcaccaccaccaccacggtcgccgccgagatcgggccccaccagcaccagcaccgccaccacggccccgtcttcgtggggcgccacccgatccgcgtccgctcctggccgcacccggaccccaacgagctgctcaaggcccaccgcatcctcgccgccgtccagaacgcgcagcgcagcagcaagcgccgcggcgcggggccgcccaggcccgtcattgccgtcaccccgaccaccacctccgtgctccaggtaccgtccctgacgtccctggcgcacacgctccgactcgtcgacgcccagctcatgtggatcgtcgtcgagccggggcaccgcaccgacgctgtcgccgccgtgctctcccgctccaacctcgacttcctccacatcaccggccccggcgactccaccgcgtccctgcgattgcacgccctcagggagattcgggcgaatcgaatggatgggatcgtggtgttcgccgacgagaacagcaccctccggacggagctgttcgacgaggcgcagaaggtgagcaccgtaggcgccgtgcccgtcggcatcctgggcgacgacgacggcaccagcgagtcgttcctccaggcgccgtcgtgcgacgccgcggggaagctggtgggctaccgcgtgtcggaggagaccgtgctgccggcgaaccgaggcgacatgctgctgtccagcaggctggagtgggccggcttcgtggtgaacgcgcgcgcgctgtgggacgacgccaaggagcggcccgagtgggtgcgcgatctcagcgccatcgacgacgccgacgcccgcgccgccagcccgctcgcgctcgtcaccgaccccggccgcgtcgagccgctcgccagctgcgcccaggcggcgctcgcgtggtcgctccggtcagacagcctccacgaggtcaaattcccacacgaatggaaattcgatcctcctcagctgagtacaggttccaatgagcagagtgtcaaaccagagacgaagcaaacaactctagcgagcattgaagatcagcactagaggtcaattttttgtggacagtagaagtcagagcaaatcaggcagctattgctcccaggatttgtcaaaagtctccagttccccactgatgcatccgtcgatgcaccgtcggtgccaaccgctgccaaagtaacagaagccagctcagatcagcgcagctcatttctttggactctacagataaagtcaccatcagtacatgtaacttggacccttgttcatctaaatcactctgtatgaatgtatacaaatagataaatgtttaattatctgtaccttcaatcctcttcatgtagaatagcattttaggcatattgttttcatgtaaaatagatcagagcagggacttgcagaaagtcttgtggtttgggcatgaaagcattggttgtacactcgtatgaaataatgatgatccagttttcactctag

SEQ ID NO: 13555 - protein, 442 aa, Panicum virgatum
  misc_feature: Ceres CLONE 1769858
  misc_feature (189)..(400): Pfam Name: Glyco_transf_43 Pfam Description: Glycosyltransferase family 43
  misc_feature: SWISSPROT Homolog: EC 2.4.1.135 Galactosylgalactosylxylosylprotein 3-beta-glucuronosyltransferase
  misc_feature: Useful for making plants with altered carbohydrate content
MKLPLWPGLAPAAGPPDAAPEPAKPSLPAAWLLLHALFCATSMAVGFRFSRLIVYLLFLPTPPINPAAQLVSLVSPPVMLAAGNATATITTTTTTTTTVTTTTTVAAEIGPHQHQHRHHGPVFVGRHPIRVRSWPHPDPNELLKAHRILAAVQNAQRSSKRRGAGPPRPVIAVTPTTTSVLQVPSLTSLAHTLRLVDAQLMWIVVEPGHRTDAVAAVLSRSNLDFLHITGPGDSTASLRLHALREIRANRMDGIVVFADENSTLRTELFDEAQKVSTVGAVPVGILGDDDGTSESFLQAPSCDAAGKLVGYRVSEETVLPANRGDMLLSSRLEWAGFVVNARALWDDAKERPEWVRDLSAIDDADARAASPLALVTDPGRVEPLASCAQAALAWSLRSDSLHEVKFPHEWKFDPPQLSTGSNEQSVKPETKQTTLASIEDQH

SEQ ID NO: 13556 - DNA, 677 bp, Panicum virgatum
  misc_feature: Ceres CLONE 1769859-R
  misc_feature: Encodes the peptide sequence at SEQ ID NO. 13557
tccccgcccaggaagagagggtggaccggcctcgtcgagaaggacaccgccagccagaccaacatctactccgtcgagccgacggtgtacgtggcggagagtgccatcagctccggcacggcgggcacgtcggcggagggggccgagaacacggctgccatcgcggcggggctcgtcctcatcaccgtcgccgcggcgtcgagcatcctcatccaggtgagcaagcagcagccgcaggtgcccgaggccgcctacagcggcccgccgctcagctactacgtcgccaagttccagcctgcggtggaagcgccggcgccggcggagcccctcgaggcccccgcccccgcggaggcggtcgtcgcccaggacacccccgccatcgaggcttctgcgccggcaccggaggctgatctgctgtcctcgtgagctcgtgttgtagtcaagattcagttttcgtggcagcttacacacatgagcttgtagtgaaggatacggtgggagagaatacagatggtcctcgtgagcatttccgaattgtaaaactttcgtgcatgtatatatatacagtgcatcagcatggctatatgcttgtatgaaaccccacgacactcgcacaaaccaagcatattgttcagctgtagctgtaacacaatgaacatacctaattttccaattcg

SEQ ID NO: 13557 - protein, 141 aa, Panicum virgatum
  misc_feature: Ceres CLONE 1769859-R
  misc_feature: Useful for making plants with modulated flowering time
SPPRKRGWTGLVEKDTASQTNIYSVEPTVYVAESAISSGTAGTSAEGAENTAAIAAGLVLITVAAASSILIQVSKQQPQVPEAAYSGPPLSYYVAKFQPAVEAPAPAEPLEAPAPAEAVVAQDTPAIEASAPAPEADLLSS

SEQ ID NO: 13558 - DNA, 600 bp, Panicum virgatum
  misc_feature: Ceres CLONE 1769859
cgcccccggcggcgccgccggagcgcggcgaccccggccgcccccccccgccgcgccagaacggggggaacccccacgcccccccgggccccgacccagacccgcccgacccagccaggagcgcgcggcggccgcggccgggggagcccgccgcgcccgccccgccccgccccgccaaggacgacgaggccaggaacgctttttttccggcgcacctcgccggcgcgcgccgcgaccacgccgcgctcaggaggctcgtcacggggctcccgcgcctgccgcgcgccggcgaggtcgccaccgagcaggagtccatcgcgggggaggccgtcgccgacgccgtctccgccgtcatcgaccgccgcgacgtgccaaggagggagaccccgctccacctcgccgtgcgcctccgcgaccccgtcgccgcagacatcctcatgtccgcgggcgctgactggtcgctccagaacgccgacggctggtccgcgctccaggaggccgtctgcacccgcgaggaggccatcgccaccatcatcgcgcgccactaccagccgctcgcatgggccaaatggtgccgccgcctcccgcgcatccccgcct

SEQ ID NO: 13559 - DNA, 1589 bp, Panicum virgatum
  misc_feature: Ceres CLONE 1769872
  misc_feature: Encodes the peptide sequence at SEQ ID NO. 13560
aaagcggaggcgaaagcgaaggggagtgggagggcagcggtcggctggtcgggccggcggcgacggtgacgcctcgctcgctgcggccctacgcattccgcgcaggtgctagctgttgaactcgcacccaaaaaaaaaaagagctatcatggggatttcagctaagtggataaaatcacttgttgggctaagaaagcatgaaaaggggcgaaacgctgaaagcagcgccgggaggagctctggtgcccagttgctacacacacaggatcattctgtagatacagaaggtgctcttgcagctgaagaactcagagtacaagctgaaccattggctgctgaagcaaacacagagacaatatcaaattccccttcctcaccaagcacatcttttcaagtttctcagactgaacatggtacaaaggagtaccaggctgctgtggttattcagtccacctttcgagcattcctggcaaggcgtgctttacgagcgttaaaagggctagttagactccaggcacttgtaagaggtcatgctgtaagaaagcaagcagcagaaacacttcagtgcatgcaagcgctggtgagagctcaaactcgtgtgagagcaagacgagtccgtgtttctttggaaagccaagggacccaaaagaaacctcctgaaaagaatgctcatgaggaccatgttcgagatattgaggaagactggtgtggtagtataggttcagtagaagaaattaaagctaaggcgttaaaaaggcaagaagctgcagctaagcgggaaagggcgatggcttatgctttaacccatcagtggcaaacaggttcgaggaaacagaaagcagcgagcctccaagaccaaggacttgcaggggacgaaaatcagtgggggcgaaactggttagaaaggtggatggctgcacgcccatgggagaacaggttacttgacagtaatgccaaagaaagtgtcacagttggtgatgacaaacctgctgaggaagacaaggctaaagctctgaacaaaccgaagggaaaagtacctgtttcaaccacacaatcaaatggatcgcggcagaagaaagtcacaggccacaagaagtcacattctgatgtaagtggctcttcatcggggcagtctgcaagtgtgcaaccaactgcttctttggagtcatccaagatcaaagagaagccatcagatgaaatcactgatgaagtcagctctcaaccttcgaaattggcttcccgatccacgagcaatccaaaagaaaggccagcacaaatcaatgcaccagcgaagaagcgattatcccttcctaacaatgcaacagccaacgggggtgtaggaaagcgccatgccaacagtagccggacaacccaggccacgagatcgaagaatgcagtgaaaggagcctccaaatctgaatcaagagagcagtcgaagccttctagcacaaccgtgaagccagttgaggcacaagcctgagaccaaaccactcccatttcattcagaccattggtgatgcccctttgtcatgcgtgctgctggaatatttttttatttttaatcttttttttaataatattttaagttt

SEQ ID NO: 13560 - protein, 443 aa, Panicum virgatum
  misc_feature: Ceres CLONE 1769872
  misc_feature (93)..(113): Pfam Name: IQ Pfam Description: IQ calmodulin-binding motif
MGISAKWIKSLVGLRKHEKGRNAESSAGRSSGAQLLHTQDHSVDTEGALAAEELRVQAEPLAAEANTETISNSPSSPSTSFQVSQTEHGTKEYQAAVVIQSTFRAFLARRALRALKGLVRLQALVRGHAVRKQAAETLQCMQALVRAQTRVRARRVRVSLESQGTQKKPPEKNAHEDHVRDIEEDWCGSIGSVEEIKAKALKRQEAAAKRERAMAYALTHQWQTGSRKQKAASLQDQGLAGDENQWGRNWLERWMAARPWENRLLDSNAKESVTVGDDKPAEEDKAKALNKPKGKVPVSTTQSNGSRQKKVTGHKKSHSDVSGSSSGQSASVQPTASLESSKIKEKPSDEITDEVSSQPSKLASRSTSNPKERPAQINAPAKKRLSLPNNATANGGVGKRHANSSRTTQATRSKNAVKGASKSESREQSKPSSTTVKPVEAQA

SEQ ID NO: 13561 - DNA, 815 bp, Panicum virgatum
  misc_feature: Ceres CLONE 1769879
  misc_feature: Encodes the peptide sequence at SEQ ID NO. 13562
accgccgcacctcgtcatctgctttgcagtcgtggtgctcggtgttgaacgatgcgcggctgcaagacgggtatgaggatgctgcccatgctgctgctggtgctcgctgccggcgcggcggcgtcgcactcgtcgtgcccggcgacgccgccggactcgggggccacgctgcaggtgtcgcacgcgttcgggccgtgctcgccgctggggcccggggcggcgtccccgtcgggggcggggttcctcgcggaccaggcggcgcgcgacgcgtcgcggctgctgtacctggactcgctggccgtccggggccgcgcgtacgcgcccatcgcgtcggggcggcagctgctgcagacgcccacctacgtggtgcgcgcccggctcggcacgccggcgcagcagctcctgctcgccgtcgacactagcaacgacgccgcgtggatcccctgcgccggctgcacgggctgccccacctccacgcccttcaacccggccgcctccacctcgtaccgcccggtggcctgcggctcaccgctgtgtgcgcaggcgcccaacgcggcatcgtgcccgcccaacagcaaggcctgcggcttcagcctcacctacgcggactcctcgctggtggcggcgctgtcgcaggactccctcgccgtcgccaacgacgtcgtcaagacctacaccttcggctgcctgcagcgggccaccggcacggccgcgccgccgcaggggctcctcgggctcggccgcgggccgctgtccttcctgtcccagaccaaggacatgtacgaggccaccctctcgtactgcctcccgagctt

SEQ ID NO: 13562 - protein, 254 aa, Panicum virgatum
  misc_feature: Ceres CLONE 1769879
  misc_feature: SWISSPROT Homolog: EC 3.4.23.12 Nepenthesin
MRGCKTGMRMLPMLLLVLAAGAAASHSSCPATPPDSGATLQVSHAFGPCSPLGPGAASPSGAGFLADQAARDASRLLYLDSLAVRGRAYAPIASGRQLLQTPTYVVRARLGTPAQQLLLAVDTSNDAAWIPCAGCTGCPTSTPFNPAASTSYRPVACGSPLCAQAPNAASCPPNSKACGFSLTYADSSLVAALSQDSLAVANDVVKTYTFGCLQRATGTAAPPQGLLGLGRGPLSFLSQTKDMYEATLSYCLPS

SEQ ID NO: 13563 - DNA, 836 bp, Panicum virgatum
  misc_feature: Ceres CLONE 1769880
  misc_feature: Encodes the peptide sequence at SEQ ID NO. 13564
aacggccccaaagccacaaagccgagtttctctgctcctcgagcagccgaacatagcagtctccagagcaccccccatggcgacggcagctgcggcggccccggccgttcagactgtggtgctgagggtgtccatccactgccatggctgcaagaagaaggtccggaaggtgctcaggagcgtcgaaggtgtgcagaacgtgacggtggacgccgcgcagcacaaggtgacggtgacgggcaccgtggacgccaacacgctcgtccagaagctgcacaagtccggcaagaagggggtgccgtggcagtactgccacccgcccgccaacaagacggaggccgccgcgcctgctccggcgccggaggcgctgtcggctccgccggccggcgacggcggcaaggatgatgctgcgaaagcggcggacaacaagaagccggacgaggcggtgaaggagccgcaggtcgagagctccgagaagatgcagcctgagcaggagcccgcgggcgcggagaagaaggcggaggcacagctgaaggcggagaagaaagtggaggagaagaaggacggcggcgacagcgaggcagctgagaccaaggccaagggcgcagagccagcaaaggaagaggcgaaggaagccgccgccgctgttgccaagaacgaggacgaggcaaagaagagcgacaagcccaaggacgccgccggcaagccggagcccgtcgccgtgacgtcggagaagtccctgcccgcgcccccgccgccggcccccaagtacgcgtacgaggaggactaccgccacccctactacgcgccggcgccgcagccggtgatgagctacc

SEQ ID NO: 13564 - protein, 253 aa, Panicum virgatum
  misc_feature: Ceres CLONE 1769880
  misc_feature (15)..(75): Pfam Name: HMA Pfam Description: Heavy-metal-associated domain
MATAAAAAPAVQTVVLRVSIHCHGCKKKVRKVLRSVEGVQNVTVDAAQHKVTVTGTVDANTLVQKLHKSGKKGVPWQYCHPPANKTEAAAPAPAPEALSAPPAGDGGKDDAAKAADNKKPDEAVKEPQVESSEKMQPEQEPAGAEKKAEAQLKAEKKVEEKKDGGDSEAAETKAKGAEPAKEEAKEAAAAVAKNEDEAKKSDKPKDAAGKPEPVAVTSEKSLPAPPPPAPKYAYEEDYRHPYYAPAPQPVMSY

SEQ ID NO: 13565 - DNA, 2143 bp, Panicum virgatum
  misc_feature: Ceres CLONE 1769883
  misc_feature: Encodes the peptide sequence at SEQ ID NO. 13566
actactagctcccacatttgggaagcagatccttaattagacagcaacccaaccacctactaggcctaggctgtgatccaagttcgctcactttgatctgcagattgcagaaatctgcagggtgcagaatggagagaacactgatcacctcctctaacatctccatggctgcgcatccttcaggatcgtccaggagagttggctacatctcccctgctgcctctgctgctgcacaaaactccagctacaggaagaagaagagcaccccgtcggccacgactaacacttcaagaattggcactgcaagtgcaagaacaagaagggcgccggcgccgagccaggctcgggctcagccccgccgccgcccctccccggctgccgcgtccctgccgatggcgctctgcagcgcgctggaggaggcgatcaacacgttcgtcgacccgccggcgctgcggccgtcggtggacccgcggcacgtgctgtcggccaacttcgcgcccgtggacgagctgccgcccacgccctgccccgtcgtgcgcggcgccatcccgcgctgcctcgccggaggcgcctacatccgcaacgggcccaacccgcagcacctcccgcgcggcccgcaccacctcttcgacggcgacggcatgctgcactcgctgctcctcccggcggagtccgagtcgccgccgtccgaccccgtcctgtgctcgcggtacgtgcagacgtacaagtacctcgtggagcgcgacgcgggcgcgccagtcatgccgagcgtcttctccggcttccacggcctgggcgggctggcgcgcggcgccgtcgtggcggcgagggtgctcacggggcagatgaacccggccgagggcgtggggctcgccaacaccagcctcgtcttcttcggcgggcgcctctacgcgctcggcgagtccgacctgccgtacgccgtgcgcgtcgacccggccaccggcgaggtgaccacgcacgggcggtgcgacttcggcggccgcctcttcatgggcatgaccgcgcaccccaagaaagaccccgtcaccggcgaggtgttcgcgttccggtacggccccgtgccgccgttcgtcacctacttccggttcgacccggccgggaacaagggccccgacgtgcccatcttctccgtgcagcagccgtcgttcctgcacgacttcgccgtcaccgagcggtacgccatcttcccggagatccagatcgtgatgcagcccatgggcatggtggccggcggcgcgcccgtcggggccgactccggcaaggtgccccggatcggtgtgctccccaagtacgccacggacgagtcggagatgcgctggttcgaggtgccgggcttcaacatcatgcacacgctcaactcgtgggaggaggccggcggcgaggagctggtgctggtggcgcccaacgtcctgtccgtggagcacgcgctggagcgcatggagctcgtgcactcctgcgtcgagaaggtgcgcgtcaacctccgcaccggcgccgtgtcgcgcaccccgctctcggcggggaacctcgacttcggcgtgatccacccgggctacctcggccggcgcaaccgctacgggtacctgggcatcggcgaccccatgcccaagatcggcggcgtggccaagctggacctcgaccttgccggcacgggcgattgcaccgtggcgcggcgggacttcgggggcgggtgcttcgccggggagcccttcttcgtccccgacgacgtggagggggacggcaacgaggacgacggctacgtggtgtgctacgtccacaacgagcgcaccggcgagaaccggttcgtggtcatggacgcgaggtcgccgcagctggacatcgtcgccgaggtgcagctgcccgcccgcgtcccctacggcttccacggcctctttgtcaccaaggccgagctccaggcgcagcagcaatgacaagaacatgattccaagagaacacacacaaactggatactgaatagtaggtcatagtatgaacaaaactctaggtctcgtatagcattcgagtgtacgaattgttgtattgtaaatggagcagaacccatacaagagtttcgtgatttgagttgatatggtaacacaaagattttaaccaggttcactggacc

SEQ ID NO: 13566 - protein, 518 aa, Panicum virgatum
  misc_feature: Ceres CLONE 1769883
  misc_feature (11)..(510): Pfam Name: RPE65 Pfam Description: Retinal pigment epithelial membrane protein
  misc_feature: SWISSPROT Homolog: EC 1.13.11.51 9-cis-epoxycarotenoid dioxygenase
MALCSALEEAINTFVDPPALRPSVDPRHVLSANFAPVDELPPTPCPVVRGAIPRCLAGGAYIRNGPNPQHLPRGPHHLFDGDGMLHSLLLPAESESPPSDPVLCSRYVQTYKYLVERDAGAPVMPSVFSGFHGLGGLARGAVVAARVLTGQMNPAEGVGLANTSLVFFGGRLYALGESDLPYAVRVDPATGEVTTHGRCDFGGRLFMGMTAHPKKDPVTGEVFAFRYGPVPPFVTYFRFDPAGNKGPDVPIFSVQQPSFLHDFAVTERYAIFPEIQIVMQPMGMVAGGAPVGADSGKVPRIGVLPKYATDESEMRWFEVPGFNIMHTLNSWEEAGGEELVLVAPNVLSVEHALERMELVHSCVEKVRVNLRTGAVSRTPLSAGNLDFGVIHPGYLGRRNRYGYLGIGDPMPKIGGVAKLDLDLAGTGDCTVARRDFGGGCFAGEPFFVPDDVEGDGNEDDGYVVCYVHNERTGENRFVVMDARSPQLDIVAEVQLPARVPYGFHGLFVTKAELQAQQQ

SEQ ID NO: 13567 - DNA, 734 bp, Panicum virgatum
  misc_feature: Ceres CLONE 1769887
  misc_feature: Encodes the peptide sequence at SEQ ID NO. 13568
cgcggagagagagggattcgcaacgagatggcggcggtggctagggttttccgcgggtcccggttcctcatgtccccggcgccgggcgcggctgcggcggcgggggcgaagaaggcggcggcgccacaggtcaccaaggcggacgcgacggcggcgaaggagaagcgcgggatcttgaagccggtgccggtctccgaggagatgcgcaggttcgccggcggcaagcccgaggtcgcccgctccgaggccgtcaagctcatctgggcccacatcaaggccaacggcctccagaacccggcgaaaaaaacagagatcaactgtgatgccacactcaaaagcttgtttggtgggagggacaagattgggatgctggagatctcgaaactactgaaccctcacttcctgaagaactaacagaagcagcagatggcgccaatgatggtgctttcgtctaagactttattggatggcctcttttgtgatccatgttaagtccagctccccactaggtagttgagccaaagttgtgtcatggtgtcaagacttcagactttgtgttcagcagttgggtttggggtgtgatgcatgtaaaaaggattcccagtgttattgctgctcttgtgatcctgtgagggcaccttcatgcaaattgatgtgggaaatgttagtctgctgatggcacaaaaaaaaaaaaaataagccatctgcaagtcaagtctcactagtcactccta

SEQ ID NO: 13568 - protein, 128 aa, Panicum virgatum
  misc_feature: Ceres CLONE 1769887
  misc_feature (49)..(126): Pfam Name: SWIB Pfam Description: SWIB/MDM2 domain
MAAVARVFRGSRFLMSPAPGAAAAAGAKKAAAPQVTKADATAAKEKRGILKPVPVSEEMRRFAGGKPEVARSEAVKLIWAHIKANGLQNPAKKTEINCDATLKSLFGGRDKIGMLEISKLLNPHFLKN

SEQ ID NO: 13569 - DNA, 1984 bp, Panicum virgatum
  misc_feature: Ceres CLONE 1769890
  misc_feature: Encodes the peptide sequence at SEQ ID NO. 13570
aaaaccctatctcggtcttccgcctctccgcctccgccttcgcatcttctctcgcaacggcggcagcagcagccatggccaaggtctggggcggcgtcggcgcgtgggcgctggacgccgagcgcgccgaggaggaggaggagcacgggcgcgccgcgggcctgccggcgcccgagcccgccggcggcgccgccagcttccccagcctcgcggaggcggccgccgccaagcccaagaagaagaacaagcgcaccaccctgtcgctctccgagttcaccacctacggcgcgctcgcggcccagcgccgcgccgcgcccgcggagcccaggggcctcaccccggacgagatgatgatgctgcccaaggcgccccgggagcgctccgccgaggagctcgaaaactcccgcggcttccgctcctacggcggcggcctcgggggaggcgagcgccgcgggttcgacgacgagggccgccgcgggtcgggcaggagctcggatctcgacataccctcccgcgccgacgaggtcgacgactggggggccactaagaagttcaccccgtctgccaccgactctggccgccgcgacaggttcggcgggccgtccccgatgggccgcgcggatgacattgacgactggtcgcgcgacaagaagccgctcccgtcgcgctaccccagcctcggttccggtggtggcgggggcggattccgcagctcgtcgggattccgcgactcgctgggcttccgcgactcatcagcttcctctgattccgaccgttgggtccgtggagccacccttacgccacacaacggcgagggggcgggggagaggcggcgtatcattctcgatcctccgaaacgtgatcctgcagccacttctacgccacctgccgaggtggcacgcaaccggccaagcccatttggtgctgcaaggccccgggaggatgtgctgacagagaagggagtggattggaggaaattggagagtgggattgagcagaagaccagccatcctaccagctcgaactccagcaaggaaaatggtgctgattcctcccgccctgggagccctggatcgcaggtttcagcagttgggagtgagggagcgcccggggcacggccaaaggttaacccgttcggtgatgccaagccaagggaagttgttttgcaggagaaagggaaggattggaggaagattgaccttgagctggagcatcgtgctgtaaataggccagagtcagatgaagaaagaaacttgaaagaagaaatcaaccttatgatggtggatctcagaggaattaaggaaaagataagtgatggttctgaccaagcctcggtagatgcaaaaaaattgtctgagaagatatctcagttggaaagtaaacttgagcagcttacaagggagttggatgacaagattcgatttgggcaaagaccatgttctggtgcagctagggttacaacacttccaccaaccagtttagcagaggagccagaagctacagttgtggacagaccgctcgtggtggtatggaaccacactcaagcctggaagaaagatggagatttcaaggaagcagagaaaggggctcttttggtggaagctgaagttcagatagtgatgaggcagagatggtaaattgggagtccaggcttctggtaattgtttgggaaacttgtggttccgagtccctttttttgttttgaataggatgcgcaaaataagtaattttgtgttccgtcatttttggttggtccagaagattgaagagaatggagataagtccacattaagttatagattgtcacctctatatgctgtaggatatttcccatttcccttttttcaatcttccgtgtgtcataacaatacctgtcaatactaactgttattcgtgcctactgaattcgatcagcttttttgtctcgagttgtttatttgattgatcctggtggaatggaaaccttgaattggatcttttgtat

SEQ ID NO: 13570 - protein, 520 aa, Panicum virgatum
  misc_feature: Ceres CLONE 1769890
  misc_feature (1)..(520): Pfam Name: eIF-4B Pfam Description: Plant specific eukaryotic initiation factor 4B
  misc_feature: SWISSPROT Homolog: EC 2.7.11.1 Non-specific serine/threonine protein kinase
MAKVWGGVGAWALDAERAEEEEEHGRAAGLPAPEPAGGAASFPSLAEAAAAKPKKKNKRTTLSLSEFTTYGALAAQRRAAPAEPRGLTPDEMMMLPKAPRERSAEELENSRGFRSYGGGLGGGERRGFDDEGRRGSGRSSDLDIPSRADEVDDWGATKKFTPSATDSGRRDRFGGPSPMGRADDIDDWSRDKKPLPSRYPSLGSGGGGGGFRSSSGFRDSLGFRDSSASSDSDRWVRGATLTPHNGEGAGERRRIILDPPKRDPAATSTPPAEVARNRPSPFGAARPREDVLTEKGVDWRKLESGIEQKTSHPTSSNSSKENGADSSRPGSPGSQVSAVGSEGAPGARPKVNPFGDAKPREVVLQEKGKDWRKIDLELEHRAVNRPESDEERNLKEEINLMMVDLRGIKEKISDGSDQASVDAKKLSEKISQLESKLEQLTRELDDKIRFGQRPCSGAARVTTLPPTSLAEEPEATVVDRPLVVVWNHTQAWKKDGDFKEAEKGALLVEAEVQIVMRQRW

SEQ ID NO: 13571 - DNA, 1711 bp, Panicum virgatum
  misc_feature: Ceres CLONE 1769892
  misc_feature: Encodes the peptide sequence at SEQ ID NO. 13572
atgccgggcgtcgccgccaactcctcgctgccttctctctttgcccgccgtaggtgagcaggccttttccgaatcccgaccccgagatcggcctcgccctcgatgacgaagcttcttcttcttctccggatgatgctctggcgccgccaccgtctctcctcaccgccgtacacgcggctcctcgcctgccttctcctcctcggcctgctgccgccgctctcccgcgccgcgacggtggtcaaccgcctgccggggttccccggccccctgcccttctacctggagacagggtacgttggcgtgggggaggaggaggccggggcggagctcttctactacttcgtggagtcggagcggagccccggcaccgaccccgtgctggtgtgactcaccggcgggccccggtgctccgccttcagcggcctcgcctacgagatcgggcccatcaatttcgtcctccaaccctacgacggcacgctgccgcggctggtctacagcccggattcctggacacgggtggcgagcatcatcttcctggactcgcccgtgggttcaggcttctcgtacgcgcgcgacccccgcggctacgacgtcggggacgtctcgtcgtctaggcaggtcgtggagttcctgaggaagtggtttgatgctcacccatggcttcaatcaaaccctttctacgtcgctggcgactcgtatgcaggaatggtggtgcccgttattgcacaatatatctcagaaggaaatgaaggaatgcatcatgcactgatcaatctcaagggctatatagtcggcaaccctgtaaccggagacaaggtcgacaccaactctcggattccgtacgctcattcgcatggaatcatatctgaccagcagtacgaggctgcggtggcaaattgcaatggggattatgtgagtccgacgaacaagctctgcgccgacgtgctacaaactatccagaatctcatgtcagaagtcgaccacaaagatatactgggaccgaaatgtccccttgattcaccgaatccgaggagagatgctttagagaggaagtccctagcagaggaacactactatcggattagtgacccacctgcggaaccttcttttcgttgttttgaataccgctactacctgtcttacttttgggcaaatgacaatgccactagagctgcccttggggtcaaggagggaacagtgaaggaatgggttaggtgccagcgttcaggttttccctacacctacgatattccgagcagcataaagtaccacttcaacctcaccaccaggggttaccgcgctctggtatacagtggagaccatgatctaagtataccgttctcgggcacacatgcatggataagatccttcaacttctccattgttgatgactggagggcgtggcaccttgatggccaggctgcaggattcacgatcaaatatgcgaacaatctcactttcgcgacagtgaagggtggtcgccatgctgctccagggaatcagcccaaagaatgcttcactatggctaaaaggtagctggacaataagcctctctgatttgcctgccaactcaggctgcacttctgaatccggattcagtctgtaactgtgcaataagtctgtaaaatgacaaccaaactagcgaagtaagttaattaatgtaataaagcacgtcaaatattaagtttgcactcgaaagtgtttctctttc

SEQ ID NO: 13572 - protein, 276 aa, Panicum virgatum
  misc_feature: Ceres CLONE 1769892
  misc_feature (1)..(275): Pfam Name: Peptidase_S10 Pfam Description: Serine carboxypeptidase
  misc_feature: SWISSPROT Homolog: EC 2.3.1.91 Sinapoylglucose--choline O-sinapoyltransferase
  misc_feature: Useful for biocontainment applications
  misc_feature: Useful for making plants with modulated biomass
  misc_feature: Useful for making plants with modulated flowering time
MVVPVIAQYISEGNEGMHHALINLKGYIVGNPVTGDKVDTNSRIPYAHSHGIISDQQYEAAVANCNGDYVSPTNKLCADVLQTIQNLMSEVDHKDILGPKCPLDSPNPRRDALERKSLAEEHYYRISDPPAEPSFRCFEYRYYLSYFWANDNATRAALGVKEGTVKEWVRCQRSGFPYTYDIPSSIKYHFNLTTRGYRALVYSGDHDLSIPFSGTHAWIRSFNFSIVDDWRAWHLDGQAAGFTIKYANNLTFATVKGGRHAAPGNQPKECFTMAKR

SEQ ID NO: 13573 - DNA, 795 bp, Panicum virgatum
  misc_feature: Ceres CLONE 1769897
  misc_feature: Encodes the peptide sequence at SEQ ID NO. 13574
atcctcacatcctccacagagcttcacgcattgcacggggagcagaggagcaacctccgagtagtggcggcgcggagaaagctagcgcccaaacccaatccacctagctagctagcgagataggcatggcgcgctgggccattgcgatccacggcggcgcgggcgtggacccgaacctgccggagagccgccaggacgaggccaagcgcgtgctggcgcggtgcctgcaggccggcgtggacatgctgcgcgcgggggcctcggcgctcgacgtcgtcgaggccgtggtgcgcgagctcgagaccgaccccttcttcaactccggccgcgggtccgcgctcacccgccgcggcaccgtcgagatggaggctagcatcatggacggccgcggccgccgctgcggcgccgtgtccggcgtctccaccgtcaagaaccccgtctccctggcgcgccgcgtcatggacaagtcgccgcactcgtacctcgccttcgaaggcgccgaggagttcgcccgcgagcagggccttgagaccgtggacaacagctacttcatcaccgaggacaacgttggcatgctcaagctcgccaaggaggccggcagcatcctgttcgactaccgcatcccgctggccgggacggacacgtgcagcgcgctggcgggggcggacaaccacaagggcatggtgatgaacggcctccccatcagcatctacgcgccggagacggtggggtgcgcggcggtggactcgagtggcttcaccgcggcggccacctccacgggcgggctcatgaaac

SEQ ID NO: 13574 - protein, 223 aa, Panicum virgatum
  misc_feature: Ceres CLONE 1769897
  misc_feature (2)..(223): Pfam Name: Asparaginase_2 Pfam Description: Asparaginase
  misc_feature: SWISSPROT Homolog: EC 3.5.1.1 Asparaginase
MARWAIAIHGGAGVDPNLPESRQDEAKRVLARCLQAGVDMLRAGASALDVVEAVVRELETDPFFNSGRGSALTRRGTVEMEASIMDGRGRRCGAVSGVSTVKNPVSLARRVMDKSPHSYLAFEGAEEFAREQGLETVDNSYFITEDNVGMLKLAKEAGSILFDYRIPLAGTDTCSALAGADNHKGMVMNGLPISIYAPETVGCAAVDSSGFTAAATSTGGLMK

SEQ ID NO: 13575 - DNA, 794 bp, Panicum virgatum
  misc_feature: Ceres CLONE 1769909
  misc_feature: Encodes the peptide sequence at SEQ ID NO. 13576
acggaaacagccactcacctcccccaccctccggttcatgtcctgctgctccccatgtcgcccccactcgagctcgactacataggactctcgccgccggaggtcgccgccgccgcagatgccgccgacgacctgaagggcaccgagctccgcctcggcctgccggggtccgagtcgccggagcgccgcgtcgcggctgccaccgcgaccaccctggacctgctcccagccaagggcgccaagcgcgggttcttcgacgaggtgccgccgccgtcgcccgccgccgctgcgggcaagggcaagaaggtggcggacgaggaggacgacgacaagaaggtggcagcgaccccgcagccggccgccaaggctcaggtggtgggatggccaccaatccgcagttaccgcaagaacacgatggctactacccagcagaagggcagcaaggaggatgctgaggccaagcagggccaagggttcctctacgtgaaggtcagcatggatggcgccccgtacctcaggaagattgacctcaagacatacaagaactacaaggatctctccactgcacttgagaagatgttcagtggctttagtaatggtgagatgtctcgggttattctccacttttaccaggcgtatacagtatgtaattgtgtttcatttttatgtgtatagttttggaaacacatcttagaagccttaaaaaacatgcttggttctaatgataagcaatagttttagcttactattattttgagtagttttaggataacaaacaattcagtgcgaagttt

SEQ ID NO: 13576 - protein, 206 aa, Panicum virgatum
  misc_feature: Ceres CLONE 1769909
  misc_feature (26)..(202): Pfam Name: AUX_IAA Pfam Description: AUX/IAA family
MSPPLELDYIGLSPPEVAAAADAADDLKGTELRLGLPGSESPERRVAAATATTLDLLPAKGAKRGFFDEVPPPSPAAAAGKGKKVADEEDDDKKVAATPQPAAKAQVVGWPPIRSYRKNTMATTQQKGSKEDAEAKQGQGFLYVKVSMDGAPYLRKIDLKTYKNYKDLSTALEKMFSGFSNGEMSRVILHFYQAYTVCNCVSFLCV

SEQ ID NO: 13577 - DNA, 777 bp, Panicum virgatum
  misc_feature: Ceres CLONE 1769918
  misc_feature: Encodes the peptide sequence at SEQ ID NO. 13578
caatccctcaccagtcaccacccctccacttcctcctccccagaccccagcctctgctcgtgccgccgccgaccatggcctgcctcaccgacctcgtcaacctcaacctctcggacaccacggagaagatcatcgccgagtacatatggatcggtggatctggcatggatctcaggagcaaggccaggaccctctccggaccggtgaccgatcccagcaagctgcccaagtggaactacgacggctccagcaccggccaggcccccggcgaagacagcgaggtcatcctgtacccgcaggctatcttcaaggacccattcaggaagggcaacaacatccttgtcatgtgcgattgctacaccccagctggcgagccaattcccaccaacaagaggcacagcgccgccaagatcttcagcaaccctgaggttgccgctgaggagccctggtatggtattgaacaggagtacaccctccttcagaaggacaccaactggccccttgggtggcctgttgatggcttccctggccctcagggtccttactactgcgatatcggcgccgacaagtctttcgggcgcgacatagttgactcacactacaaggcttgcctgtatgccggtatcaacatcagtggcatcaacggggaggtcatgccaggacagtgggagttccaagttggcccgtccgtcggcatttccgccggtgaccaggtgtgggttgcttgctacattcttgagaggatcaccgagatcgccggagtggtggtgacattcg

SEQ ID NO: 13578 - protein, 234 aa, Panicum virgatum
  misc_feature: Ceres CLONE 1769918
  misc_feature (17)..(97): Pfam Name: Gln-synt_N Pfam Description: Glutamine synthetase, beta-Grasp domain
  misc_feature (103)..(234): Pfam Name: Gln-synt_C Pfam Description: Glutamine synthetase, catalytic domain
  misc_feature: SWISSPROT Homolog: EC 6.3.1.2 Glutamate--ammonia ligase
  misc_feature: Useful for making plants with modulated water use efficiency
MACLTDLVNLNLSDTTEKIIAEYIWIGGSGMDLRSKARTLSGPVTDPSKLPKWNYDGSSTGQAPGEDSEVILYPQAIFKDPFRKGNNILVMCDCYTPAGEPIPTNKRHSAAKIFSNPEVAAEEPWYGIEQEYTLLQKDTNWPLGWPVDGFPGPQGPYYCDIGADKSFGRDIVDSHYKACLYAGINISGINGEVMPGQWEFQVGPSVGISAGDQVWVACYILERITEIAGVVVTF

SEQ ID NO: 13579 - DNA, 1074 bp, Panicum virgatum
  misc_feature: Ceres CLONE 1769919
  misc_feature: Encodes the peptide sequence at SEQ ID NO. 13580
accccaccgccttcacccgtgccccccaccccggccctgcttcgacgggcggcggcgcagatcgaaggaaccaggagggaatgatggatctcggggacagccagcagcggctcatcgccggcgcggcgctgctgctggccaccgtcgccttcgtcaggctcctgctgggctcccgcgcccgcggcaagcgcctcccgcccaccatcccgggggcgccggtcgtcggcgggctcatcaagttcatgcgcgggcccatccccatgatccgggaggagtacgcccgcctcggcagcgtcttcaccgtccccatcctcagccgccggatcaccttcctcatcgggcccgaggtctccgcgcacttcttcaagggcaacgaggccgagatgagccagcaggaggtgtacaggttcaacgtgcccacctttgggccgggggtcgtcttcgacgtcgactactccgtcaggcaggagcagttccggttcttcaccgaggccctgcgtgccagcaagctccgcagctatgtcgaccagatggttgctgaggctgaggagtacttctcaaagtggggagaaagtggtaccgtgaatttgaagtatgagttggagcaccttatcatactgacagctagtcgatgcttgctgggaagggaggtgcgagagaagctctttgatgatgtatctgctctcttccatgaccttgacaatgggatgcagcccgttagtgtcatcttcccctacctcccaatccctgcwcataagcgccgggacagggcacgggcacrtctggcagaaatctttgccaccatcattaactctcgcaaggyctctggacaktcggaagaagacatgctgcagtgctttattgattccargtacaagaacggacgctccaccgcagagggtgaggtgacckggttacttattgcggsactctttgccggayaacacaccagctctatcayctcaacctgractggagcctacctccttcggttcaagcactactttccagaggctatggaggagcagaaagaggtgatgaagcggcctgggaacaagattgatcatgacatat

SEQ ID NO: 13580 - protein, 330 aa, Panicum virgatum
  misc_feature: Ceres CLONE 1769919
  misc_feature: SWISSPROT Homolog: EC 1.14.13.70 Sterol 14-demethylase
  misc_feature (233)..(233): Xaa is any aa, unknown, or other
  misc_feature (247)..(247): Xaa is any aa, unknown, or other
  misc_feature (250)..(250): Xaa is any aa, unknown, or other
  misc_feature (263)..(263): Xaa is any aa, unknown, or other
  misc_feature (277)..(277): Xaa is any aa, unknown, or other
  misc_feature (282)..(282): Xaa is any aa, unknown, or other
  misc_feature (287)..(287): Xaa is any aa, unknown, or other
  misc_feature (293)..(293): Xaa is any aa, unknown, or other
  misc_feature (296)..(296): Xaa is any aa, unknown, or other
MDLGDSQQRLIAGAALLLATVAFVRLLLGSRARGKRLPPTIPGAPVVGGLIKFMRGPIPMIREEYARLGSVFTVPILSRRITFLIGPEVSAHFFKGNEAEMSQQEVYRFNVPTFGPGVVFDVDYSVRQEQFRFFTEALRASKLRSYVDQMVAEAEEYFSKWGESGTVNLKYELEHLIILTASRCLLGREVREKLFDDVSALFHDLDNGMQPVSVIFPYLPIPAHKRRDRARAXLAEIFATIINSRKXSGXSEEDMLQCFIDSXYKNGRSTAEGEVTXLLIAXLFAGXHTSSIXSTXTGAYLLRFKHYFPEAMEEQKEVMKRPGNKIDHDI

SEQ ID NO: 13581 - DNA, 1368 bp, Panicum virgatum
  misc_feature: Ceres CLONE 1769920
  misc_feature: Encodes the peptide sequence at SEQ ID NO. 13582
aaacaacacgaacaacccaagaaaaacttttcctagcggtgaacaatgtgcgggggcgccattctcgcggaactcatcccgtcgccgcgccgggcggcgtcgaagccggtgaccgcgggccacctctggacggcgggctccgacaccaagaaggccggcagcgggaggagcaagaggcaccagctcgccgacgtcgacgactttgaggccgccttcgaggacttcgccgacgattttgacgaggaggaggtcgaggaccaccatttcgtgttctcgtccaaatccgcattctccccagcccacggcgtgcgcgcggcgacccagaagaggcgcggcggccgccacttccgcggcatccggcagcgcccctggggcaagtgggcggcggagatccgcgacccgcacaagggcacccgcgtctggctcggcaccttcaacaccgccgaggacgccgcccgggcctacgacgtcgaggcacgccgcctccgcggcagcaaggccaaggtcaacttccccgcggccggcgcgcgcccacgccgcggcaacgcgccgagaccgcagcgccaccatgccgcagcgcagcccgcgttgcttgcaggagagaagcggaaggaggaggagatcgtcgtgaagcctgaaattggggcgtcgttcgacttcgacgtgggcagcttcttcgacacggccttccccgcggcgccgccggccatggagaactccttcgccggcagcaccgggtcggagtccggtagccccgcaaagaagatgagatacgacaacgactcgtcgtccgatgggatgagctccggcggcggctccgcgctggagctcgctgacgagctcgcgttcgatccgttcatgctgctccagatgccctactcgggcgggtacgagtccctcgacggcctgttcgccgtcgacgccgcccaggacgtgaacaacgacatgaacggcgtcagcctgtggagcttcgacgagttccccgacgacagcgctgttttctaacgtgccgccctaccagtttccctcagctggacggcggcggtgcggacgctccaccggacgatcgatgcagctgatgagggcgactgccgatcgcttgcttgttgattggcgtgtaatcatatatgtcagagtactgtactgtgctgtgctgcttgagtttgctcgctagattctgtatcagtgtatctgtactgccggcctcctgatcaaactgtactctactttgaatatttgtactactcgtttttggtgcttcctatagtgtgtcaatagtcctatgaatttgatcatgtcggcaatggtcgtctatatattgtacggttgtgattgttatgccaaataagtttgtgaacctggttgtat

SEQ ID NO: 13582 - protein, 319 aa, Panicum virgatum
  misc_feature: Ceres CLONE 1769920
  misc_feature (99)..(150): Pfam Name: AP2 Pfam Description: AP2 domain
  misc_feature: The sequence is a functional homolog of SEQ ID NO 10 in the 10/412,699 US patent application
  misc_feature: The sequence is a functional homolog of SEQ ID NO 124 in the 11/479,226 US patent application
  misc_feature: The sequence is a functional homolog of SEQ ID NO 151 in the 11/479,226 US patent application
  misc_feature: The sequence is a functional homolog of SEQ ID NO 32 in the 10/412,699 US patent application
  misc_feature: Useful for making plants with altered lignin content
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
MCGGAILAELIPSPRRAASKPVTAGHLWTAGSDTKKAGSGRSKRHQLADVDDFEAAFEDFADDFDEEEVEDHHFVFSSKSAFSPAHGVRAATQKRRGGRHFRGIRQRPWGKWAAEIRDPHKGTRVWLGTFNTAEDAARAYDVEARRLRGSKAKVNFPAAGARPRRGNAPRPQRHHAAAQPALLAGEKRKEEEIVVKPEIGASFDFDVGSFFDTAFPAAPPAMENSFAGSTGSESGSPAKKMRYDNDSSSDGMSSGGGSALELADELAFDPFMLLQMPYSGGYESLDGLFAVDAAQDVNNDMNGVSLWSFDEFPDDSAVF

SEQ ID NO: 13583 - DNA, 1698 bp, Panicum virgatum
  misc_feature: Ceres CLONE 1769921
  misc_feature: Encodes the peptide sequence at SEQ ID NO. 13584
atcggcatcggcatcggcatcggcatctccatctccatctcgccggcggagccctcctctcctctcctctcctctcctcatagccagccagccagccagccagcccaagcaaacccaaatccaacaactactagcagcaagcgccgaccatggggcagggcactcctgggggcatgggaaagcagggtggagccggcgaccgcaagcccggggacgccgacaagaaggacaagaagttcgagccgcccgctgccccctcccgcgtcggccgcaagcagcgcaagcagaagggcgccgaggccgccgcgcgcctccccaacgtcgcgccgctctccaagtgccgcctccgcctcctcaagctcgagcgggtcaaggactacctcctcatggaggaggagttcgtcgccgcgcaggagcgtctccgcccgcaggaggacaaggccgaggaggaccgatccaaggtcgacgacctccgcggcacgcccatgagcgtcggatccctcgaggagatcatcgacgagagccacgccatcgtatcctcctccgtcggacccgagtactacgtcggcatcctctccttcgtcgacaaggaccagctcgagccgggatgctccatactcatgcacaacaaggttctgtctgtggttgggatattgcaagatgaagttgatcccatggtatctgtgatgaaagttgagaaagctcctctggagtcttatgctgacattggtgggttagacgctcagattcaagaaattaaagaggcagttgagcttccattgactcatcctgagctgtatgaagacattgggatcaggcctcccaagggagtcatattgtatggagagcctggaacaggaaaaactctacttgccaaggctgtcgctaactcaacatctgcaactttcttgcgtgtcgttggaagtgagcttattcaaaagtaccttggtgacggtcccaagctagtcagagaacttttcagggtggctgatgagctttctccctcaatagtctttattgatgagattgatgcagttggaacaaagagatatgatgctcattcaggaggagaacgtgagattcaaagaactatgttggagctgctgaatcagctagatggttttgactcacgtggagatgttaaagttattctagcaacaaaccgcattgaaactcttgatccagctttgcttcggccaggtcgtatagaccggaagattgaatttcctctgccagatattaaaactaggcgtcgcatcttccagatacacacctcaaaaatgacgttagccgatgatgtgaacttggaagaattcgtgatgacaaaggatgagttctcgggggctgatatcaaggctatttgtacggaagctgggttgctagcattgcgagaacgtagaatgaaggtgacccatgcggatttcaagaaggccaaggagaaggtgatgtacaagaaaaaggaaggcgtcccagatggtctctacatgtgatcccttcattgtcaggacaagctatctttattgtagtagcactttctcttcatcatgggagatatgtgggcttgtttgtcatagtacttgtcgcactcagtttggaaaacatgtattatccttcgatttatttgaagtaagaaaattccctttgagcggatgctggaacgctgtgtaggcaaggcttgcgctgcagcatacagctttt

SEQ ID NO: 13584 - protein, 446 aa, Panicum virgatum
  misc_feature: Ceres CLONE 1769921
  misc_feature (227)..(414): Pfam Name: AAA Pfam Description: ATPase family associated with various cellular activities (AAA)
  misc_feature: SWISSPROT Homolog: EC 3.6.4.3 Microtubule-severing ATPase
MGQGTPGGMGKQGGAGDRKPGDADKKDKKFEPPAAPSRVGRKQRKQKGAEAAARLPNVAPLSKCRLRLLKLERVKDYLLMEEEFVAAQERLRPQEDKAEEDRSKVDDLRGTPMSVGSLEEIIDESHAIVSSSVGPEYYVGILSFVDKDQLEPGCSILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIETLDPALLRPGRIDRKIEFPLPDIKTRRRIFQIHTSKMTLADDVNLEEFVMTKDEFSGADIKAICTEAGLLALRERRMKVTHADFKKAKEKVMYKKKEGVPDGLYM

SEQ ID NO: 13585 - DNA, 645 bp, Panicum virgatum
  misc_feature: Ceres CLONE 1769929-R
  misc_feature: Encodes the peptide sequence at SEQ ID NO. 13586
gagctggatgagaaccttaataagcagtttcgtgtatttgaagctgcaccacatgaatcaagaggtgttccttctaagaggcctgcaccagattactttctgtgatgctgcatattcaacgcctgagcttgctgcctaatctatgctttcaagcactggcactggcaggcaagctttgcggatgatgtcccatgttataagaagcgctcaggtcttacaagggtccttgcctgaaggtgcttccaggatgtctaaatctagtgtgtcacgttctcctttcaggtcttttgtttgtaagagagttgatgctggcatccagtttttcacagaagagctcccatttgagcttgagaaatgctcctatgaaggtggatttcatgggaggtgtgcactagtatgatgtaaattttgtcgtggtgcctcatccctaagaaaacccgttgcgagaatccggagtggttacactggaacctgcaggaaattttgtagctgacattcgcaagctgttaggaggaaagcatgtggtccagtaatgtaacatttgcgactagaacttgacaaatatctgcatgtaatggttgtaatgcaacatgctctcgcagctttactaatttaaatatgcctagctgtaagcttaccaagtac

SEQ ID NO: 13586 - protein, 34 aa, Panicum virgatum
  misc_feature: Ceres CLONE 1769929-R
  misc_feature: SWISSPROT Homolog: EC 3.1.3.16 Phosphoprotein phosphatase
ELDENLNKQFRVFEAAPHESRGVPSKRPAPDYFL

SEQ ID NO: 13587 - DNA, 227 bp, Panicum virgatum
  misc_feature: Ceres CLONE 1769929
gaaagccaacagaatcttggccccagcgaaatcgcggtagccttaccgccccagcgaaaccttcggcccccgcacgctacgccaccggtcaccccctcccccctccgcctcctaaccctagaatcttcgagaagcacccggcgaggagcgcgccgccgcggcgcttctggaagcttctggaaggaggagagggagagaggggggggggggggggggggggggggggg

SEQ ID NO: 13588 - DNA, 1657 bp, Panicum virgatum
  misc_feature: Ceres CLONE 1769935
  misc_feature: Encodes the peptide sequence at SEQ ID NO. 13589
agagcaagcacggggagatcagccggcagcgtctgacatggcggcgctgtggctggcgagagcatcgtcccagctggcgcgccgcgccgccaggaggctcccgccgcttccttcgcgccacggcggcgagaccagcccgtggctcttgggctcatcggccgcagcgccgccgccggttcttggatcaccaccactgccaccgctggagagaatcgtccgccggggcttctgctccgtccggcgcttcgccggggagagcagcgccgccgccgccaccgctgacgaggaggagccggagaacgggttcgccggcggcgatcaggccattgacttccctggagggaaggtttcatttgtagctgaaatgaacttccttccggagtcacatggggaaaggatcagctgttatcgtgttcttgacgatgatggcagaacaatatctggtagtagattccgagaggtcaataaggaggtggctctgaaaatgtacagggagatggtcaccctccatatcatggataacatcttctatgaagcgcagaggcagggtagaatctcattttatctcacttccaatggcgaggaagcgatcaacatagcatctgctgctgcacttagtattgacgacattgtgctgcctcagtacagggaaccaggtgttcttctgtggcgcggtttcacactgcaagagtttgcaaaccaatgctttgggaacagtatggattatggtaaaggaaggcaaatgccaattcactatggatcaaaccgtcttaactatttcacagtctcatcgcctatttcaacacagctcccacatgctgttggagctgcctactctctgaagatggataaaaaggacgcatgtgccatcacatacttcggcgatggaggcacaagtgagggagacttccatgccgcgctcaactttgcagctgttatggaggcaccagtggtcttcttctgccgcaacaatggctgggcaatcagcaccccaaccactgaacagttcagaagtgatggagtggttatccgtggccaggcttatgggatccgtggtatcagagtagatggaaatgatgctcttgctgtttacagtgcagtccatgctgcccgagaaatggctatagctgaagggagaccaattttaattgaggccctgacttacagagtcggccatcactcaacatctgatgattcaaccaagtacaggccagttgatgagattgagcattggcgaacagcaagggatccaatttccagatacagaaaatgggttcaggggaacgactggtggtctgatgctgaagaatctgaactaaggagcagagtgagaaaagagcttcttcaagccattcaggttgcagaaagaatgccaaaaccaccaattgctgagcttttcactgatgtttatgatcagatcccttccaacctgcgagaacaagagcgattgctgcgggagacaatcatgaagcaccctgcagactacccaactgatgtacctgtttaggtttcaggatttagatgagcaacatcgttgtgtaagtattgatgattcagatccatagcattataagcaatatatgattcagccagtaatctcctgattcataggctctaaaacaataattcaacctgccagatgtttacaacaagctcg

SEQ ID NO: 13589 - protein, 489 aa, Panicum virgatum
  misc_feature: Ceres CLONE 1769935
  misc_feature (151)..(451): Pfam Name: E1_dh Pfam Description: Dehydrogenase E1 component
  misc_feature: SWISSPROT Homolog: EC 1.2.4.4 3-methyl-2-oxobutanoate dehydrogenase (2-methylpropanoyl-transferring)
MAALWLARASSQLARRAARRLPPLPSRHGGETSPWLLGSSAAAPPPVLGSPPLPPLERIVRRGFCSVRRFAGESSAAAATADEEEPENGFAGGDQAIDFPGGKVSFVAEMNFLPESHGERISCYRVLDDDGRTISGSRFREVNKEVALKMYREMVTLHIMDNIFYEAQRQGRISFYLTSNGEEAINIASAAALSIDDIVLPQYREPGVLLWRGFTLQEFANQCFGNSMDYGKGRQMPIHYGSNRLNYFTVSSPISTQLPHAVGAAYSLKMDKKDACAITYFGDGGTSEGDFHAALNFAAVMEAPVVFFCRNNGWAISTPTTEQFRSDGVVIRGQAYGIRGIRVDGNDALAVYSAVHAAREMAIAEGRPILIEALTYRVGHHSTSDDSTKYRPVDEIEHWRTARDPISRYRKWVQGNDWWSDAEESELRSRVRKELLQAIQVAERMPKPPIAELFTDVYDQIPSNLREQERLLRETIMKHPADYPTDVPV

SEQ ID NO: 13590 - DNA, 776 bp, Panicum virgatum
  misc_feature: Ceres CLONE 1769938
  misc_feature: Encodes the peptide sequence at SEQ ID NO. 13591
acttgtctcactcatcatcagttgtagtcctgatccacatcgtcggagccggagacggagaggattcactcgccgatcgcttccttgctgctgcgccgccgtcttctcttctgtcgctccggacatgtgtctgtagcagttcatttgagggagttggtacccttgtgcgtccattatggcattagcttctgccaatgccatctttcctccctcaaacctttcatataaagcttgggaggacccatcattcttcaagtggagaaagcgggaagcgcatgtgccattgcgctcacaggatacgctggaaggagccctcaagtattggcatgagcgaaggaatgtgaactatctcaatgctgacactgctgtctggaatgatgatgcggttcgcagtgctctagaaagtgctgctctttggtccaagggcttaccctatactaaatctctaagtggacactggaaatttcttctggccccttcagcagaaagtgttccagagaaattctatgatactcattttgatgattcgaattgggaagctttgccagtaccctcaaattggcaaatgcatgggtttgaccgcccaatctacaccaatatcacgtatcctttcccaataaatccaccatttgtgcccactgataatcccactggctgttacaggacagtttttcacatcccaaaagagtggaaaggtcggaggatcttgctgcactttgaagctgttgattccgcgttttttgcttgggtaaatggggtgccaattgggtacagcc

SEQ ID NO: 13591 - protein, 200 aa, Panicum virgatum
  misc_feature: Ceres CLONE 1769938
  misc_feature (85)..(200): Pfam Name: Glyco_hydro_2_N Pfam Description: Glycosyl hydrolases family 2, sugar binding domain
  misc_feature: SWISSPROT Homolog: EC 3.2.1.23 Beta-galactosidase
MALASANAIFPPSNLSYKAWEDPSFFKWRKREAHVPLRSQDTLEGALKYWHERRNVNYLNADTAVWNDDAVRSALESAALWSKGLPYTKSLSGHWKFLLAPSAESVPEKFYDTHFDDSNWEALPVPSNWQMHGFDRPIYTNITYPFPINPPFVPTDNPTGCYRTVFHIPKEWKGRRILLHFEAVDSAFFAWVNGVPIGYS

SEQ ID NO: 13592 - DNA, 826 bp, Panicum virgatum
  misc_feature: Ceres CLONE 1769945
  misc_feature: Encodes the peptide sequence at SEQ ID NO. 13593
aaaccaagcacgccaggcacccgaccggagcccgtccgtgcgccgctctccccccgcctccgaccccagccgctccggcgagcccccagcgaaggcggcgtcagccatgagggagatcctgcacatccagggcgggcagtgcgggaaccagatcggcgccaagttctgggaggtgatctgcgacgagcacggcatcgacgccacgggccgctacgcgggggactcggacctccagctcgagcgcatcaacgtctactacaacgaggccagcgggggccggttcgtgccgcgcgccgtgctcatggacctcgagcccgggaccatggactccctgcgctcgggccccttcggccagatcttccgccccgacaacttcgtcttcggccagtccggcgccggcaacaactgggccaagggacactacaccgagggcgccgagctcatcgactccgtcctcgacgtcgtccgcaaggaggccgagaactgcgactgcctccagggtttccaagtctgccattccttgggaggtggcactggatctggcatgggcacccttcttatttctaagattagggaggagtaccctgatagaatgatgttgaccttctctgtattcccatcaccaaaggtttcagatactgttgtggagccatacaatgctacactttcagttcaccaacttgttgagaatgctgatgaatgtatggtgcttgacaatgaagctctgtatgacatatgcttccgcacgctaaagctcgccacacctacctttggtgacctgaaccatcttatctctgctaccatgagtggcgtcacatgctggctg

SEQ ID NO: 13593 - protein, 239 aa, Panicum virgatum
  misc_feature: Ceres CLONE 1769945
  misc_feature (45)..(238): Pfam Name: Tubulin Pfam Description: Tubulin/FtsZ family, GTPase domain
  misc_feature: Useful for making plants with modulated flowering time
MREILHIQGGQCGNQIGAKFWEVICDEHGIDATGRYAGDSDLQLERINVYYNEASGGRFVPRAVLMDLEPGTMDSLRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCW

SEQ ID NO: 13594 - DNA, 1750 bp, Panicum virgatum
  misc_feature: Ceres CLONE 1769948
  misc_feature: Encodes the peptide sequence at SEQ ID NO. 13595
cccggcgcgggccacgccagattcgaatcaaacaagccagcaatccctcgagtaaaagaagcgggcaggaatctcggcgaggttcccggccggcgcgtggcgcgcagctgcggtgcggcgccctttatcgatggtgagcggcggcggcgcgggggaggagagcgcgcgcgggcgcggcggcggcgcggcgctgctgggcgcgtacgagctggggcggacggtcggggagggcaacttcggcaaggtgaagcaggcgcggcaccgcggcacgggcgcgctcttcgccgtcaagatcctggaccgcgcccgggtcctctcccagcgcatcgccgaccagatacgccgggagatcgccacgctcaagctgctccgccaccccaacgtcgtccgcctgcacgaggttgctgctagcaagaccaagatttacatggtgctcgagtttgtcaacggcggcgaactgttcgacaggattgccatcaagggaaaactctcggaggaagaaggaaggaggctatttcagcagctgatcgatggtgtcagctactgccacgaaaagggcatctaccatagagacctcaagcctgagaacgttcttgttgaccggaagggcaacatcaagatatctgattttggcctcagtgctttaccacaacatctcgggaatgatgggttgctgcatacgacctgtggtagccccaattacattgctcctgaggttctgcagaacagaggatacgatggatccttgtcagatatctggtcttgtggggttattctttatttgatgctcgtaggataccttccgtttgatgaccggaatatcgttgttctttatcagaagattttcaagggtgacactcagatcccaaagtgcctttctcctggcgcacaaaatcttctccagcggattcttgagcccaacccgatgaagcggatcacaatggctgaaatcaaggcacatgagtggttccagagggattatgttcctgcagttccattcgacaacgatgatgaagattcacagcttgacctggtccttccagtcaaggaggaaattaatccatcacctggggatcatcagatcaatgcttttcagttgattggaatggcatcatcccttgacctctcagggtttttcgaagaagaggacgtgtcccagaggaagatcagattcacaacaacacacccacccaaggatttgtttgacaagattgaacgttctgcaagcgaaatgggcttccaagtacagagggggcacggcaagctcaaagtaacgcaaaactacactggaacaaagaatcctaaaaacccagcttcatttcttgtctgcaccgaggtgtttgatcttggcccctctttgtacgtcgtagagatcaagaagtcccatggagaccctgcattgtacagaaagctctgcgagaggatctgcagtgagttgggcgtgctgatggagcagatcttcgggacacggccggttgccgatgatcttgcgagcttggacagtcgatccgggacgcctttggtggcattgtgacgaagtctgcccgttgccgtgatgtagcgtgagatctagggaagacgaagcagttcagctgcaatgcagctaggaacgagtgtactgtaagtaggatcaaaattcgcctgaaaatagagatgtcaaaatagtgcaggatcataatgtgtaaaagaagcagcagccactgacgtcaaaccgaatgtcaaatctaataaatggattgtattcggtggc

SEQ ID NO: 13595 - protein, 467 aa, Panicum virgatum
  misc_feature: Ceres CLONE 1769948
  misc_feature (25)..(280): Pfam Name: Pkinase Pfam Description: Protein kinase domain
  misc_feature (314)..(374): Pfam Name: NAF Pfam Description: NAF domain
  misc_feature: SWISSPROT Homolog: EC 2.7.11.1 Non-specific serine/threonine protein kinase
MVSGGGAGEESARGRGGGAALLGAYELGRTVGEGNFGKVKQARHRGTGALFAVKILDRARVLSQRIADQIRREIATLKLLRHPNVVRLHEVAASKTKIYMVLEFVNGGELFDRIAIKGKLSEEEGRRLFQQLIDGVSYCHEKGIYHRDLKPENVLVDRKGNIKISDFGLSALPQHLGNDGLLHTTCGSPNYIAPEVLQNRGYDGSLSDIWSCGVILYLMLVGYLPFDDRNIVVLYQKIFKGDTQIPKCLSPGAQNLLQRILEPNPMKRITMAEIKAHEWFQRDYVPAVPFDNDDEDSQLDLVLPVKEEINPSPGDHQINAFQLIGMASSLDLSGFFEEEDVSQRKIRFTTTHPPKDLFDKIERSASEMGFQVQRGHGKLKVTQNYTGTKNPKNPASFLVCTEVFDLGPSLYVVEIKKSHGDPALYRKLCERICSELGVLMEQIFGTRPVADDLASLDSRSGTPLVAL

SEQ ID NO: 13596 - DNA, 2242 bp, Panicum virgatum
  misc_feature: Ceres CLONE 1769949
  misc_feature: Encodes the peptide sequence at SEQ ID NO. 13597
aaggatccccaattccttactgctcctccacaactagaccggcaaggcggatccgcgacggcccgcggacgacgagtcgacgacggcgaggtggatctgcgacggggcgcggccggcgaggcggatcaacgtcagggagcagccggcgcggctaggacgggccgcggccggcgaggcggatccgcgtcagggagccgccggcgcggcgtggggacctcgggcgacgcggggaggagcgggcggcgtttgcgtcggctgtttgagaagcgactgtttgggtccgtgaccctttcctttcgcgcgggctccgtttgttggagatagtctgagcagcaggatcgagcggacagcggggcagccaggcggcaggcgcgcacgggcagcaacgccgcgggtctcggcgatgctttgcgggcgggcgtgaagggcgtgcgcaaacgagctgaggcgtccaattccctgcgcctgggcgtgagctcggttgccggagccaggcagcgcggaccggcggcgatgagcggcagcggtggaggagtcggcggcggtgccggcgggagccccaacaacacggagtggcgcttcaaccagactctccgcaacgtgcaaggcatgcttaaaggacgcagctttcccggaaaggttttgctaactcggcgatctgagcctctttcccctcctgattattctccaagatttgagagtgagcatgatgaagatgagcacaagggaggttctcaggagggagaaggccaggcacctggaaactcatttgacagtgcaagtgcaaagaaatcaaatattctgtcaacaagtagctcaaattcattaccagatgcccaagggctagtttctggggctagagctacagattctgcaagaattgataaattcacaaaggaactctctaggccagctgttatattagacaatttgcgtgaattatcttggagtggtgtgccgccatatatgcgacctaatgtatggaggcttcttttgggttatgcaccacctaataaagatagacgagaaggtgttctaacaagaaaaagactagagtatgtggaatgtgtttctcaatactatgatatccaggatagtgaacgcgcggatgaagaaattactatgcttcgccagattgcagttgattgcccaagaactgtacctgatgttaccttttttcagaatcctcaaattcagaaatctctcgagcgcattttatatacatgggctattcgtcacccagcaagcggctacgtccaaggaataaatgaccttgtcacaccgttcttggtcgtgttcttatctgagcacctagagggcaacatggacagttggtctatggacaatctttcaggacaggacatttctaacatagaagcagactgctattggtgtctctcgaagtttcttgatggaatgcaggatcattacacatttgcacaaccaggaattcagcgtcttgtttttagattgaaagaactagtttgtcgtatagatgaacctgtatccaagcatattgaagaacaaggactagagtttcttcaatttgccttccgttggttcaactgccttctgatacgggagataccttttcatcttgtcacacgcctgtgggatacatatcttgctgaaggagattatctgccagattttctcgtgtacatctcggctagttttctgttaacttggtcggacaagctgcagaaactggattttcaggaaatggtgatgttccttcagcaccttcgcacaaggacctgggcacaccacgagcttgagatggtcctctccagggcttacatgtggcacacgatgttcaaaagctctcccagccaccttgccagctaggaacctgttcgatgcctgtaagaagcaacaggcctcgtgttcctgccttggagttatatatcaccctgctagggcttttctgggtctatttttgtcaagctcatgatattggttgtatccctccgatttgtatattttaccgaggaatcgagatctgcgatggaaatcgaagaagaatattgtttgccattgtatggtagcttgaggcatatcaaattctctttcctcgttgtacctgataggctgatacacacacagttactccaatccaacaccatgagagttttttttttttgtttttttttctgaccacctatttgtagcttctgggacgctgtatcctttctttcttgtgctggtatcagattctggtcgagctgaaccaggttgctcg

SEQ ID NO: 13597 - protein, 444 aa, Panicum virgatum
  misc_feature: Ceres CLONE 1769949
  misc_feature (144)..(398): Pfam Name: TBC Pfam Description: TBC domain
MSGSGGGVGGGAGGSPNNTEWRFNQTLRNVQGMLKGRSFPGKVLLTRRSEPLSPPDYSPRFESEHDEDEHKGGSQEGEGQAPGNSFDSASAKKSNILSTSSSNSLPDAQGLVSGARATDSARIDKFTKELSRPAVILDNLRELSWSGVPPYMRPNVWRLLLGYAPPNKDRREGVLTRKRLEYVECVSQYYDIQDSERADEEITMLRQIAVDCPRTVPDVTFFQNPQIQKSLERILYTWAIRHPASGYVQGINDLVTPFLVVFLSEHLEGNMDSWSMDNLSGQDISNIEADCYWCLSKFLDGMQDHYTFAQPGIQRLVFRLKELVCRIDEPVSKHIEEQGLEFLQFAFRWFNCLLIREIPFHLVTRLWDTYLAEGDYLPDFLVYISASFLLTWSDKLQKLDFQEMVMFLQHLRTRTWAHHELEMVLSRAYMWHTMFKSSPSHLAS

SEQ ID NO: 13598 - DNA, 2015 bp, Panicum virgatum
  misc_feature: Ceres CLONE 1769955
  misc_feature: Encodes the peptide sequence at SEQ ID NO. 13599
ttccctctactgcaccgagttctcctcttctccttcccggccgcgccacgcacggcacgccatcgccgcggcggaggcccgcgagaccggccggccagcgccggccttgtcgcggtcagtaccctcgcctcgcctcgacctccccttcgcctccccctattccctcccggcaatattctctcgcccgatccctcagcttcacccgcccgaaggcgatcccaatcccagatccggccagcgactcacccagctctatcccactcccacggcaggctcccaggtgactcccgcgatcggcccccgccggcgcgcggcgcacggctcgactggagtagcggcgcccccgacccctggttgcggttgtcgaggatgagcgggaggaagaatgccggcaggacctccccctggctgctcatcctcatctccgcagggtgcttcttcgcgacctacaacttcctgacgatgcacggccggggccgggacgggccgcgcaagcggttccacgtcgcgctgacggcgacggacgcgctctacagccagtggcagtcccggatcatgtactactggtgcaaggagatgagggaccgccccggctccgacatgggcggcttcacacggatccttcactcggggaaacctgatgggttgatggacgagatgcccaccatggtggtggacccgcttcctgaaggcacggataagggatacattgtcttaaataggccttgggcatttgtccagtggctgcagagagcaaagattgatgaagagtatgtactaatggcggagccagatcatgtctttgtgaagcctttgccaaacttagctcatggtgatgaaccagcggcgtttccatttttctacatcaacccaactcagaatgagaagatattgcggaagttttttccagaagaaaaagggcctgtctcaaaaattgatcctattggcaactctccagtaataataaagaaggcccaacttgagaagattgctccaacctggatgaatgtttcattaaaaatgaaagaggatcaggatacagacaaagcttttggatgggtcttggaaatgtatgcatatgctgttgctagtgcactgcatggtgtgcaccatagtctccgtaaagatttcatgattcagcctccttgggacctaaaaacagacaacacattcattatccattatacatatggatgtgattatacaatgaagggtcagctaacttatgggaaaattggtgaatggcgttttgacaaaagatcttatcttgaatcaccaccaccaagaaatctttcactaccccctcctggagttcctgaaagtgtggccacccttgtgaagatggtgaatgaggccactgcaaacattccagggtgggaggatgagagataatatgatggcttggctgagttgtagcttattttagctcctagctggtatggtttttgttggaaaacatagaggaataccacgggtgaataaaagaagagtgttcaattcatatctgaagtctaggactgtgtccaattttccacagtttaacctaggttagtgttcgggaagaaaaagatatattcactttgatctagtgagttgcatcgtttttgtattgtaaagcagaaatataggcttctggctacttttggttcatttagttagccgtgttgtaaagcagagatgtagtttagacttcagagtcctccaaccatgagaggtttgttattagtcatcttgggaaaagttctggtggatgctgccaacatcctgctgagtgctatcactggaaaccaccaaagactttcagaaataatctagtgtacctagataaaaatatttgatgatcaggttttttgctttcgaacctatgtgtgtaatacagctgttgtctttgtagtacttactgtactactccctccatcgaaatatgatagatatatttctatatggcacaatgaccaagggcaccaagtgtgcttatcaatctcataaatgcaacatagattttttgttggtct

SEQ ID NO: 13599 - protein, 340 aa, Panicum virgatum
  misc_feature: Ceres CLONE 1769955
  misc_feature: Useful for making plants with modulated drought sensitivity
MSGRKNAGRTSPWLLILISAGCFFATYNFLTMHGRGRDGPRKRFHVALTATDALYSQWQSRIMYYWCKEMRDRPGSDMGGFTRILHSGKPDGLMDEMPTMVVDPLPEGTDKGYIVLNRPWAFVQWLQRAKIDEEYVLMAEPDHVFVKPLPNLAHGDEPAAFPFFYINPTQNEKILRKFFPEEKGPVSKIDPIGNSPVIIKKAQLEKIAPTWMNVSLKMKEDQDTDKAFGWVLEMYAYAVASALHGVHHSLRKDFMIQPPWDLKTDNTFIIHYTYGCDYTMKGQLTYGKIGEWRFDKRSYLESPPPRNLSLPPPGVPESVATLVKMVNEATANIPGWEDER

SEQ ID NO: 13600 - DNA, 369 bp, Panicum virgatum
  misc_feature: Ceres CLONE 1769960
  misc_feature: Encodes the peptide sequence at SEQ ID NO. 13601
ccgccccgaccccggccgagccgcggggcgccgcggcgtttttgaacggcagcggcggccgccgcgcggtggagaaggacccgatcaagcttttttttcgctaccccgagtggctctaccagcacaaggagctcggcctcgtcgtcgacgtcagccgggtggggttcacggaggagttccttcagcagatggagccgcggatgcagcgcgccttcgccgacatgcgggagctcgagaagggcgccatcgccaaccccgacgagggccgcatggtggggcactactggctccgcgacccgaccctcgcacccaactccttcctccgcaacaagatcgagaccgcgctcgacagcgtcctcgccttctccc

SEQ ID NO: 13601 - protein, 122 aa, Panicum virgatum
  misc_feature: Ceres CLONE 1769960
  misc_feature: SWISSPROT Homolog: EC 5.3.1.9 Glucose-6-phosphate isomerase
  misc_feature: Useful for making plants with modulated flowering time
APTPAEPRGAAAFLNGSGGRRAVEKDPIKLFFRYPEWLYQHKELGLVVDVSRVGFTEEFLQQMEPRMQRAFADMRELEKGAIANPDEGRMVGHYWLRDPTLAPNSFLRNKIETALDSVLAFS

SEQ ID NO: 13602 - DNA, 630 bp, Panicum virgatum
  misc_feature: Ceres CLONE 1769961
  misc_feature: Encodes the peptide sequence at SEQ ID NO. 13603
acctggccactagccaactcgaccccttcgccaaatctctcgtcacagcagtcctcttcctctccggctttggcgatgtctgggcgcggcaaggggcttggcaagggcggcgccaagcgccaccgcaaggtgctccgcgacaacatccagggtatcaccaagccggcgatccggaggctggcgaggaggggcggcgtgaagcgcatctccgggatcatctacgaggagacccgcggcgtgctcaagatcttcctggagaacatcatccgcgacgccgtcacctacacggagcacgcccgccacaagaccgtcaccgccatttacgtcgtctacgcgctcaagcgccagggccgcaccctctacggattcggcggttgatcgcgtccgctccctcgtctgcagctgctggcggtggtgcctgactgcttgttcatttgggttatccgtgctgtgcttttcgtttggtgatgtagagatatatcagattcgtagatctgtgctgtattttgttcttagtaggtggatgtgaagtacgggtctagaagttccaactgccagttgtatcccagtttcgtttcgtttcctcgtatcctttgcattgcagcaatgaaatgttaacctcgatctgct

SEQ ID NO: 13603 - protein, 100 aa, Panicum virgatum
  misc_feature: Ceres CLONE 1769961
  misc_feature (22)..(91): Pfam Name: Histone Pfam Description: Core histone H2A/H2B/H3/H4
MSGRGKGLGKGGAKRHRKVLRDNIQGITKPAIRRLARRGGVKRISGIIYEETRGVLKIFLENIIRDAVTYTEHARHKTVTAIYVVYALKRQGRTLYGFGG

SEQ ID NO: 13604 - DNA, 1504 bp, Panicum virgatum
  misc_feature: Ceres CLONE 1769962
  misc_feature: Encodes the peptide sequence at SEQ ID NO. 13605
gcttggcttcgcttcctcacttccttgcttttattgtcacgcgcgcccatccccaacccaaaaccctagccgccgccgccgcctgctgaggacatgcctccactgctcaggggcgcaagcgttgtgtgacacccgcgtgggataaaggttattcagcacgtgctgctctctccgccgcgccggcatggaggagaggccatagatcgccggacctcgcctccgccgccgccggacgcggcggcggagaaggatgaggcctcccagggtctgcacctaccggaggacatccggtgggagcgtctcgacaaggcgcgcttcttcgtcctgggagccgggctcttctccgccgtctcggccgcgctctaccccgccgtcgtcctcaagacgcgcctccaggtcgccccggtggcagcgacgggggcggcagcgctccctccctcggctttcggcgcggccgccgccatcctgcgccgggagggggccctcgccttctaccgcggcttcgccacctccctcgccggcaccgtcccggcgcgcgcgctctacatgggcgcgctcgaggccacccgctccgccgtcggccccatcgcgctcagcctcggcgcaccagagcccgccgcgtcagcggctaccggcgcggccgcgggcctcgccgccgccgttgctgcgcagatcgtgtggacacccgtcgacgtgatcagccagcgcctcatggttcagggcaatccctgccccgcctcccgctaccgtggcggcgtcgacgccttccgcaagattgtaggttcggacggcctgcgtggtctgtaccgtggcttcggcatgtccatcctaacctatgccccctccaatgccgtgtggtgggcgacttactcactgtcacagaagataatttggagtgggattggctgctacttgtgcgagtatggtgttggtgttcaagaaattgatcttggcaatggggattcttcgctgcagccaggttgcaagactgttatggtagtgcagggagtgagtgctgcaatggctggcggcgcgtcagcgcttgtgaccatgccactggacaccatcaagaccaggatgcaggtcatggatggggacggtgagccgattaccgtggggaggacagtgcggaggctgatcaaggaaggcgggtgggctgcttgttacagggggcttggcccaaggtgggcgtccatgtcattgtccgccaccaccatgatcaccacctatgagttcctcaagcggctctcagacaagggccaggagagcggccttgcatgatgtttgatgacaagtatagacgacagtaatcaggtgcctttgtttcttaagttcaatttcaacactcaatatgttacgtgttgaaaaaaatggtgatcaaatgtctgtagatatcttcgtttgttcctctaatcaagtttccatatcagtctaattcacgttgtttacacattattgttcccttgttctgttgttctagttgcatttccttgcattattcagc

SEQ ID NO: 13605 - protein, 244 aa, Panicum virgatum
  misc_feature: Ceres CLONE 1769962
  misc_feature (26)..(119): Pfam Name: Mito_carr Pfam Description: Mitochondrial carrier protein
  misc_feature (149)..(238): Pfam Name: Mito_carr Pfam Description: Mitochondrial carrier protein
MGALEATRSAVGPIALSLGAPEPAASAATGAAAGLAAAVAAQIVWTPVDVISQRLMVQGNPCPASRYRGGVDAFRKIVGSDGLRGLYRGFGMSILTYAPSNAVWWATYSLSQKIIWSGIGCYLCEYGVGVQEIDLGNGDSSLQPGCKTVMVVQGVSAAMAGGASALVTMPLDTIKTRMQVMDGDGEPITVGRTVRRLIKEGGWAACYRGLGPRWASMSLSATTMITTYEFLKRLSDKGQESGLA

SEQ ID NO: 13606 - DNA, 1622 bp, Panicum virgatum
  misc_feature: Ceres CLONE 1769963
  misc_feature: Encodes the peptide sequence at SEQ ID NO. 13607
attccgccgaacacctctcgggctttcgtcccaccaccgcctcgatgccgccggctaaccccacgccgaccaaatggccgaagaacctcacctcagaccacctccaccgcctgatccgcgccgagcgcgacccgcgccgcgcccttgcgctcttcgacgctgccaccggcgccgcgtccactcctgcgcccgaccccatcaccccgtctccggacaccgtgtctctgctcacctcccgcctcgcctccgccggccacctccccctggccgcctccctcctctcgcgctcgcgtgggttcttcccctccgccgccgcgcttgagggcccattcctcaccctcctccgcgccttctcccgcacgcaccgcccgctcgccgctctccacctcttccgctccgccccctccgacctcgcgctcccccactccgctcgctcctacaccgccgtcctcgccgctctcgtcgcgcactcgcagctccatctggcccgctccctcctcgctgacatgcgcgccgccggattcgcccccaccgccgccacctacaacgtccttctcaaggcccactgctctgacgccagcacccccatcgaagacgctctccgaattttccggaacatccgcaaacccgacgcctgctcctacaataccatcatcgatgggctctgccgccgtggccgcctggccgaggccctcgagctgttttccgagatggtagggaaatgcattgcacctactgttgttacttacaccactgttatccactggctcgcacgggagggttgctttgatgatgctttaaaaatattcgatgaaatggggaggagagggatctcacctaatttggtcacttatagttcgctaattgacggtttgtgtaagggtggacgtgcatcatcagcattggaattgctggattggatgatcaaggagaagaagctgccaaatatgatcacatatagctcggtgattgacgggctctgcaaggaacacaggttgaatgatgcaatggaggtcttggaccggatgcgtctacaggggcggaagcctgatgctggattgtttgggaagctaattgttgggctatgtgatgcagggagggctgtggaggctgcaaattacctggatgagatggttcttgctggtattgaacccaaccgggtgacttggggcctgcatgccaagataaacaatactgtgctgacagtgttgtgcactaagggtgaactagtcagggcttttcaggtctaccagagcgcaagaactcggagcatttctaccgagccaaccactttccatcttcttgttgagagcttatccaaaaataacaatttagagaaagctgctcatgttgtgcttgacatgctgtcagagagatgcattcctgaaagggagacatgggatgttgttatcagtgggtactggggtaagaagaaggtgagacaagaagccgaggagatatggagccagctaactgttagttgatttgagaaatatggcactatgctatgttattacttaatgttgctagcataaagtatgcatcttggccagcttactcttcaggtatcgtgtgatgatttctcccctttgccattatgtataaaagatatattgcagacc

SEQ ID NO: 13607 - protein, 479 aa, Panicum virgatum
  misc_feature: Ceres CLONE 1769963
  misc_feature (233)..(267): Pfam Name: PPR Pfam Description: PPR repeat
  misc_feature (198)..(232): Pfam Name: PPR Pfam Description: PPR repeat
  misc_feature (303)..(337): Pfam Name: PPR Pfam Description: PPR repeat
  misc_feature (268)..(302): Pfam Name: PPR Pfam Description: PPR repeat
  misc_feature (338)..(372): Pfam Name: PPR Pfam Description: PPR repeat
MPPANPTPTKWPKNLTSDHLHRLIRAERDPRRALALFDAATGAASTPAPDPITPSPDTVSLLTSRLASAGHLPLAASLLSRSRGFFPSAAALEGPFLTLLRAFSRTHRPLAALHLFRSAPSDLALPHSARSYTAVLAALVAHSQLHLARSLLADMRAAGFAPTAATYNVLLKAHCSDASTPIEDALRIFRNIRKPDACSYNTIIDGLCRRGRLAEALELFSEMVGKCIAPTVVTYTTVIHWLAREGCFDDALKIFDEMGRRGISPNLVTYSSLIDGLCKGGRASSALELLDWMIKEKKLPNMITYSSVIDGLCKEHRLNDAMEVLDRMRLQGRKPDAGLFGKLIVGLCDAGRAVEAANYLDEMVLAGIEPNRVTWGLHAKINNTVLTVLCTKGELVRAFQVYQSARTRSISTEPTTFHLLVESLSKNNNLEKAAHVVLDMLSERCIPERETWDVVISGYWGKKKVRQEAEEIWSQLTVS

SEQ ID NO: 13608 - DNA, 2721 bp, Panicum virgatum
  misc_feature: Ceres CLONE 1769972
  misc_feature: Encodes the peptide sequence at SEQ ID NO. 13609
attaatggggtgctcatcctcctgacctcctcgtcctccccctcctctcctcctccccgccgggtcgcggtcggctccgccttttaaccgccttgccctggagggggccgagcggcggaccgcacgggcgcacgaccgcggggggaccggagcaggacccggaaccctagtggcggccgcgcgcgccatgggcatcgatctcaacatggtggacggcgagggcgaggagcggcgccccccgccggcggtgtgccgggacctgtggcacgcgtgcgcggggcccgtagtcgcgctgccgcggcggggcagcctcgtcgtgtacctgccgcagggccacctcgctgcggctggcggcggggacgtcgcggcggacctgccgccgcacgtggtgtgccgcgtcgcggacatcgagctatgcgcggatgcggcgacggacgaggtgtacgcacggctggcgctggtggcggagggtgaggcatttgggagaaatgtgcgtgttggtggagttgaaggggacgaggacatggaggattttgatgctgaaaggaagtcccggatgctgcacatgttctgcaaaacgctcactgcctctgacacaagcacgcatggagggttctctgttcctcgtcgagctgctgaggactgtttcccaccgctggactataatcaactcaggccttctcaagagcttgttgccaaggatttgcatggagccaagtggaagtttcgtcatatttataggggtcagcctcgtaggcatctcttaacaactggatggagttcatttgtcaataaaaagaaactggtttcaggggatgcagtcttatttctccgaggtgatgatggtgaactaagactgggtgtaaggagagctgttcagcttaaaaatgaggccctttttgaagaattcagtagcgacagtgcaaagcgacatacgttgtctgctgtatataattccttgaaacataaaagtgtctttcacatttcttacaatccaagagttgctgcttcagaatatataattccttaccggaagttccttaagagcctcaaccatccagtctgtattggagcgaggatcaacttccaatgccagaatgaagatgttagtgaaaggcgatctggaatggttgttggcaatagtgaagtagatcccatgaaatggcctggctcaaagtggagaagcctgctggtaagatgggaggatggttctgaatgcaatggccaagatagagtatctccatgggagatcgatatagttggtggctcagtctctgctgcccattctctgtccgcatctagttctaaaagaaccaagttatgccctccgggaaatttggacgttccaacaatgtggaatggttgtactgactccgtggaaactggaaagttacccagggtcttgcaaggtcaagaattgatgggttttaggactcatcgtgttacgtgtgctcctcaaacagctgaggttgcaaaatttcaatcttctgatgctagtaggttccttactaatgcacgaagctgcatgttgagtggtccaacaggcagacttgcagtacagaactctggctttacctaccaatctctgggcttcagtgaatctattggattctcagaggtcttgcaaggtcaagaaatttctcaggcagttcctatgttccaaggaatgatatctgcggcatgttcactgaagggcggatatgggctgcgtggttatgtgcataccccagctgctgttaatggattatcagccacagctcaagaatgttctctcacactatgtactccacctgcagcacaagtgccccctcctcatcccaatcatatgtttaaccaaactgtgtcgtcccagcttggattgggaaacaagtctgctggcgaagttgcaaatggcagtcagcctcgcccatttgatatgtcgtgggaagctcagaccaggccacagcatgaaatacctgctcaaattagcttggatcaatttgaggctaggagagcttcagcacctggagatgctgctaaaattgggtctggtggaagggaggtgcgcaaaactagctgcaggctttttggtttctcattgactgagaagatcttgccagctgatgatgatggcgtgaaggaagtgagttatgaggctgagtgccagaatccacggatgctggacttgttcgggtacaactgctccaccccaagtgctgctcttccagctctctgtgccgcccccttcggaatgtgatgctactttagtaatctttccaagtattttcaagcactcagattagacgtactttcccagtaccccagtgtgtgcataagctgtcttttgacctcattccctccattggcctgctcatgttaatcagtcatctgcacgagtcaaggaaggatgattggtgaaccattcctctgcatggctcacctggccacccaaagtattatggttgtgtatcgtgatatgcaccattgtaacttttgtggctatccttcagacccattgtgcgatgaagctaacgatgtgccctaaaagtacttcgctcacagatttggattcatgggaaggtctgtcagctttgatgtaccggttatgtgtctttaactgagctcctgtatgacttttgtagctcagtcatgagccgtgtttgcactggtgcctaggtcgtgtgattgtatcagtatgtaagactattgcttcgtttcaagatatgttgcttatggaccttt

SEQ ID NO: 13609 - protein, 682 aa, Panicum virgatum
  misc_feature: Ceres CLONE 1769972
  misc_feature (127)..(232): Pfam Name: B3 Pfam Description: B3 DNA binding domain
  misc_feature (254)..(335): Pfam Name: Auxin_resp Pfam Description: Auxin response factor
  misc_feature: The sequence is a functional homolog of SEQ ID NO 696 in the 11/479,226 US patent application
MGIDLNMVDGEGEERRPPPAVCRDLWHACAGPVVALPRRGSLVVYLPQGHLAAAGGGDVAADLPPHVVCRVADIELCADAATDEVYARLALVAEGEAFGRNVRVGGVEGDEDMEDFDAERKSRMLHMFCKTLTASDTSTHGGFSVPRRAAEDCFPPLDYNQLRPSQELVAKDLHGAKWKFRHIYRGQPRRHLLTTGWSSFVNKKKLVSGDAVLFLRGDDGELRLGVRRAVQLKNEALFEEFSSDSAKRHTLSAVYNSLKHKSVFHISYNPRVAASEYIIPYRKFLKSLNHPVCIGARINFQCQNEDVSERRSGMVVGNSEVDPMKWPGSKWRSLLVRWEDGSECNGQDRVSPWEIDIVGGSVSAAHSLSASSSKRTKLCPPGNLDVPTMWNGCTDSVETGKLPRVLQGQELMGFRTHRVTCAPQTAEVAKFQSSDASRFLTNARSCMLSGPTGRLAVQNSGFTYQSLGFSESIGFSEVLQGQEISQAVPMFQGMISAACSLKGGYGLRGYVHTPAAVNGLSATAQECSLTLCTPPAAQVPPPHPNHMFNQTVSSQLGLGNKSAGEVANGSQPRPFDMSWEAQTRPQHEIPAQISLDQFEARRASAPGDAAKIGSGGREVRKTSCRLFGFSLTEKILPADDDGVKEVSYEAECQNPRMLDLFGYNCSTPSAALPALCAAPFGM

SEQ ID NO: 13610 - DNA, 833 bp, Panicum virgatum
  misc_feature: Ceres CLONE 1769977
  misc_feature: Encodes the peptide sequence at SEQ ID NO. 13611
ttatttttcaagaaagaagaaaatcaatcccctgcatatgctcttggtgagattgatgaaggtgctccaggtgctgaaaatgaaaaggctggtattgtaaatcaacaaaaattagaaaagaaatttggtcagtcttctgtttttgtcacgtccacacttcttgagaatggtgggaccttgaagagtgcaagtccagcttctcttttgaaagaagccatacatgtcatcagttgtggttatgaagacaagactgactggggaaaagagattggctggatctatggatcagtcacagaagatattctaactggcttcaagatgcattgtcatggttggcggtccatttactgcatacctaaacgacctgcattcaaaggttctgcacctctgaatctttcagatcgtcttcaccaggttcttcgatgggctcttgggtctattgaaattttcttcagcaaccattgccctctttggtatgggtatggtggtggtttgaaatttttggaaagattttcctacatcaactccatcgtatatccttggacgtctattcctctgttggcttactgtacattgcctgccatctgtttgctgacgggaaaatttattactccagagctaaacaatgttgccagcctctggttcatgtcactttttatctgcatctttgctacgagcatcttagaaatgagatggagtggtgttggcattgatgattggtggaggaatgagcagttttgggttattggaggtgtgtcctcgcacctttttgctgtgttccaaggacttctcaaggtcataactggtgtggatacaagcttcactgtgacatc

SEQ ID NO: 13611 - protein, 277 aa, Panicum virgatum
  misc_feature: Ceres CLONE 1769977
  misc_feature (1)..(277): Pfam Name: Cellulose_synt Pfam Description: Cellulose synthase
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: The sequence is a functional homolog of SEQ ID NO 6 in US patent 7285702
  misc_feature: Useful for making plants with altered carbohydrate content
  misc_feature: Useful for making plants with modulated biomass
  misc_feature: Useful for making plants with altered cell wall content and/or composition
  misc_feature: The sequence is a functional homolog of SEQ ID NO 2 in US patent 7049481
  misc_feature: Useful for making plants with modulated plant growth and development
LFFKKEENQSPAYALGEIDEGAPGAENEKAGIVNQQKLEKKFGQSSVFVTSTLLENGGTLKSASPASLLKEAIHVISCGYEDKTDWGKEIGWIYGSVTEDILTGFKMHCHGWRSIYCIPKRPAFKGSAPLNLSDRLHQVLRWALGSIEIFFSNHCPLWYGYGGGLKFLERFSYINSIVYPWTSIPLLAYCTLPAICLLTGKFITPELNNVASLWFMSLFICIFATSILEMRWSGVGIDDWWRNEQFWVIGGVSSHLFAVFQGLLKVITGVDTSFTVT

SEQ ID NO: 13612 - DNA, 2019 bp, Panicum virgatum
  misc_feature: Ceres CLONE 1769981
  misc_feature: Encodes the peptide sequence at SEQ ID NO. 13613
aaaatccgcttcccggcccaaaccaacccaccaaaccctagctcgtcgaattagaaaaggaaatcccccaccccgccgccgcgagatggccgagcacgacgcgcgctacgagggcaacggcggccccgcccccggggacgcgggcggccacgcccaggccgagcacgccgccgccgccgctggcgggggctccccgcccgccgcggggcccaagcccaccgggttctccgaccacgccgacggccgcgcctcccagccccagcacgagacacagttgcatgacagtggttcctcaaaatcccgagaaagggacagagaacgtgataagggcaaggacagggagcgtgacagggaccgtggccgagagagggagagggaccgggacagggagaaggaccgcgaaagaggtgacaaggacagggatcgtgatcgccaccacagggatcgccgcgagcgcagcgagaaaagggaacaccgtgatcgatccgatgattgtgaccgccaccgtgatgatcgtgaccgtcacaggagccacgattctgaaaggagaagagaccgtgacagagatggccaccgtaggcatcggtcccgctcccgctccccgtctaagagccgtgaccgtgaccatagatctagatctcgttcgcgctctcgttcaaagagcaagcgtatgagtggatttgatcaagcaccgctacaaccgacgttgcctatagctgctgctggtgctgttcctggtcagctgcctggagtcactcctattccagggatgtttccaaacttgtataatttgggacagatcaacccccttgttattcaaccgcaagccatgacacaacaggctactcgacatgctcggcgtgtgtatgttggtggacttcctccaactgctaatgagcagactgttgccatattcttcaatggagttatggcagctattggaggaaacacagctggtccaggtgatgctgttctgaatgtctacataaaccatgataagaaatttgcttttgttgagatgagatctgtggaggaagcaagcaatgcaatggccttagacggcataatgttcgagggagcaccggtgaaggttagaaggccgacggactataatccttccctagcagctgcgctgggcccaagccagccaaaccccaatcttaatcttgctgctgttggcttgatgcctggctctgctggaggattagaaggccctgatcgcatttttgtgggtgggctaccctattacttcactgaggcccaagtgcgggagttgctcgagtccttcggtcctctgcggggatttgatcttgtgaaggatagggaaactggtaactcgaagggctatgcattctgtgtgtaccaggatctttctgttaccgacattgcctgtgctgctcttaacggcatcaagatgggagacaagacccttactgttaggcgggcgaaccaaggaggcgctcagcctaggccagagcaggaaaacatcctgttgcaggcacaacaacaggtgcaaatgcagaaactcgtgtaccaagtcggaggtgcccttccaacaaaagtcgtatgcttgacacaggtggtcacagcagatgaactaagagatgatgaggaatatgaggacattgtggaggacatgagggaagaagggcgcaaatacggtaacttggtgaaagttgtaatcccacggcctgaccccagcggtgctcctgttgctggagttgggaaggtgtttttggaatatgcagatgtggagggttcgaccaaagcgaagacgggcatgcacgggaggaagtttggcgggaaccaggtggtggctgtgttctaccccgaggacaagttcgccgcagagcagtacgatggatgaagttagaaaccaatgctagagttggagtcatggctacacgatgtactgtttttttttttttcatctcagttttttaggaccagaaccattccaacttctcacaattgatttcggaccatactatagtcgtaatccaggaaccattatagccg

SEQ ID NO: 13613 - protein, 593 aa, Panicum virgatum
  misc_feature: Ceres CLONE 1769981
  misc_feature (380)..(451): Pfam Name: RRM_1 Pfam Description: RNA recognition motif. (a.k.a. RRM, RBD, or RNP domain)
  misc_feature (260)..(336): Pfam Name: RRM_1 Pfam Description: RNA recognition motif. (a.k.a. RRM, RBD, or RNP domain)
  misc_feature: SWISSPROT Homolog: EC 2.7.11.1 Non-specific serine/threonine protein kinase
MAEHDARYEGNGGPAPGDAGGHAQAEHAAAAAGGGSPPAAGPKPTGFSDHADGRASQPQHETQLHDSGSSKSRERDRERDKGKDRERDRDRGRERERDRDREKDRERGDKDRDRDRHHRDRRERSEKREHRDRSDDCDRHRDDRDRHRSHDSERRRDRDRDGHRRHRSRSRSPSKSRDRDHRSRSRSRSRSKSKRMSGFDQAPLQPTLPIAAAGAVPGQLPGVTPIPGMFPNLYNLGQINPLVIQPQAMTQQATRHARRVYVGGLPPTANEQTVAIFFNGVMAAIGGNTAGPGDAVLNVYINHDKKFAFVEMRSVEEASNAMALDGIMFEGAPVKVRRPTDYNPSLAAALGPSQPNPNLNLAAVGLMPGSAGGLEGPDRIFVGGLPYYFTEAQVRELLESFGPLRGFDLVKDRETGNSKGYAFCVYQDLSVTDIACAALNGIKMGDKTLTVRRANQGGAQPRPEQENILLQAQQQVQMQKLVYQVGGALPTKVVCLTQVVTADELRDDEEYEDIVEDMREEGRKYGNLVKVVIPRPDPSGAPVAGVGKVFLEYADVEGSTKAKTGMHGRKFGGNQVVAVFYPEDKFAAEQYDG

SEQ ID NO: 13614 - DNA, 1870 bp, Panicum virgatum
  misc_feature: Ceres CLONE 1769983
  misc_feature: Encodes the peptide sequence at SEQ ID NO. 13615
aaccaatcaacctcacaccacctgctgacggtggaatcgcacctgagcacctgcagcagcggagccatggaggaccggctgagcagcctccccgacgacctcctccactccatcctccgcgacctcccgctcaagcacgccgtccgcaccagcgccctctcccggcggtgggtgccccagtggatccgcgcgctcgccgactcaccggtcctcgacttcaccgaccgggacttcgcccgcggccagccgccggcgcgggccgcggccacggtgggtcgctgcctccggctccacgccgagcacggcacgccgctcgacgcgttccgcgtggcgcccgtgtccccgccggggcccggctacggcgcgttcgggcgggacgtcatcgggtgggtcgcggccgccttggccaggggcgccagggaggtggaggtggacctgacgccgccgtcgcgggagggcgccgaccatgggagcgccgcgttcctggatctccccggcgacctgttccaggccaggagctcactggagcggctcgcgctcggtcggctcagcctccgcgccgtcccgctccccgcggccgggctcgccggcctccgctcgctctccctcagccacaccgacgtcaccgatgaggcggtccggggcgtgctcgccggctgccccgcgctcgagtccctgagcctgcggtgctgcgccctcctcaccgcggtgcgcgtcgccggcgagcggctgcgggccctggagctcctgggctgccgggccgtgcgcgagctccgggtcgccgcgcccgcgctcgagtcgttcgccctgtacggcgacgtcatcctgagcaccgccgactggtgcgagtccgtcgccgtcgacttcgccgccgcgccggcgctgcgcgacgtgtacctctcgcacatggtcggcttcgacaccttggaccggaatcacgaccactactaccccttcgtgtaccacgtcccgcaagcccggatcttgacgctctgctccgtcggcttggtggtgccgttgctttcgagggactcggatgatgatgaccgcttcgatcatcttccttatgcgcatgtaaacgccggtgaggatacatacatagacatgcccaacctccaagagctgcagctgctgctgggctccctggaagaagaaattctttctcaggacccgcggttccctgagcgcgtgtactatttcttccaaaacacctcacttccagtcctcgaacggctctttatccgtctttccagcaatcctgcacacggaagcagcagctcggcgacagcgttggcagacgaggacgaggacgacgacgacaaagacatcggattccgctacgagatcgtcctcggccagctgactttcatcaaggttgtgcattttagggggacatggcgcgagcggcggctggtcgtgttcttgctggagagggctcccatcctcgagcagctggtgttggtcatggcggaaggaggaggagccccgggagacgagcgcctggaggacatccaggagtgggtgtcggcgctgcaaaaggcgtcgcgcgaggcgcgcacctccgtgtgccggcccagcgaagacgatagcccgaaccatgcccacacgaggttcttccatgaggactactgctgcaaccatcaagaatgattttatacacgaacaggattgctttgtttgtaacaaaattactagtatgttttaagttgttttaggatgctcgatctgctctgttctagtaccttttaatattgtttcatggttcattgtaatctatagaagaatgcagaagtactgaactttagggggaagtctgtctgcaaggacgtgttgtctctgttcctatgatgatcctatcaacttgctctcc

SEQ ID NO: 13615 - protein, 527 aa, Panicum virgatum
  misc_feature: Ceres CLONE 1769983
  misc_feature (3)..(55): Pfam Name: F-box Pfam Description: F-box domain
MEDRLSSLPDDLLHSILRDLPLKHAVRTSALSRRWVPQWIRALADSPVLDFTDRDFARGQPPARAAATVGRCLRLHAEHGTPLDAFRVAPVSPPGPGYGAFGRDVIGWVAAALARGAREVEVDLTPPSREGADHGSAAFLDLPGDLFQARSSLERLALGRLSLRAVPLPAAGLAGLRSLSLSHTDVTDEAVRGVLAGCPALESLSLRCCALLTAVRVAGERLRALELLGCRAVRELRVAAPALESFALYGDVILSTADWCESVAVDFAAAPALRDVYLSHMVGFDTLDRNHDHYYPFVYHVPQARILTLCSVGLVVPLLSRDSDDDDRFDHLPYAHVNAGEDTYIDMPNLQELQLLLGSLEEEILSQDPRFPERVYYFFQNTSLPVLERLFIRLSSNPAHGSSSSATALADEDEDDDDKDIGFRYEIVLGQLTFIKVVHFRGTWRERRLVVFLLERAPILEQLVLVMAEGGGAPGDERLEDIQEWVSALQKASREARTSVCRPSEDDSPNHAHTRFFHEDYCCNHQE

SEQ ID NO: 13616 - DNA, 725 bp, Panicum virgatum
  misc_feature: Ceres CLONE 1769987
  misc_feature: Encodes the peptide sequence at SEQ ID NO. 13617
attcagctgagtgtgctcgatcatcaagcaatcaacaaagcctcccaattatcctttcatcagatcatcttccttcttccaagatgtcttgcagctgcggatcaagctgcaactgcggctccaactgcaagtgcggcaagatgtaccctgaccttgaggagaagagcagcggcggcgctcaggccaccatcgtcctcggcgtggccccggagaagaagactggccagttcgaggcggcagcggagtccggcgagaccgcccacgcctgcaagtgcggtaacagctgcagctgcgacccctgcaactgctgatttcgatgggggaacgtcagaacacacctgcatgcatgcatgctagctactacctactactctgcttgtgtgtgacttgatgattgaacaagaataaggatgagcctgagccatcatgtctcatgtatcggtttggctccggcctcatcaagcatgcatgcgtcgcctgcccctctgtgtgctttgcgtccgtcctgtgtctgtatgtgttgatcattgcaaagaaaccatgcaggcatacatctctgcatgtgtctctgtaatgatcggtccagagtgatgaatatataaaaacctccgtccgcctcgccgcccccctcgatcccagatttcccggagccccggcgcccatgggggccgccacggcggcgctccggcgcggggtgctggacctggaggcgcagttcgccttct

SEQ ID NO: 13617 - protein, 75 aa, Panicum virgatum; identical to SEQ ID NO: 12252
  misc_feature: Ceres CLONE 1769987
  misc_feature (1)..(75): Pfam Name: Metallothio_2 Pfam Description: Metallothionein

SEQ ID NO: 13618 - DNA, 637 bp, Panicum virgatum
  misc_feature: Ceres CLONE 1769990-R
  misc_feature: Encodes the peptide sequence at SEQ ID NO. 13619
ctttattgatgagattgatgcagttggaacaaagagatatgatgctcattcaggaggagaacgtgagattcaaagaactatgttggagctgctgaatcagctagatggttttgactcacgtggagatgttaaagttattctagcaacaaaccgcattgaaactcttgatccagctttgcttcggccaggtcgtatagaccggaagattgaatttcctctgccagatattaaaactaggcgtcgcatcttccagatacacacctcaaaaatgacgttagccgatgatgtgaacttggaagaattcgtgatgacaaaggatgagttctcgggggctgatatcaaggctatttgtacggaagctgggttgctagcattgcaagaacgtagaatgaaggtgacccatgcggatttcaagaaggccaaggagaaggtgatgtacaagaaaaaggaaggcgtcccagatggtctctacatgtgatcccgtcattgtcaggacaagctatctttattgtagtagcactttctcttcatcatgggagatatgtgggcttgtttgtcatagtacttgtcgcactcagtttggaaaacatgtattatccttcgatttatttgaagtaagaaaattccctttgagcgg

SEQ ID NO: 13619 - protein, 158 aa, Panicum virgatum
  misc_feature: Ceres CLONE 1769990-R
  misc_feature (1)..(126): Pfam Name: AAA Pfam Description: ATPase family associated with various cellular activities (AAA)
  misc_feature: SWISSPROT Homolog: EC 3.6.4.3 Microtubule-severing ATPase
FIDEIDAVGTKRYDAHSGGEREIQRTMLELLNQLDGFDSRGDVKVILATNRIETLDPALLRPGRIDRKIEFPLPDIKTRRRIFQIHTSKMTLADDVNLEEFVMTKDEFSGADIKAICTEAGLLALQERRMKVTHADFKKAKEKVMYKKKEGVPDGLYM

SEQ ID NO: 13620 - DNA, 801 bp, Panicum virgatum
  misc_feature: Ceres CLONE 1769990
agcggcatcggcatctccatctccatctccatctccatctcgccggcggagccctcctctcctctcctctcctcatagccagcctgccagccagccatcccaagcaaacccaaatccaacaactactagcagcaagcgccgaccatggggcagggcactcctgggggcatgggaaagcagggtggagccggcgaccgcaagcccggggacgccgacaagaaggacaagaagttcgagccgcccgctgccccctcccgcgtcggccgcaagcagcgcaagcagaagggcgccgaggccgccgcgcgcctccccaacgtcgcgccgctctccaagtgccgcctccgcctcctcaagctcgaccgggtcaaggactacctcctcatggaggaggagttcgtcgccgcgcaggagcgtctccgcccgcaggaggacaaggccgaggaggaccgatccaaggtcgacgacctccgcggcacgcccatgagcgtcggatccctcgaggagatcatcgacgagagccacgccatcgtatcctcctccgtcggacccgagtactacgtcggcatcctctccttcgtcgacaaggaccagctcgagccgggatgctccatactcatgcacaacaaggttctgtctgtggttgggatattgcaagatgaagttgatcccatggtatctgtgatgaaagttgagaaagctcctctggagtcttatgctgacattggtgggttagacgctcagattcaagaaattaaagaggcagttgagcttccattgactcatcctgagctgtatgaagac

SEQ ID NO: 13621 - DNA, 813 bp, Panicum virgatum
  misc_feature: Ceres CLONE 1770002
  misc_feature: Encodes the peptide sequence at SEQ ID NO. 13622
aaacatttggactccaaattttgcagaactagcctccctcctgtacctagcaatagcatcccccagagagaccgagaaggcttcgattcgatcgatacgatggccgcggacaagcagagagggggcgaggaggacgcgccgtcccgggtggcgctgctgcacgccgacgtgaggaaggaggagtggcgggcggcggcggcgggcaccggcagtctcgggcggagggtgtgggaggagtcgaggaagctgtgggtcatcgtggcgccggccatcttcagccgcgtcgtcacctacagcatgaacgtcatcacgcaggccttcgcgggccacctcggcgacctcgagctcgccgccatctccatcgccaacaccgtcgtcgtcggcttcaacttcggcctcatgctgggcatggcgagcgcgctggagacgctgtgcgggcaggcgttcggcgcccgcaagttccacatgatgggcgtgtacatgcagcggtcgtggatcgtgctcctcctgtgcgcggtgctgctgctgcccatgtacttcttcgcagaggaggtgctgctgctgacggggcagccgccggagctgtcggcgatggccgggcgggtgtcggtgtggttcatcccgctccacttctccttcgccttcctcttcccgctgcagcggttcctgcagtgccagatgaagaacatggtcaacgccgccgtctccgccgccgcgctcgccgtccacatcctcgtcagctggctcttcgtcgccaaattccagttcgggctcgtcggcatcgcgctcacgctccacttctcgtggtgcgcc

SEQ ID NO: 13622 - protein, 237 aa, Panicum virgatum
  misc_feature: Ceres CLONE 1770002
  misc_feature (56)..(216): Pfam Name: MatE Pfam Description: MatE
MAADKQRGGEEDAPSRVALLHADVRKEEWRAAAAGTGSLGRRVWEESRKLWVIVAPAIFSRVVTYSMNVITQAFAGHLGDLELAAISIANTVVVGFNFGLMLGMASALETLCGQAFGARKFHMMGVYMQRSWIVLLLCAVLLLPMYFFAEEVLLLTGQPPELSAMAGRVSVWFIPLHFSFAFLFPLQRFLQCQMKNMVNAAVSAAALAVHILVSWLFVAKFQFGLVGIALTLHFSWC

SEQ ID NO: 13623 - DNA, 2093 bp, Panicum virgatum
  misc_feature: Ceres CLONE 1770006
  misc_feature: Encodes the peptide sequence at SEQ ID NO. 13624
ctcgcacaggaagatcggaagggggtgctacaactccattgcaagcaatcccatgggtgatttgaaggattgatgcgcccatgaaagatccaacaagcttataaattggtttcagccattgcctttattgattctctatgctgaacaatgctcctcaaggctaaggagtcccttaggaagatgctttcagctgctacgggctactatggaggcctggtgcaatcatattcactttcagcatatggtcttaggcattctctcggctcctccattgaagcttccagacattttattccatccaaggctcgttcattgtcgcaattttcatgtgggggcagttctgcggaccaagagattgtgattgctatgggaagcaacgtgggtgatagagtcagtacatttgatagggcgctacagatgatgaaaagctcaggcgtgaacatcactaggcatgcctgtctgtatgagactgctcctgcttatgtgactgatcagccacggttcctgaactctgccattcgtggtacgaccaggctgggaccttacgagttgcttaagaaactaaaggaaatcgagaaggatatcggacgcactggtggaataaggtatggcccgagaccaatcgatctagacatacttctgtatggtgattcccagatccatagtgagactctaattgtgccgcatgaacgcattcatgagaggccatttgtcttagcacctcttgtcgaccttctgggtacatcccgtgatgatggtattgaaacaagttggcactcgctgtcaaagtgcagtggggggttctttgaattatggaataaacttgggggtgaatccacaattggaacagaaggtattaaaagggtactgccagttgggaatcgtctgcttgattggtgcgagagagccctaatcatggggatccttaatgtgacaccagacagctttagcgatgggggtaagtttcaacaagtggaagctgccatttctcaggccaagttattaatctcacaaggtgcagatatcattgacattggtgctcaatcaaccaggccatatgcaaagagactatctccaaaggaggagcttgagaggttgattcctatcctggatgagatcacaaaaattcccgagatagagggcaagttgctctcagtggatacattctacgcagaagttgccgctgaagctgtgaagagaggagttcacatgatcaatgatgtatcaggtggacagcttgacccaagaattcttaaagttgcagctgaactgggagttccatatgttataatgcatatgaggggcgatccatcaactatgcaaagtgaaaagaatttacagtatggtgatgtctgccaggaaattgcttctgagctatatacacagttgagagaagcagagctatctgggattccattatggaggatagttcttgatcctggcattgggttctccaagaaatctggggataactttgaattaattgctggattgaaatccattaggagagagatgagtaaaatgagtataggtgcttcacgtgtgccaatattactgggaccctcaaggaaaagttttctgcgtgaaatatgtgatcgtgccaatccagttgatttagatgctgctactgttgcagctgtgaccattgggattttgaatggtgctaacatagtaagggtccataatgctggatattgtgcagatgctgcaaaggtttgtgatgccctgcataagcgcagaagatgggaaaactgaactggctgatcgaacagatacaaaattccacttttgtgatatagggtagctacaccatcggttgagtatcattgttgtattaacccagagaatagagatgagcttttcttatgttatttcctttctaaaatcttcaatgaagcattggttgaagtcggacgactctgaaagaatagccaagaatgaggttttgaaagctgcttgtaagttgcaggtagttaacctttaggttccatcttacataattccaggtcaatttttttccaataaaactacataagaaggattttttggccttttggtaattcaagttgttttcaagtttgatttcttcttgt

SEQ ID NO: 13624 - protein, 535 aa, Panicum virgatum
  misc_feature: Ceres CLONE 1770006
  misc_feature (259)..(482): Pfam Name: Pterin_bind Pfam Description: Pterin binding enzyme
  misc_feature (71)..(197): Pfam Name: HPPK Pfam Description: 7,8-dihydro-6-hydroxymethylpterin-pyrophosphokinase (HPPK)
  misc_feature (241)..(527): SWISSPROT Homolog: EC 2.5.1.15 Dihydropteroate synthase
  misc_feature (72)..(196): SWISSPROT Homolog: EC 2.7.6.3 2-amino-4-hydroxy-6-hydroxymethyldihydropteridine diphosphokinase
MLLKAKESLRKMLSAATGYYGGLVQSYSLSAYGLRHSLGSSIEASRHFIPSKARSLSQFSCGGSSADQEIVIAMGSNVGDRVSTFDRALQMMKSSGVNITRHACLYETAPAYVTDQPRFLNSAIRGTTRLGPYELLKKLKEIEKDIGRTGGIRYGPRPIDLDILLYGDSQIHSETLIVPHERIHERPFVLAPLVDLLGTSRDDGIETSWHSLSKCSGGFFELWNKLGGESTIGTEGIKRVLPVGNRLLDWCERALIMGILNVTPDSFSDGGKFQQVEAAISQAKLLISQGADIIDIGAQSTRPYAKRLSPKEELERLIPILDEITKIPEIEGKLLSVDTFYAEVAAEAVKRGVHMINDVSGGQLDPRILKVAAELGVPYVIMHMRGDPSTMQSEKNLQYGDVCQEIASELYTQLREAELSGIPLWRIVLDPGIGFSKKSGDNFELIAGLKSIRREMSKMSIGASRVPILLGPSRKSFLREICDRANPVDLDAATVAAVTIGILNGANIVRVHNAGYCADAAKVCDALHKRRRWEN

SEQ ID NO: 13625 - DNA, 799 bp, Panicum virgatum
  misc_feature: Ceres CLONE 1770008
  misc_feature: Encodes the peptide sequence at SEQ ID NO. 13626
ttctgcacactttcctcttcctcgacgcctcaagcaaaccatggcagtcgctgtcctcgcgtctcagcgagagcatagctcgatcgcttccaggatcaccgagctacatcggacgacatgtgctttcggctgggcacacagcggatttcctgaaatcgagtgtagcgcctatgtctatgagaagttagccttctctgctttaacgattgtgtatggagtcggttgtgttcctgcaaagccccagtggaagtcatctgaagttgtgaaggcctatgaatcccgtatcatggaaggcgttagcgagatcttcgttgttcgtgaaaaaagagttccatctcaagttcatgaaaaaagtgtggagttaactggaggaataactcttgctgacaagacgcataggttactctgttgtacacaaaaagaaaaccttgatgagcatcacggaattgattggcagacacgctacaaaataattcaggggatttgcgagggtttggcatacctccatacgcaactggaacatcttatttgtcatggtgatgtaaaaccggacaatatattgctggatgcaaatatggtgccgaaaattgcagattttggcctgtcacggtgcttcggggaagaactagcacgaaacatgacaaattgtataggaacacaggggtacgaagcgccagagatgaacggaaagaaaatctcatatttgtctgacatataccgtttgggtctcatagtccttagtatattgaagattacatggtggaggcaagcgatgtggattatgctcgagtcatcttcc

SEQ ID NO: 13626 - protein, 252 aa, Panicum virgatum
  misc_feature: Ceres CLONE 1770008
  misc_feature (54)..(247): Pfam Name: Pkinase Pfam Description: Protein kinase domain
  misc_feature: SWISSPROT Homolog: EC 2.7.11.1 Non-specific serine/threonine protein kinase
MAVAVLASQREHSSIASRITELHRTTCAFGWAHSGFPEIECSAYVYEKLAFSALTIVYGVGCVPAKPQWKSSEVVKAYESRIMEGVSEIFVVREKRVPSQVHEKSVELTGGITLADKTHRLLCCTQKENLDEHHGIDWQTRYKIIQGICEGLAYLHTQLEHLICHGDVKPDNILLDANMVPKIADFGLSRCFGEELARNMTNCIGTQGYEAPEMNGKKISYLSDIYRLGLIVLSILKITWWRQAMWIMLESS

SEQ ID NO: 13627 - DNA, 444 bp, Panicum virgatum
  misc_feature: Ceres CLONE 1770008-R
tggagaccgacaacgtggtgcttccggacgtgtactacgtccccgggctttggacgaaccttgtctccgtcggccagcttgccgggctggattactgcatcgggtttagccgcggtgcatgccacatcagtgacgccgccggcacggtcgtcggtacagcccacgccaggggggacggcctgtatgaggtggaccatctcagagtgccacttgctggcgcataccgtgaagtgctgtagcatatgtgctgttgttgtgtgagctagtacgatgtaggagccacattcaataagggcaaccgatccatgcactatattgcttttcactttttgttaaaactttgtatgtcttcctgatcggcccaattccatcgcaccaactatgcatgaaaccatgtcccatgaactggttatcattatatatgctattgctgatgtgtttttt

SEQ ID NO: 13628 - DNA, 1668 bp, Panicum virgatum
  misc_feature: Ceres CLONE 1770012
  misc_feature: Encodes the peptide sequence at SEQ ID NO. 13629
attgtatcgcccacacgcacgtcctcatcagacgacgaatccatcatggagctcgggcaagctatggaggatctcccaactccgctgctgctctccacctttgcagtgtccgtggtcgtatgctacgtcctcttcagcaggaagcgggcgggcaggaagactgcgccgctgccgcccggcccgaggggctggcctgtcctaggcaacctgccgcagctcggcgggaagacgcaccagacactgcacgagatgaccacggtgtacggcccgctgctgcggctgcgtttcggcagctccgacgtggtggtggccgggtcggcggccatggcggagcagttcctccgcgtccacgacgctaacttcagctgccgcccgcccaactccggcggggagcacatggcgtacaactaccaggacgtcgtgttcgctccctacgggccccggtggcgcgcgatgcggaaggtgtgcgccgtgaacctcttctccgcgcgcgcgctcgacgacctccgcgccgtccgggaacgggaggccgcgctcatggtgcggtcgctcctggggcaagggagcgacgcgctgccggtgccgctcggcaaggccgtgaacgtgtgcacgacaaacgtgatctcccgagcggccgttgggcggcgggtgttcgctgccgccggcagcgagggcggcgcaagggagttcaaggagatcgtgctcgaggtgatgcaggtgggaggggttctcaacgtcggggacttcgtgccggcgctccggtggttggacccgcagggcgtggtggccaagatgaagaagctgcaccgccggttcgacgacatgatgaacgggatcattgctgagaggaaggccggggtgacgccagatggagaggaaggcaaggacctgctgggcttgctgctgccgatggtgcacgatgagcggcccgtagccggtggcgaggaggatgggatcaccgaaaccgatgccaaagcacttattttggtaagtttaattttcgttttacgatatattttcctttcccaatcgaacaatgcatgcatgattagcgttaggcgacgcatagaaaaaggtaaaaaaatctgaacgtgaaactcggacctattgctgtcgacaggtactgatgatgtactcatacgacatgcatgctagctcatgaacagtcatttaaattcgtacgtacgttattttaaataacggaataaaattatctgtaaatccggctagctcatgaacagtcatttaaaatccatttattattttaaataacgaaataaaattatacgtaatccgtacattattacaaattccatccaaattaaacaggaacccccaaaatgaccaaataaatccaccattttaatctatacgttttaaaagggtgctgatgggcctttcgtcaataataacatgtggtattcgaccacgtttgcaaaaacaacggtttttattgtggccattaacctcaaataagctttcaatactatgatgttattccatcaacctccagaataatctttgcatcttaaaaaaggacctaaacgaatctaatctagattggatgtaacaagtagcttgcttttcgtcacataggactctaattttctcttggacacttgtaatcaaacccgtacccaatttaaaggttcataagaatacccatgc

SEQ ID NO: 13629 - protein, 347 aa, Panicum virgatum
  misc_feature: Ceres CLONE 1770012
  misc_feature (43)..(347): Pfam Name: p450 Pfam Description: Cytochrome P450
  misc_feature: SWISSPROT Homolog: EC 1.14.13.21 Flavonoid 3'-monooxygenase
MELGQAMEDLPTPLLLSTFAVSVVVCYVLFSRKRAGRKTAPLPPGPRGWPVLGNLPQLGGKTHQTLHEMTTVYGPLLRLRFGSSDVVVAGSAAMAEQFLRVHDANFSCRPPNSGGEHMAYNYQDVVFAPYGPRWRAMRKVCAVNLFSARALDDLRAVREREAALMVRSLLGQGSDALPVPLGKAVNVCTTNVISRAAVGRRVFAAAGSEGGAREFKEIVLEVMQVGGVLNVGDFVPALRWLDPQGVVAKMKKLHRRFDDMMNGIIAERKAGVTPDGEEGKDLLGLLLPMVHDERPVAGGEEDGITETDAKALILVSLIFVLRYIFLSQSNNACMISVRRRIEKGKKI

SEQ ID NO: 13630 - DNA, 775 bp, Panicum virgatum
  misc_feature: Ceres CLONE 1770016
  misc_feature: Encodes the peptide sequence at SEQ ID NO. 13631
ccacaaattactaagagagtatggcccttttaaggaacctgtgattcgtaattacactggtcaaattcttgctggtcttgcctacttacatgggaggaacactgtccacagagatatcaaaggagcgaacatacttgtgggccctaatggtgaagtcaaacttgctgactttgacatggctaagcatatatcatcttttgctgaaatacgctctttcaaaggaagtccttactggatggcgcctgaggttataatgaacagtaaaggctacagtttagcagtggacatttggagtttgggatgtaccattattgaaatggcaacggcaagacctccttggcatcaatatgagggggtagcagcaatatttaagattgcgaacagtaaagatatacctgaaataccagacagtttttcagaggaagggaaaaaattcttgcagctttgcttacaacggaacccagcatctcgtgcctctgcatcccagttgatggatcacccttttgttctggatcatcctgcagtcaaagctgcaaaatccagtgcattgagaaatgccttgtcttctccagctgatggcaggctcgcaatgtccaacagggagttgccatcacggaagatcattactcctctgagggatataggactgagtgtgagagattttaccggattttccactgctgttccttcaccacacagccctattcctgggagaacaaacatgtctatgccagtttcaccatgctcaagcccactacggcagtttaagcaatct

SEQ ID NO: 13631 - protein, 257 aa, Panicum virgatum
  misc_feature: Ceres CLONE 1770016
  misc_feature (2)..(169): Pfam Name: Pkinase Pfam Description: Protein kinase domain
  misc_feature: SWISSPROT Homolog: EC 2.7.11.25 Mitogen-activated protein kinase kinase kinase
HKLLREYGPFKEPVIRNYTGQILAGLAYLHGRNTVHRDIKGANILVGPNGEVKLADFDMAKHISSFAEIRSFKGSPYWMAPEVIMNSKGYSLAVDIWSLGCTIIEMATARPPWHQYEGVAAIFKIANSKDIPEIPDSFSEEGKKFLQLCLQRNPASRASASQLMDHPFVLDHPAVKAAKSSALRNALSSPADGRLAMSNRELPSRKIITPLRDIGLSVRDFTGFSTAVPSPHSPIPGRTNMSMPVSPCSSPLRQFKQ

SEQ ID NO: 13632 - DNA, 1738 bp, Panicum virgatum
  misc_feature: Ceres CLONE 1770017
  misc_feature: Encodes the peptide sequence at SEQ ID NO. 13633
acccaatccccagccgcagccgccacaaaccgagaaagagagcacgagcagcggcgcgagttgcgagccgcggacgcgccgtcacctgcggcgcctcctcctcccatcgcagcctccttcgcttccttagcggttcagccatgggtaaggagaagtcccacatcaacatcgtggtcattggccacgtcgactccggcaagtcgaccaccaccggccacctgatctacaagcttggaggcatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagttcgagaccaccaagtactactgcacggtcattgatgcccctggacaccgtgacttcatcaagaacatgatcacgggtacatcccaggctgactgtgctgtccttatcattgactccaccactggtggttttgaggccggtatctccaaggatggccagacccgggagcatgctctccttgctttcactcttggagtcaagcagatgatctgctgctgcaacaagatggatgccaccactcccaagtactcgaagacccgttatgatgagattgttaaggaagtctcctcctacctgaagaaggttggctacaaccctgacaagattgccttcgtccccatctctggttttgagggtgacaacatgattgataggtccaccaaccttgactggtataagggcccaacccttcttgaggctcttgaccagatcaacgagcccaagagaccttcggacaagcccctgcgtctcccccttcaggatgtgtacaagattggtggtattggaactgtccctgttggccgtgtcgagaccggtatcatcaagcctggtatggttgttacctttggtcccagcggcctgactactgaggtgaagtcagttgaaatgcaccacgaggctctccaagaggcccttcctggtgacaatgttggcttcaatgtgaagaatgttgctgtgaaggatctgaagcgtgggtatgtggcctccaactccaaggatgaccctgccaaggaggctgcaagcttcacctcccaggtcatcatcatgaaccaccctgggcagatcggcaatggctatgccccagtgctggactgccacacctcccacattgctgtcaagttcgctgagctcattaccaagatcgacaggcgatctggcaaggagcttgagaaggagcccaagttcctcaagaacggtgatgctggtatggttaagatggttcccaccaagcccatggtggtggagaccttctctgagtaccctccccttggtcgctttgctgtccgtgacatgaggcaaacggtcgctgttggagtcatcaagagtgtggagaagaaggaccctaccggcgccaaggtgaccaaggctgctgccaagaagaaatgatgtgtctggtggtttatcctacgtctgattttgctatgcctagatacctttccattatcccataagttttgtcagcggtggttgctgttgtcatgtgaacttttaatgtcttccggcggtgtgccatttgtatgtcaggtcccgtgttattttaacttgaatgctcgaagacctatggtgtgcccttttgggcgtcgttaaaccgtgtttctcatgagtcatctcgttatccctatgcattctgtttcgctttc

SEQ ID NO: 13633 - protein, 447 aa, Panicum virgatum
  misc_feature: Ceres CLONE 1770017
  misc_feature (5)..(225): Pfam Name: GTP_EFTU Pfam Description: Elongation factor Tu GTP binding domain
  misc_feature (322)..(430): Pfam Name: GTP_EFTU_D3 Pfam Description: Elongation factor Tu C-terminal domain
  misc_feature (248)..(315): Pfam Name: GTP_EFTU_D2 Pfam Description: Elongation factor Tu domain 2
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKTRYDEIVKEVSSYLKKVGYNPDKIAFVPISGFEGDNMIDRSTNLDWYKGPTLLEALDQINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 13634 - DNA, 826 bp, Panicum virgatum
  misc_feature: Ceres CLONE 1770019
  misc_feature: Encodes the peptide sequence at SEQ ID NO. 13635
acaatccctgtcccgcaccgcccgagccacaacagcgacagggccctcgcgccgatcgcgccgagccagccgcggcgttgccggcgggcaatgggagctgggcggcggcggtgatgggcgcggcgagctccaggctggagaaggcgctgggcgagcagttccccgagggcgagcgctacttcggcctcgagaacttcggcaacacatgctactgcaacagcgtcctgcaggcactttatttttgtgttcctttccgtgatcaactgctggagtattatgcaagcaataaaaacactggagatggtgaagagaacatgctaacctgcctggctgatctgttctctcagatcagtaatcagaagaagaaaactggagttattgctcctaagcgttttatacaacgattgaagaaacagaatgaaattttccgcagttatatgcatcaggatgctcacgagtttctgaattttttactgaatgagctcgttgacattctagagaaggaacataatgctgaaagagagtctcttcaaaatatttcgttgcaaaagaattcaaatggccctattaatggccaacccaatggtagtcacaaagaattagctgctacatgggtccataaatgcttccagggaatattgactaatgaaacaagatgttttagatgtgaaactgtgactgatagagatgaaacgttttttgatctgagcctggacattgaacagaatagttcaataaccagctgtcttaagaacttcagctcgacagagactttgaatgctgaggataagttcttctgtgacaaatgttgcagtctacaggaagc

SEQ ID NO: 13635 - protein, 237 aa, Panicum virgatum
  misc_feature: Ceres CLONE 1770019
  misc_feature (20)..(228): Pfam Name: UCH Pfam Description: Ubiquitin carboxyl-terminal hydrolase
  misc_feature: SWISSPROT Homolog: EC 3.1.2.15 Ubiquitin thiolesterase
MGAASSRLEKALGEQFPEGERYFGLENFGNTCYCNSVLQALYFCVPFRDQLLEYYASNKNTGDGEENMLTCLADLFSQISNQKKKTGVIAPKRFIQRLKKQNEIFRSYMHQDAHEFLNFLLNELVDILEKEHNAERESLQNISLQKNSNGPINGQPNGSHKELAATWVHKCFQGILTNETRCFRCETVTDRDETFFDLSLDIEQNSSITSCLKNFSSTETLNAEDKFFCDKCCSLQE

SEQ ID NO: 13636 - DNA, 966 bp, Panicum virgatum
  misc_feature: Ceres CLONE 1770022
  misc_feature: Encodes the peptide sequence at SEQ ID NO. 13637
accggcacacttcaattccactcaaaactttcctcctcctcctcatcttcgtcttcctctctctagctgctgtgggaatactctctctctctctctctctgccaagaacaccggccggctagcagcttgtgtttgttgttcccatggagatcgacggcgacaacctcagcgccaccgagctccggctcggcctgccggggaccagcagcggcgacgaccggccgaggaggccggcgccctccgtcggcgccaagcgcgcgctcgaggacaccaggagcgaggcgtccggcaccacggccgccggcgacgaccacgacgacgccacgcctgctgccaaagcgcaagtggtggggtggccgccggtgagggcgtacaggaagaacaccttccaggcggcggcgaagaaggccgagcagccgggagggctgtacatgaaggtgagcatggacggggcgccgtacctcaggaaggtggacctccggatgtacaaggggtaccgggagctcagggaggcgctggacgccctcttcaccaagtccttctccgccgccgccgccgcagcggagggcggcgacggccagcacgccctcgcctacgaggacaaggacggcgacctcatgctcgtcggagacgtgccctgggacatgttcatctcttcgtgcaagaagctcaggataatgaagggttgtgaggccaggtgattgccgatacacaggcagaggctgcagactcatgggggatgaatcgaggagcacagatcgtgcaaaggagctgtgtggcttgggctctccagtgctgtacaaagagatggttgtttctgaaaccaagaaggagaaggatctatgaattgtgtatatagttttaggctcttagctagccgccttgttttttgagttgtgttttgtatgagcgaaggctgtaaaaaaatcaaaaagaaaaatgagaaatttgacttaagtttggtcg

SEQ ID NO: 13637 - protein, 185 aa, Panicum virgatum
  misc_feature: Ceres CLONE 1770022
  misc_feature (7)..(185): Pfam Name: AUX_IAA Pfam Description: AUX/IAA family
  misc_feature: The sequence is a functional homolog of SEQ ID NO 648 in the 11/479,226 US patent application
  misc_feature: The sequence is a functional homolog of SEQ ID NO 636 in the 11/479,226 US patent application
  misc_feature: Useful for making plants with altered terpenoid content
  misc_feature: The sequence is a functional homolog of SEQ ID NO 739 in the 10/374,780 US patent application
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: The sequence is a functional homolog of SEQ ID NO 656 in the 11/479,226 US patent application
  misc_feature: Useful for making plants with modulated nitrogen use efficiency
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: The sequence is a functional homolog of SEQ ID NO 667 in the 11/479,226 US patent application
  misc_feature: The sequence is a functional homolog of SEQ ID NO 890 in the 10/412,699 US patent application
MEIDGDNLSATELRLGLPGTSSGDDRPRRPAPSVGAKRALEDTRSEASGTTAAGDDHDDATPAAKAQVVGWPPVRAYRKNTFQAAAKKAEQPGGLYMKVSMDGAPYLRKVDLRMYKGYRELREALDALFTKSFSAAAAAAEGGDGQHALAYEDKDGDLMLVGDVPWDMFISSCKKLRIMKGCEAR

SEQ ID NO: 13638 - DNA, 2652 bp, Panicum virgatum
  misc_feature: Ceres CLONE 1770026
  misc_feature: Encodes the peptide sequence at SEQ ID NO. 13639
aaccacctagcaccagccagaatagggagaaagagagcctgccaaattctcatacagatacacagtctctctctctctctctcaagcttctcttcctccattccaccattttctcccacctctgatcccttcatgtagcagccagaaaagcagcaaaaaggaggcggagatggcttaaaactcccaaaaccaccatgaaaaagggcttctttggcccctaggttgctggcatttggtgtctctttttccgtcacctgctcgtattgctttctctcatcccaaggcgacgagggaataggaagctggaaagctcacctgcagctttgctcatggcctagctcaggctgtagctgaacgcctatgtgtcagggtctcagggagtctgaatcttgtccggtcctttcacttctccctcctcgctcttccttgtggcgtgtcttgctggtctctggagagtggagagcaaaactcttcctagttcttcaatggtgggcgtaggcgctggcctgggcttggtcatggaaggaaccagctgtggtgctctgctcaaggagcttcagcaaatttgggcagaggttggagaaagtgaggatgagaagaacaaggtgttgctggatatcgaaagagagtgcttggaagtctaccgcaggaaggtggacgatgccaatcggactagggtccagctgcaccagtcagtggctgccaaagaggctgaagttgcatctctgatggcaactctaggggaacacaagctgtacatgaagaaagataagggcattgtatcgctcaaggaacaactcgccgctgttgttcctgtattggagaacttgaaatgcaagaaagaggaaaggatcaaacaattctcagacattcgatcgcagatcgaaaagatccgctttgagttaagcgaatataatgatcagggtgatagcgagagcagtcttgctgaggatcaacatgacttgtcaacaaggaagctcaacagttaccaagcacagcttcgtgcccttcagaaagataagtctgaacgcctccgcaaggttctggagtacataaatgaagtgcactctttgtgtggagtccttggaattgattttggacctactgtaaatgaaattcatcctagtttacatcagaatggtgttgagcaatcaagaaacatcagcaatagcacactggatggccttgctagtactatatccaagctaaaagcagaacggaagtctcgaatccagaagatgagagcgacaatggaatcactgtgccaactctggaagcttatggactcgcctgaggaagagaagcggcaatttagcaaagtaatgagcattctcatattaccagaggagggaatcacatcatctggcgttctctcccaggaattaattgataagatggaagctgaagttgagaggttagcaaaactaaaaaccagcagactgaaggatattgtcatgaaaaggaggagagaattagaagagatctgccaaaatgcacacatagaacctgatgtcagcacagcccctgaacaaactgatgcgctgattgattctggcctcatcgacccctctgcgctcctggcaaatattgagtcacagatattaaaagcaaaagaagagtcccttagccgaaaagatataatggacaggataaataagtggattgctgcttgtgatgaagaggcttggcttgaagaatataaccaggacccaaagcggtatagtgctggaaggggtgctcacataaaccttaagcgggccgaaaaggcacggattttggtcacaaaaatcccaagtatggtggagaacctgataaaccggacatttgcttgggaaaacgcaagaagtaaaccctttctctatgatgggggccgcctaatatctgttcttgaagagtacagacttagccggcaacagaaagaagaggaaaaacgacgataccgggaccagaagaagttggagagcatcctacttgcagagaaagaagcaatttttggctcgaaaccaaccccaaagaggacgagcagtttaaataggaagacaaatgggtaccggccaaatggaaacactaatggactcatgactccaactcctaggcgatcatctcttggcagtgctactcctgagcttttgacgcccaggtcatactctggccacaatagatactttggtgatttcaggcggctatcgacgtctcatctgaacttcggtgatgattcgctgtcaacatttacatccatcagtggctctgaaccggaaccctttctcatggatgaactccatactgatgggtgattggatgatctgattagccaagtattgagtattgtaaatggagagcactatagtaattagtatgtacattcctgatgttatatatttagctcggatttgactacttagtattaggttggtagagacttggtttgggttggttttggagttgaattgtttcaagctgttggcattgtagattgaggattaggtgaaagatgtagcgaatgatttgaatttgggcagtcatctcagctgtaacatatcataacttatgtgattcgcttgtgaccttgtgcgctgcagccttgtacaagtgctatggaaaatctatgtacagaactacagattctactgccccagtactccttgtatgccc

SEQ ID NO: 13639 - protein, 602 aa, Panicum virgatum
  misc_feature: Ceres CLONE 1770026
  misc_feature (37)..(597): Pfam Name: MAP65_ASE1 Pfam Description: Microtubule associated protein (MAP65/ASE1 family)
  misc_feature: SWISSPROT Homolog: EC 2.7.11.1 Non-specific serine/threonine protein kinase
MVGVGAGLGLVMEGTSCGALLKELQQIWAEVGESEDEKNKVLLDIERECLEVYRRKVDDANRTRVQLHQSVAAKEAEVASLMATLGEHKLYMKKDKGIVSLKEQLAAVVPVLENLKCKKEERIKQFSDIRSQIEKIRFELSEYNDQGDSESSLAEDQHDLSTRKLNSYQAQLRALQKDKSERLRKVLEYINEVHSLCGVLGIDFGPTVNEIHPSLHQNGVEQSRNISNSTLDGLASTISKLKAERKSRIQKMRATMESLCQLWKLMDSPEEEKRQFSKVMSILILPEEGITSSGVLSQELIDKMEAEVERLAKLKTSRLKDIVMKRRRELEEICQNAHIEPDVSTAPEQTDALIDSGLIDPSALLANIESQILKAKEESLSRKDIMDRINKWIAACDEEAWLEEYNQDPKRYSAGRGAHINLKRAEKARILVTKIPSMVENLINRTFAWENARSKPFLYDGGRLISVLEEYRLSRQQKEEEKRRYRDQKKLESILLAEKEAIFGSKPTPKRTSSLNRKTNGYRPNGNTNGLMTPTPRRSSLGSATPELLTPRSYSGHNRYFGDFRRLSTSHLNFGDDSLSTFTSISGSEPEPFLMDELHTDG

SEQ ID NO: 13640 - DNA, 1712 bp, Panicum virgatum
  misc_feature: Ceres CLONE 1770027
  misc_feature: Encodes the peptide sequence at SEQ ID NO. 13641
agctggctcccttgctgagagaggaatcggccaagaagagaaggcggagaggagatgaagacccggagctccgcgaggggggagcacaggcggctcgggaatgtggctctcctggccctcatgctctgctccgtcgtcgccctctccctcatccgggggaggttcgccccaatcgtcaacagtgccggagacgccatcaaatccgaggaggcggcggccgcggtgagcaaggcggccgtcaacattgacactggcgacagcgccgacgaggccgccgcggaagctgctgcggaggagaaagacaaggaggagcccgagcccaaccccgccgccaagccggtgtgctacgagacgagccgccgctccgacacctgcgaggcggccggcgacgtgcgcgtgatggggagcagccagaccgtgtacgtcgacacgctggaccgggagtggaagaccaagccgtactgccggaagcacgacaacttcgcgctgtcccacgtcaaggagtggaccctcaagccgctcccctccggcgcggcgccgcggtgcacggtcaacagctcggccaccgccttcgtgctctccaccggcgggttcacgggcaaccctttccacgactacacggacgtgctgatcccggtcttcatcacggcgcaccccttgggcggcgaggtgcagttcttggtgagcagctacaagtcgtggtgggtgaaccggtacatccagatcttccagcagatgagccggcacgaggtggtggacatcgacgccgacgacgaggtccggtgctaccgcaacgtggtggtagggccgacgttccaccgggagctcggcgtggatgcgtccaagacgccgtcgggctactccacggccgacttccgcaagatgctgcgcgacgcgttcgggctggagcgcgcgacggccacgccgagcggcgaccagtgggacatccggcgccggccgcggctgctcatcatctcgcggcgtccctcccgcggccgcgcgttcatgaacgagcgcgcgatggcggacatggcggcgagcctcgggttcgacgtgcggatcggggagcccgacacgagcacggacacgtccaagttcgcgcggctggtgaactcgtgcgacgtgatggtgggcgtgcacggcgccggactgaccaacatggtgttcctgccggccggcgccgtggtggtgcaggtggtgccgtacgggaggctcgagtggctggcccggaacacgttcgcggagccgtcggcggggatggaggtccactacctcgagtacgcggtgcagctggacgagacgacgctgagcgagcagtacccgagcgaccacccggtgctgagggaccccatggccatccacaagcaggggtggaacgcgctcaagaccacgtacctggacaagcagaacgtgcggccgcacctggggcgcctcaagaacaccttcctccaggcgctcaagatgctgccgcacggccgggacgattaggaaggaggtgatctagacctctcggatattagagggtaggtgtatagcttaattaatggtaattactactttttttggcttgttttttcttctttatttgttcgtatgagtaagagggcgctccagtaccagcaagtagtagtggcagtgctactgtgaatgggatcgcagagacaaattctagtgtttaactgttcataagttatctttttttttcttttcct

SEQ ID NO: 13641 - protein, 477 aa, Panicum virgatum
  misc_feature: Ceres CLONE 1770027
  misc_feature: Useful for making plants with altered carbohydrate content
MKTRSSARGEHRRLGNVALLALMLCSVVALSLIRGRFAPIVNSAGDAIKSEEAAAAVSKAAVNIDTGDSADEAAAEAAAEEKDKEEPEPNPAAKPVCYETSRRSDTCEAAGDVRVMGSSQTVYVDTLDREWKTKPYCRKHDNFALSHVKEWTLKPLPSGAAPRCTVNSSATAFVLSTGGFTGNPFHDYTDVLIPVFITAHPLGGEVQFLVSSYKSWWVNRYIQIFQQMSRHEVVDIDADDEVRCYRNVVVGPTFHRELGVDASKTPSGYSTADFRKMLRDAFGLERATATPSGDQWDIRRRPRLLIISRRPSRGRAFMNERAMADMAASLGFDVRIGEPDTSTDTSKFARLVNSCDVMVGVHGAGLTNMVFLPAGAVVVQVVPYGRLEWLARNTFAEPSAGMEVHYLEYAVQLDETTLSEQYPSDHPVLRDPMAIHKQGWNALKTTYLDKQNVRPHLGRLKNTFLQALKMLPHGRDD

SEQ ID NO: 13642 - DNA, 850 bp, Panicum virgatum
  misc_feature: Ceres CLONE 1770044
  misc_feature: Encodes the peptide sequence at SEQ ID NO. 13643
agtgctatagagctgagtcacaggccacagcccgacacccccgcaaggagaagaggaagctgcttttcagataagaagatggagatggcgtcgttgcttcgacttgttgccctctcgctgctccttgcagtggccactccagtaagggacatcaccgatgcgtgctcgtctcaagtcaaggctgcagacttccctcacctgaacggctccggcctccacctcacgctgcaccacccgcggagcccctgctcgccggcgccgctgcccgccgacctccccttctccgcggtgctcacccacgacgacgcgcgcatcgcctcgctcgccgcgcgcctcgccaagacgccgtcctcgcggcccaccgcgcttgacgagtcgtcgtccctggcgctcgacgagtcgtcgtccccggcgctcgacgagtccctcgcgtccgtgccgctgggcccgggcacgtcggtgggcgtgggcaactacgtcacccgcatgggcctcggcacgcctgccaagtcgtacgtcatggtcgtggacacgggctcctcgctcacgtggctgcagtgctccccctgcgtggtgtcgtgccaccgccaggccggccccgtgttcaaccccaaggcgtccagctcctacgcctccgtctcctgctcggcgccgcagtgcagcgacctcacctccgccacgctcaaccccgccgcctgctccagatccaacgtctgcgtctaccaggccagctacggcgacagctccttctccgtcgggtacctgagcaaggacaccgtgaccttgggctccggcagcatgcccaacttctactacgggtgcgggcaggacaacgaggggctcttcggcc

SEQ ID NO: 13643 - protein, 255 aa, Panicum virgatum
  misc_feature: Ceres CLONE 1770044
  misc_feature: SWISSPROT Homolog: EC 3.4.23.12 Nepenthesin
MASLLRLVALSLLLAVATPVRDITDACSSQVKAADFPHLNGSGLHLTLHHPRSPCSPAPLPADLPFSAVLTHDDARIASLAARLAKTPSSRPTALDESSSLALDESSSPALDESLASVPLGPGTSVGVGNYVTRMGLGTPAKSYVMVVDTGSSLTWLQCSPCVVSCHRQAGPVFNPKASSSYASVSCSAPQCSDLTSATLNPAACSRSNVCVYQASYGDSSFSVGYLSKDTVTLGSGSMPNFYYGCGQDNEGLFG

SEQ ID NO: 13644 - DNA, 1938 bp, Panicum virgatum
  misc_feature: Ceres CLONE 1770045
  misc_feature: Encodes the peptide sequence at SEQ ID NO. 13645
gcccccacctttttcccgtttcctgctcgctcgcttgctttttgcggcgatgagatctttggtttggttggtttctttaagacccggcgtccaaatcaccctgccttttgatcccaatttcctccttttccctgccctcccaacacaaagcaagattcttgcttgtgcgagttatgtcaggaaagatttggtcggccaggctctccctctgaaggactgagacggtagccactttaatttgcacgacaaaagtgagttctgcctttcgttgttcctactctttgttttcctgtatgtcgtgctttggcggccctcaactagctacccgtgctttgctgattgccgccttaattgtgtgcgcctgtgctttttaagggaggaagccttgctttcggtgtgccgccgatcgagcctgacggagatggcgcacgatcccagcctgggcttcgcggattacttctcggcggcggcggacgccacggcgatggaggagggggcgcccgagctgtacggcttgcacgccgacatggagttcctggccatgcgaggaggcctggccgccatgccggccgcgacgcacggccacggtcacggtcacaacaaggccgtgctcgacgatgacgcggggccagacggcggctccgccacggacgcggccaccatgcagttcctgagcgccggcggccaccagcagcagcagccgagccaggcgccactgtcgctgtcgctgtgccggcccgatggcgccggcggcgtgggcgtgacgttgcacgagcacctcggcggctcctcccggcaccatcagcagcagccgccccccgcggcgtggatggagcacgactactcggcggccacgcaggggacgcagcacgcggcggcggcgtggcacctgcgcagctcgaggttcctcctcccggcgcagcagctcctgcaggagttctgcagcctccccgtcgacagcgccgcgaaaaacaagcagcgcgccaagcaggcatcatcaacggcaaagccgccgcagcagcaagaagacggcggcgagggttcgtcgtcgtcggcctgctgggccccgtcgccgcagatccaggccatggaggcgctggagctgcagcggctcaaggacaagctctacatcatgctggaagaggtggaccggagatacaggaggtactgcaagcagatgcgttcgctggctggcgggttcgaggcggtggccggggagcgcgcggcggcggcgtacacggcgctggcgtcgcgcaccatctcgcggcacttccggagcctgcgggacgggatggtggcgcagctgcaggcggcgcgcaaggcgctcggggaaaaggcggacgtgtccgtgcccgggatgacgcgcggggacacgccacgcctgcgggtgctcgaccagtgcatccgccagcacaaggcgctcggcatgccggagacccacccgtggcgaccgcagcgcggcctacccgagcgcgccgtcaccatcctccgggcctggctattcgaacacttcctgcacccgtatccaagcgacgtggataagcacattctggctcgccagacgggcctctcacggaaccaggtactattatttttgcatataaataaataaactctagctctccatcagctgaactaaattttagatccacacatgcatgcatgcatttcagacaaaaattaagaaaaaaaaggaaggttgaattgtcaacattggcctacgtgttgtttgcatcgtccgggcaggcgtctcatcagaacaatataaatctgtagtatgcaattgcgtgttgcgccccggccctctgattcgatccgcgtcgcgtagatggcacatcaattcatgattggttgccatgtcatggtcgtgccgccatgtcctcttgtgcctgcaaacgttcccagaaaagattccttcttttacataggcaacatccg

SEQ ID NO: 13645 - protein, 396 aa, Panicum virgatum
  misc_feature: Ceres CLONE 1770045
  misc_feature (155)..(293): Pfam Name: POX Pfam Description: Associated with HOX
MAHDPSLGFADYFSAAADATAMEEGAPELYGLHADMEFLAMRGGLAAMPAATHGHGHGHNKAVLDDDAGPDGGSATDAATMQFLSAGGHQQQQPSQAPLSLSLCRPDGAGGVGVTLHEHLGGSSRHHQQQPPPAAWMEHDYSAATQGTQHAAAAWHLRSSRFLLPAQQLLQEFCSLPVDSAAKNKQRAKQASSTAKPPQQQEDGGEGSSSSACWAPSPQIQAMEALELQRLKDKLYIMLEEVDRRYRRYCKQMRSLAGGFEAVAGERAAAAYTALASRTISRHFRSLRDGMVAQLQAARKALGEKADVSVPGMTRGDTPRLRVLDQCIRQHKALGMPETHPWRPQRGLPERAVTILRAWLFEHFLHPYPSDVDKHILARQTGLSRNQVLLFLHINK

SEQ ID NO: 13646 - DNA, 1743 bp, Panicum virgatum
  misc_feature: Ceres CLONE 1770056
  misc_feature: Encodes the peptide sequence at SEQ ID NO. 13647
acagtcccactccccaaccgggctctactcaacctccgcgccttcttgatccccgcccgctcaccaagcacaccgatccatccaatcctggtcgccgctgctgccggattcgcccgctaaccaacccgcgcaagctccgccccctgccgcgccgccatgctggcctcggcgagggggttctgggcgcggcaccgccggaagatcctcgtctcgctgggcgtcgcgggggcgggctacgccgcctaccgcctctacgacacgcaccgcgcccagctcctgcgggtggagcagctgcgcgccagggaggagaaggccgccgacgacctcgtcaagaaccagctacagcaacactttaagaaggtgcagagcatttgtgacactaccacattgcctttggccatgcatcagctctgtgaaaacataatgagtcagttggatatttcaaaattgactgccaagttacggcaagggaaggcagaatcaagagcaatgacaccaaaagaaaaatatgatacttgggaggagattaaaattaagagtatgatattttttcgtcgtaactattgcatggccttttctcttcttttccttgtctaatcataaatatgcattagtaaccatgttattgtctatttcaatggaacctccgatttcttaggtttcacaaagacagtttcttcaatttgggcaatgacgttgctcagcttgtacactagagttcaggtcaccatattaggcaggcatctctacttagattttgcccgaggtacacatggtgcacagttacaggaagaatctgatacctttagtgaaaatggacacaagagcttccttacaacggctgattatcttcccactggcaaaatcaatgcatacataatgcatatgcaacatgctgcaacaggagtcctaaaagagaagcaactgaaagaccttatgagcacggacgaagtattgcaaacaatgttacaaatattggactttttcatgaatctgtgtgaagataactcatggataaaataccttgtacctgacgatgccagtgttcaagcacagttgatggctgtgtccactagtggctttgatgattcatcactcctaaatgatttcagaaagctcgaacaactaatggccgagacacgagtagtactggcaagtgatgatttcagaaatatcatggagaggtcaatgaggaagatagctgacatggtgatagaggacctgactgcgcaggctggaattccaagtcctccatcaggattgcccttagcgacgctcttgcccagagttgctcatttgagctcgctattgcttgaggagccaaacaagaacaaatacattcagatgatccgaagtatgcctgaagtggaactcttctacacattcctctatgcaaacatgccaccagaaacatgatctgtacattgatatgaaatgatcacttccttctgaactgtggctccaatggtctggcggtatgtggatgccgaacattctgcaaatctgggaaccaagagctcatttctgcgctgtatatgctgagatattccgcttttactaacatgaagtaactaagtggagttccttccatctggattctttcttcaaagtctgggttgtgagtgtctatttaggatccccaccctttgtttctgctattttgctatatttttggaagcttacacgacgataattggtgcgtatgttttactggtcaaatggttaatgtatacatttctactc

SEQ ID NO: 13647 - protein, 146 aa, Panicum virgatum
  misc_feature: Ceres CLONE 1770056
  misc_feature (2)..(140): Pfam Name: Peroxin-3 Pfam Description: Peroxin-3
MLASARGFWARHRRKILVSLGVAGAGYAAYRLYDTHRAQLLRVEQLRAREEKAADDLVKNQLQQHFKKVQSICDTTTLPLAMHQLCENIMSQLDISKLTAKLRQGKAESRAMTPKEKYDTWEEIKIKSMIFFRRNYCMAFSLLFLV

SEQ ID NO: 13648 - DNA, 764 bp, Panicum virgatum
  misc_feature: Ceres CLONE 1770075
  misc_feature: Encodes the peptide sequence at SEQ ID NO. 13649
cttccactctatgtcctcttagcccttccactcatcgccttccttttcctctgcttccaccgttcgaggcacgcacatgccaccggcaggctccctccgtcgccatgggcgctgccggtcatcggccacatccaccacctcgccggcgcgctcccgcaccgcgcgatgcgcgacctcgcgcggcgcctgggcccgctcatgctgctccgcctcggcgagctccgcgtcgtggtggcgtcctcggccgacgcggcgcgcgaggtgatgaggacgcacgacctggccttcgtctctcggcccatcaacccgacgggcaggatcctgctgggcgagcacagcgacggcctcgtggccgccccctacggcgaggggtggcgccagctccgcaggatctgcaccacggagctcttcagcgcgcgccgcgtccggtccttccgggccgtgcgcgaggaggaggtccgccgcctcctccagtccgtggcggcggcggcctcgccggtgaatctgagcgggatgatagcggcgtacgtggccgacgcgtcggtgcgcgccatcatcggcagcaggttcagggacaaggagactttcctgcggctgctggagcggcggatcaagatcatgccggcgagcagcttgccggacctcttcccctcttcgcgcttggcgatgctcgtcagcccgacaccgcgcttggtgaagcgcgagcgcgagaagatgatggccttcgtcgacaccatcatccaggaccaccaagacaacagagc

SEQ ID NO: 13649 - protein, 254 aa, Panicum virgatum
  misc_feature: Ceres CLONE 1770075
  misc_feature: SWISSPROT Homolog: EC 1.14.13.21 Flavonoid 3'-monooxygenase
LPLYVLLALPLIAFLFLCFHRSRHAHATGRLPPSPWALPVIGHIHHLAGALPHRAMRDLARRLGPLMLLRLGELRVVVASSADAAREVMRTHDLAFVSRPINPTGRILLGEHSDGLVAAPYGEGWRQLRRICTTELFSARRVRSFRAVREEEVRRLLQSVAAAASPVNLSGMIAAYVADASVRAIIGSRFRDKETFLRLLERRIKIMPASSLPDLFPSSRLAMLVSPTPRLVKREREKMMAFVDTIIQDHQDNR

SEQ ID NO: 13650 - DNA, 751 bp, Panicum virgatum
  misc_feature: Ceres CLONE 1770077
  misc_feature: Encodes the peptide sequence at SEQ ID NO. 13651
acctgccaccatagtcgcgtctccttttaacgtcgcctcggttgagagacagagagaagagggaggaaattaaaatgaagtcctccgtcgtgattgctctagcagcagcggtgcttctggtcgcggcacagtacgcctccctcgccgacgccaaggggccaagggtcatcatcgtcggcgccggcatgtccgggatctcgacggggaagcggctgtgggagtcgggtgtccgggacctggtgatcctggaggcgacggagcgcgtgggcgggcggatgcacaagcacaacttcggcggcctcaacgtggagatcgggtttttctgggtggagggcgtcggcggcgacaagctcaaccccatctggcccatcgtcaactccacgctcaagctcaggaacttctactccgacttcgacagcgtcgtcggcaacgtctacaaggaggacggcggtggcctctacgacgaggactacgtgcagcagcgcatggaccgcgcctacgaggtggacgacatgggcaccaaccttaccaaaatgatggaccccagcggccgcgacgacatctccatcttagccatgcaacggatgttcaaccaccagccgaacgggcctgcgacgccggtggacatggtgctggactacttcatctacgactacgagttcgcggagccgccgagcgtgaccagcctgcagaacacccacccgctgcccaccgaggccgacttcggcgaagacaaccatttcgtcgccga

SEQ ID NO: 13651 - protein, 225 aa, Panicum virgatum
  misc_feature: Ceres CLONE 1770077
  misc_feature: SWISSPROT Homolog: EC 1.5.3.11 Polyamine oxidase
MKSSVVIALAAAVLLVAAQYASLADAKGPRVIIVGAGMSGISTGKRLWESGVRDLVILEATERVGGRMHKHNFGGLNVEIGFFWVEGVGGDKLNPIWPIVNSTLKLRNFYSDFDSVVGNVYKEDGGGLYDEDYVQQRMDRAYEVDDMGTNLTKMMDPSGRDDISILAMQRMFNHQPNGPATPVDMVLDYFIYDYEFAEPPSVTSLQNTHPLPTEADFGEDNHFVA

SEQ ID NO: 13652 - DNA, 678 bp, Panicum virgatum
  misc_feature: Ceres CLONE 1770089-R
  misc_feature: Encodes the peptide sequence at SEQ ID NO. 13653
gaaatggagaatccaggggatggacgagtcatctttgcctctatcagtcaattgctggccgtcggtatctggaaatgaaacctatgtcaacattgaatatgaagcttctgagatatttgatctgaacaatgttatcatatctatacctctgccagcacttcgggaggctccaagtgttcgacagatagatggagagtggaagtttgactcaagaaactctgtgttggaatggtctattctccttattgatcagtcgaatcgcagtggttccatggaatttgtcgtccccccagctgatccatcatcatttttccccatctctgttgggttttctgcatccagtacgttcagtgatttgaaggttactggaatccatcctctgaaggaaggcaaccctcccaagttttcacagcgggctcgtctgctcactgctaactaccaagtggtttaatgctcttatcaaggtcgagtgttgtatcacttaaaatacttccaacagcacatgatagtgacataatgtattttgccatgaacttctgtgagccatggcagggaggatcactttgcatttggagaatattctttttggttcctttcgtttttagcatgttgcacaaattgatgttctgatgtattgctacttaagaaataagcgtgagttcttgcgttttgattgcc

SEQ ID NO: 13653 - protein, 149 aa, Panicum virgatum
  misc_feature: Ceres CLONE 1770089-R
  misc_feature (1)..(139): Pfam Name: Adap_comp_sub Pfam Description: Adaptor complexes medium subunit family
KWRIQGMDESSLPLSVNCWPSVSGNETYVNIEYEASEIFDLNNVIISIPLPALREAPSVRQIDGEWKFDSRNSVLEWSILLIDQSNRSGSMEFVVPPADPSSFFPISVGFSASSTFSDLKVTGIHPLKEGNPPKFSQRARLLTANYQVV

SEQ ID NO: 13654 - DNA, 836 bp, Panicum virgatum
  misc_feature: Ceres CLONE 1770089
attttcccggtggagtcagtcggccaactccagtggatctcgacccgcgttgagccctccccctccgttttccctcccgatcacctcctcccccctcccctcgcggcgacgactgggcgagcggcgccacccttcctccgtcgggaccttcgccggcgaggtgcataatttgtgggcttggtgattgatagatcgagtgatcaacaaagcgattgaaaatggtggtccttgctgcttccatcgtttcaaagtcgggaaaagcacttgtgtcaagacagtttgttgacatgtctcgcataagaatcgaaggattactcgctgcattcccgaaactggttggaactgggaagcagcacacttatgttgaaacagaaaatgtgcgttatgtttatcaacctattgaaggtttatatcttctacttatcacaaacaagcagagcaacattcttgaagatctggacactttgaggctgctttccaagcttgtacccgaatactccccttccttggatgaggagggtgtctgtaaaacagcatttgagcttatatttgctttcgacgaagccatatctcttggaaataaggaaaatgttacggtgcaacaagtaaaacaatattgtgagatggagagccatgaagagaaggcacacaagctgatgatgcaagccaaaatcaatgaaaccaaggatgtcatgaagaagaaggctaatgagcttgacaaaatgaggatggaaagaggtaaacttgacaaaggaggatactcttcaatatctggtccacgtgtgattgaaaaaactttcaatgatatgagcatcagtggttctcgatttggtagt

SEQ ID NO: 13655 - DNA, 1253 bp, Panicum virgatum
  misc_feature: Ceres CLONE 1770093
  misc_feature: Encodes the peptide sequence at SEQ ID NO. 13656
aggcctatcttctagctcgggaatcccatcctcctcggctcggccatggcgcgcctgctgctgctcttcccgtcgcaagcgtgggtcgaccccggccgcctcctcctccgacaggcggagccctcgtcggtctccaagcctcccgcgcgcagccaccacggtggtcgcgtctttatcgcccgcgccgctgagcgagccttcgggccttctcccgccggagctcgccgcctcgggctcctctccgctgtccgccgtcgccctcgtccttccctctgctggaaggagggcgcctttcttggcagatcaccaaccagaggagtcattttagcttcagaagatctagatgaagctttctgtcacccttcagacaaggataataggagaagcagggatttgcttctgcaatacagtgcacttccatgttgcactacagtttggttaagtactgcacaatcagcacagtctagtgtgggaacaaagttaaatatggtttatgaggtcggagagctgtttgagctgggaattcagctgtcttatcttctcatactacttggtctacttggagctggtacattttttgtcattcgtcaggttctcgttcgtagagagcttgatctttctgccaaagagctgcaagaacaagtgagaagtggtgatgcaagtgccacagagtattttgagcttggagcagttatgctacggagaaaattttatccagccgctatcaaatatctgcagcaagcaattgaaaaatgggacagagatgagcaggatcttgcgcaggtgtacaatgccctgggggtcagttacaagcgggataacaaactggacaaggcaatccagcagtttgagaaggccgtggagctccaaccaggctatgtgaccgcttggaataacctaggcgacgcgtatgagcagaagaaagacctgaagttggccctcaaggcctttgaggaggtcctcctctttgatcccaacaacaaggttgcaaggccacgcgtggacgacctccggcagcgcgccaacatgtacaagggcgtgcctgtaaaatctgaaaagcgatagctgtattccctttcgggggtaaaattgtgcattttttcagtccctattgcagaatagtagttcaatttttgaacggtagcatttgtaaacatgatgagaagctgtggtagcctcggaatggtccctgaaggaaggcagatgtaatatgcttatcttgttggagcaatgcagaatgtcctgtaggagcc

SEQ ID NO: 13656 - protein, 339 aa, Panicum virgatum
  misc_feature: Ceres CLONE 1770093
  misc_feature (245)..(278): Pfam Name: TPR_1 Pfam Description: Tetratricopeptide repeat
  misc_feature (279)..(312): Pfam Name: TPR_1 Pfam Description: Tetratricopeptide repeat
MARLLLLFPSQAWVDPGRLLLRQAEPSSVSKPPARSHHGGRVFIARAAERAFGPSPAGARRLGLLSAVRRRPRPSLCWKEGAFLGRSPTRGVILASEDLDEAFCHPSDKDNRRSRDLLLQYSALPCCTTVWLSTAQSAQSSVGTKLNMVYEVGELFELGIQLSYLLILLGLLGAGTFFVIRQVLVRRELDLSAKELQEQVRSGDASATEYFELGAVMLRRKFYPAAIKYLQQAIEKWDRDEQDLAQVYNALGVSYKRDNKLDKAIQQFEKAVELQPGYVTAWNNLGDAYEQKKDLKLALKAFEEVLLFDPNNKVARPRVDDLRQRANMYKGVPVKSEKR

SEQ ID NO: 13657 - DNA, 728 bp, Panicum virgatum
  misc_feature: Ceres CLONE 1770100
  misc_feature: Encodes the peptide sequence at SEQ ID NO. 13658
aaaggcgggaaggtagaaaggaacattcctgaggatgatccgagaaacccagctgtcattgcagacaatgccggagataatgtcggagacattgctgggatgggatcagatctctttggctcatatgctgaatcgtcatgtgctgctcttgttgtggcctctatctcatcttttggaatcaaccatgaatttactcctatggtgtaccctcttctcgtcagctctgtgggtattgtagcatgtctcataacaacactgtttgcaactgatttctttgagataaaggctgtttttgaaatagagcctgctctgaagaaacaacttataatttccactgttgtgatgaccattggcactgcacttatcagttggctaggccttccatacaccttcaccatttttaactttggagtccagaagacagtgcatagctggcaactgttcttgtgcgtggctgttggtctctgggctggcctaatcattggtttcgttaccgagtactacacaagcaacgcctacagccctgtacaagatgttgctgattcctgcagaactggagctgccacgaatgtcatttttgggcttgctttgggatacaaatcagtcattatccctatttttgctattgcttttagcatcttcctcagcttcagccttgctgctatgtatggtgtcgctgtggctgctcttggaatgctgagcaccattgccacaggtcttgctattga

SEQ ID NO: 13658 - protein, 242 aa, Panicum virgatum
  misc_feature: Ceres CLONE 1770100
  misc_feature (1)..(242): Pfam Name: H_PPase Pfam Description: Inorganic H+ pyrophosphatase
  misc_feature: SWISSPROT Homolog: EC 3.6.1.1 Inorganic diphosphatase
  misc_feature: Useful for making plants with modulated water use efficiency
KGGKVERNIPEDDPRNPAVIADNAGDNVGDIAGMGSDLFGSYAESSCAALVVASISSFGINHEFTPMVYPLLVSSVGIVACLITTLFATDFFEIKAVFEIEPALKKQLIISTVVMTIGTALISWLGLPYTFTIFNFGVQKTVHSWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAI

SEQ ID NO: 13659 - DNA, 713 bp, Panicum virgatum
  misc_feature: Ceres CLONE 1770102
  misc_feature: Encodes the peptide sequence at SEQ ID NO. 13660
caaggacgagctcatcaagaacgccgcctacattggcacccctggcaagggtatccttgctgctgatgagtccactggcactattggcaagcgcctttccagcatcaatgtcgagaacattgaggagaaccgccgtgccctccgtgagctcctcttctgcgcccctggtgccctccagtacctcagtggtgtgatcctctttgatttttttctctaccagaagaccaaggatggcaagcccttcgtcgatgtccttaaggattgaggcgccctccccggcatcaaggtcgacaagggtaccattgaggttgctggcaccaacaaggagaccaccacccagggccatgatgaccttggcaagcgctgtgccaagtactacgaggctggtgcccggtttgccaagtggcgtgctgtcctcaatatcggccctaatcagccatcacagcttgccattgacctgaatgctcagggtctcgctcgttacgccatcatctgccaggagaacggtctggtgccgattgttgagcctgagatccttgttgatggtccgcatgacattgagcgctgcgcttatgtcaccgagatggtccttgctgcctgctacaaagctctgaatgagcaccatgtcctcctcgagggtaccctcctgaagcccaacatggtcacccctggatctgatgccaagaaggtggcccctgaggtgattgccgagt

SEQ ID NO: 13660 - protein, 87 aa, Panicum virgatum
  misc_feature: Ceres CLONE 1770102
  misc_feature: SWISSPROT Homolog: EC 4.1.2.13 Fructose-bisphosphate aldolase
  misc_feature: Useful for making plants with modulated phosphate use efficiency
  misc_feature: Useful for making plants with modulated biomass
KDELIKNAAYIGTPGKGILAADESTGTIGKRLSSINVENIEENRRALRELLFCAPGALQYLSGVILFDFFLYQKTKDGKPFVDVLKD

SEQ ID NO: 13661 - DNA, 847 bp, Panicum virgatum
  misc_feature: Ceres CLONE 1770124
  misc_feature: Encodes the peptide sequence at SEQ ID NO. 13662
ctagccgagttccgcagagaaaggcgtctttgtactcgcctctccggctgcaaagcttcctcgcccctcccatttcccaccgccgccgccccaccccacccctccgacgacaccatgagggagtgcatctcgatccacatcggccaggccggtatccaggtcggaaacgcgtgctgggagctgtactgcctcgagcatggcattcagcctgatggtcagatgcccggtgacaagacagttggaggaggtgatgatgcattcaacaccttcttcagtgagactggcgctgggaagcatgtcccccgtgctgtgttcgttgatcttgagcccactgtgattgatgaggtgaggactggcacatatcgccagctcttccaccctgagcagctcatcagtggcaaggaggatgctgccaacaactttgcccgtggtcactacaccattggcaaggagattgttgacctgtgccttgaccgcattaggaagcttgccgacaactgcactggtctccagggcttcctcgtcttcaatgctgttggtggaggaacgggctctggccttggttccctcctccttgagcgcctgtctgttgactacggcaagaagtccaagctcgggttcactgtgtacccatctccccaggtctccacctcagttgttgagccatacaacagtgtcctgtccacccactccctccttgagcacactgatgtcgctgtcctgcttgacaacgaggccatctacgacatctgccgccgctcccttgacattgagcgcccaacctacaccaacctcaacaggcttgtgtctcaggttatctcatctctgactgcctccctgaggttcg

SEQ ID NO: 13662 - protein, 244 aa, Panicum virgatum
  misc_feature: Ceres CLONE 1770124
  misc_feature (49)..(244): Pfam Name: Tubulin Pfam Description: Tubulin/FtsZ family, GTPase domain
  misc_feature: Useful for making plants with altered cell wall content and/or composition
MRECISIHIGQAGIQVGNACWELYCLEHGIQPDGQMPGDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRF

SEQ ID NO: 13663 - DNA, 668 bp, Panicum virgatum
  misc_feature: Ceres CLONE 1770124-R
  misc_feature: Encodes the peptide sequence at SEQ ID NO. 13664
gccatcctccatgatggccaagtgtgaccctcaccatggcaagtacatggcctgctgcctcatgtaccgtggagatgttgtgcccaaggatgtgaatgctgctgtggccaccatcaagaccaagcgcaccatccagtttgtggactggtgcccgactgggttcaagtgcggcatcaactaccagcctcccagtgtggtgcctggtggtgatctggccaaggtgcagcgtgccgtgtgcatgatctccaactccaccagtgtggttgaggtgttctcccgcatcgaccacaagtttgacctcatgtatgccaagcgcgccttcgtgcactggtacgtgggtgagggcatggaggagggtgagttctccgaggcccgtaaggaccttgccgcgctggagaaggactatgaggaggtcggtgctgagtttgacgatggtgaggagggtgacgagggtgatgagtactagacccttcctggtgcatctgtgtcaggcctgcgtgctgctattatccagtgatctgccttagtggctcgtgctatcgtgttatgtgttgtctgtcggtttgaactatcagttgtgttaacgtgtggtttacaacacctgatgttgtaagaactctatgttgaatttcctgctctgctactgggtaatgaatgtcgttatgatc

SEQ ID NO: 13664 - protein, 154 aa, Panicum virgatum
  misc_feature: Ceres CLONE 1770124-R
  misc_feature (1)..(96): Pfam Name: Tubulin_C Pfam Description: Tubulin/FtsZ family, C-terminal domain
  misc_feature: Useful for making plants with altered cell wall content and/or composition
PSSMMAKCDPHHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEARKDLAALEKDYEEVGAEFDDGEEGDEGDEY

SEQ ID NO: 13665 - DNA, 644 bp, Panicum virgatum
  misc_feature: Ceres CLONE 1770134-R
  misc_feature: Encodes the peptide sequence at SEQ ID NO. 13666
gaagtaactcctagaactgtcggagcactgattgctctttatgaacgtgctgtggggatttatgcttctttggtaaatataaacgcttatcaccagcctggtgttgaggctgggaaaaaggcagctggagaagtactggcacttcagaaaagggtgctgactgtattaaatgaggccgcttgcaaggaccctgctgagccattgaccctggatgaaattgcagatcgctgtcactgcccagaagatatcgagatgatctacaaaataatccagcacatggctgcgaatgacagagcgcttatagcagaaggcagctgtggttctcctcgcagcgtcaaggtgtatcttggagaatgcaatgtagatgaagacatgcaggctgcatagattcggggcagtcggaattggtgtaaaattgtgttggaataaaaagagcagcgccatggtgtggccatgcgtgcgtgttcctgatgtgccatcacccatttgtttcttgtttgaatgtggcacggttgctgcaacgatgtatcttttattccccttgggtctccctttgcatacaaaatacaaagggatgaagaaagatagctgcatcactcacgctcgtttaaacgcatcttcaattcgaatatgcttttggcatc

SEQ ID NO: 13666 - protein, 128 aa, Panicum virgatum
  misc_feature: Ceres CLONE 1770134-R
  misc_feature: SWISSPROT Homolog: EC 5.3.1.9 Glucose-6-phosphate isomerase
  misc_feature: Useful for making plants with modulated flowering time
EVTPRTVGALIALYERAVGIYASLVNINAYHQPGVEAGKKAAGEVLALQKRVLTVLNEAACKDPAEPLTLDEIADRCHCPEDIEMIYKIIQHMAANDRALIAEGSCGSPRSVKVYLGECNVDEDMQAA

SEQ ID NO: 13667 - DNA, 818 bp, Panicum virgatum
  misc_feature: Ceres CLONE 1770134
aaaaaaaaaaaaaaaatcccgctccctacctctccagctcccctgctgcttcatcagctcctctgtttcttccgtcttcccgcccaggcctagccgccgtgagccgtggccatgcccgtcgccgcgctccaccctctcccggccatcgtcggggccggccgccgcagggcccgacgccaccggcgtttcggcctctgcgcgagctccctggagtcgccgtcggtggcctcgacggtgctggatggcgtggcagggcccccggtggagaggaaggagaaggtgaaggacgatgcggcggcggcggagaaggaagagaacaaggggctgcacgccctctacgacgacggcttcggcggcgtcaccgtcaaggactacttcgcggcggccaaggccgtgtccagggacgacggcggcccgccgcgctggttctgccccgtcgagtgcggccgcccggcggtggacggcgcgccgctgctgctcttcctgccaggaacggatggcgtcggaatggggctcatcctgcaccacaagtcgttgggcaaagtattcgaggttcgttgcttgcacataccagtcaatgatcgtacaccatttgaagctacatcatttgcaaagactccattacagcccatattgcctcttttggaatcaatgccaagcgagtttcatgttacagttccgtatcttctcagttttgtcatgggtgaccccctgaagatggcttcggttagcattgaaaacaatctatctcctccagaaactctacagaaattgtcagatagtctcacttcaatgctacctttactttcggaattgcc

SEQ ID NO: 13668 - DNA, 2601 bp, Panicum virgatum
  misc_feature: Ceres CLONE 1770135
  misc_feature: Encodes the peptide sequence at SEQ ID NO. 13669
acagaggaaaagaaatcgcaacgagaacatcgtttcttcttcctccctcccttcgcttcgcccccaagcgagcgccgcgggcgaaaccctagcctccccctccccaccaccacctcgctgggaacccagcgccgagcaggcggcggcgccggcggccgcgggggagaggggcaagatgatgaacggccagaagaagcgcgggccgaagatcgagcccttccgtcacaaggtcgagaccgaccccaagttcttcgacaagtcgtggcggaagctccacgacgccatccgcgagatctacaaccacaacgccagcggcctctccttcgaggagctctacaggactgcttataacatggtactgcacaagtttggtcctaagctctatgaaaaactcacagaaaacatgaaagagcatcttgaagagatgcgtacatgtgtagaggcagcgcaaggtggtttgttcctggaagaattagagagaaaatggaatgaccataacaaggcattgacaatgattagagacattctgatgtacatggacaggacatatattcccactaataaaaagacacctgtctttgatcttggattggagctttggagggataccatagttcgatctcccatgattcaggggaggttgcttgacacacttcttgaactcatacatagagaaaggaccggtgaagtgataaatagatgcttgatgaggactacgactaaaatgcttatgaatctagggtcttctgtttatcaggatgattttgaaaggccatttcttgaggtgtctgctagtttctacagtggtgagtcacagcaattcattgatcgctattcttgtggtgactatctgaagctggctgagaggcgcctcagtgaagaatcagagcgtgtttcacagtatatggatgtgaaaacaaatgagaagattactgctgttgtggtgaaagagatgctagcaaatcacatgcggaggttgattcttatggagaactctgggcttgtaaatatgcttattgaagacaggtatgaagacctgaccaggatttacactctgtttaatcatgttcttgacggactcacaacgattagatctgtgatgatgtctcatattaaggatactggaaagagtctggtaacagacccagagagactgaaggatccggttgattttgtccagcgacttctaaatgagaaggataagtatgacaatatcatcaatgtgtcatttaacaatgacaagagtttcctgaatgctctgaattcctcatttgagcacttcatcaacctaaacaacagatcccctgagttcatatcactgtttgttgatgacaaactgcggaagggggtgaaagaagccaatgaggaggatcttgagactgtcctggacaaggtgatgatgctgtttaggtacttgcaagaaaaggatctatttgagaagtattacaagcaacacttggcaaagcgtcttctatctgggaagactgcttctgatgaatctgagaggagcatgcttgtgaagctgaagacagaatgtggataccagtttacttcgaagttggagggcatgttcactgatttgaagacctctcaggatactacgcaagggttttatgcgtctacttcggatctggcagattaccccacgatatctgtccagatactcaccactggttcatggccaacacaaccctgcaatacctgcaacctgccccctgaaatagttgctgtctctgagaagtttcgggcatgttaccttggcacccacaatggcaggaggctgacatggcaaactaacatggggaatgctgacatcaaagcaacatttggaaacggcagcaagcatgaactgaccgtctcaacctaccagatgtgcgttctcatgctatttaacacatcagatgtcttgacttaccgtgaaattgagcagtctacagcaataccagctgttgacctgaagcgatgcctccagtccctggctcttgttaagggtaagcaagtcctgcgcaaggagcccatgagcagggacattgccgacgacgacagcttctgtgtgaacgacaagttcaccagcaagctgttcaaggtgaagattggcactgtgttggcgcagaaggagacagaccctgagaagctggagacccgtcagcgggtcgaggaggacaggaagccgcagatcgaggcagccattgtgcggatcatgaagtcgaggcgggttctggaccacaacagcatcatgactgaggtgacgaagcagctgcagcccaggttcctgcccaaccctgtggtgatcaagaagcggatcgagtccctcattgagcgtgagttcctggagcgggacaagacggacaggaagatgtaccgctatctcgcctagaaccagcccccttgcattccgattttcattttaagctacctggtatcatataaacagaccttgatccatgtacttatgcaagaaggaaatgggtctctctctgcttcccctgacaagtctagtctaaactggtttttgttgcgtttgtccaggtggtagctagttagcttctctgtgtgacatgacatcttgcgctggtttatacatgttaatgcgatagatat

SEQ ID NO: 13669 - protein, 732 aa, Panicum virgatum
  misc_feature: Ceres CLONE 1770135
  misc_feature (29)..(631): Pfam Name: Cullin Pfam Description: Cullin family
  misc_feature: Useful for making plants with modulated biomass
MNGQKKRGPKIEPFRHKVETDPKFFDKSWRKLHDAIREIYNHNASGLSFEELYRTAYNMVLHKFGPKLYEKLTENMKEHLEEMRTCVEAAQGGLFLEELERKWNDHNKALTMIRDILMYMDRTYIPTNKKTPVFDLGLELWRDTIVRSPMIQGRLLDTLLELIHRERTGEVINRCLMRTTTKMLMNLGSSVYQDDFERPFLEVSASFYSGESQQFIDRYSCGDYLKLAERRLSEESERVSQYMDVKTNEKITAVVVKEMLANHMRRLILMENSGLVNMLIEDRYEDLTRIYTLFNHVLDGLTTIRSVMMSHIKDTGKSLVTDPERLKDPVDFVQRLLNEKDKYDNIINVSFNNDKSFLNALNSSFEHFINLNNRSPEFISLFVDDKLRKGVKEANEEDLETVLDKVMMLFRYLQEKDLFEKYYKQHLAKRLLSGKTASDESERSMLVKLKTECGYQFTSKLEGMFTDLKTSQDTTQGFYASTSDLADYPTISVQILTTGSWPTQPCNTCNLPPEIVAVSEKFRACYLGTHNGRRLTWQTNMGNADIKATFGNGSKHELTVSTYQMCVLMLFNTSDVLTYREIEQSTAIPAVDLKRCLQSLALVKGKQVLRKEPMSRDIADDDSFCVNDKFTSKLFKVKIGTVLAQKETDPEKLETRQRVEEDRKPQIEAAIVRIMKSRRVLDHNSIMTEVTKQLQPRFLPNPVVIKKRIESLIEREFLERDKTDRKMYRYLA

SEQ ID NO: 13670 - DNA, 839 bp, Panicum virgatum
  misc_feature: Ceres CLONE 1770141
  misc_feature: Encodes the peptide sequence at SEQ ID NO. 13671
atcgcgtcgtcgtcgaaaccctttgcccctcccaaatcgcggaaaccctagcccccaaatcataccgcagcagcagcagctggtactgaaccctatcctctcgccgaggcctcgactttctttcttctttgcagccaccgccgctccaatcccccttacttccccagctccgctcgctagatccattcatgatgggagagaccaaggagaacgacgtatacgaggaggagctcctggactacgaggaggacgacgacaagacagtcgatggctccgccgccaagcccaccggagaggtcgcgaagaagggctacgtcggcatccacagttccgggttcagagacttcctcctcaagccagaactgcttcgtgctatccaggactgcggttttgagcatccatccgaagtgcaacacgagtgcatccctcaagcaattcttgggatggatgtcatatgtcaagcaaaatctgggatgaggaagactgcagtttttgtcctatcatccctccaacagattgatcctgttgcgggtcaggtagcagcacttgtattgtgccacacaagggaactcgcctaccagatctgccatgagtttgagaggttcagcaaatatctgcctgaagttaaagttgctgtcttctatggaggagttcacatcaggaagcataaagatttgctgaagaatgagtgccctcatattgtggttggcacacctggaaggatacttgctcttgccagagagaaggatctatcactcaagaatgtgcgacatttcatccttgatgaatgtgacaagatgctcgagtcacttgatatgcggagagatgtccaggagatc

SEQ ID NO: 13671 - protein, 216 aa, Panicum virgatum
  misc_feature: Ceres CLONE 1770141
  misc_feature (72)..(214): Pfam Name: DEAD Pfam Description: DEAD/DEAH box helicase
  misc_feature: Useful for biocontainment applications
  misc_feature: Useful for making plants with modulated biomass
  misc_feature: Useful for making plants with modulated cold sensitivity
MMGETKENDVYEEELLDYEEDDDKTVDGSAAKPTGEVAKKGYVGIHSSGFRDFLLKPELLRAIQDCGFEHPSEVQHECIPQAILGMDVICQAKSGMRKTAVFVLSSLQQIDPVAGQVAALVLCHTRELAYQICHEFERFSKYLPEVKVAVFYGGVHIRKHKDLLKNECPHIVVGTPGRILALAREKDLSLKNVRHFILDECDKMLESLDMRRDVQE

SEQ ID NO: 13672 - DNA, 1672 bp, Panicum virgatum
  misc_feature: Ceres CLONE 1770142
  misc_feature: Encodes the peptide sequence at SEQ ID NO. 13673
ccacgcctcgtccccgtccccggccatgcctctcctcttcctccccggcgccgccctcgccgccgtgtccctgcttccgccccgctgccgcctctgcctcaccctcacccgcgcggccgccaccccgaccccagctcccgcgagcaccttcgccgtcgaggactacctcgtcgccagctgcaacctcaccccgccgcaggcgctcaaggcgtccaagagcctcgcgcacctcaagactgcctccaacgcggacgccgtgctcgccttcctcgcgggcctcgggctcttcccgaaggaggtcgccgccgtcgtggcctccaacccgcgcgtcctctgcgcgcgcatcgaccggtccctggcgcccatctccgcggagctccgcgcgctggggctctccccgtcccagatcgcgcgcctcgcgcagatcaccggccggtacttcctctgccgcagcttcgtctccaaggtgcggttctggctcccgatcttcggctccccggagcggctgctccaggccagcgactggaactactggctcctcacctccgacctcgagaaggtggtcgagcccaacgtcgcatacctcaaacagtgcgggctcagcgccgccgacatcgccaagctgctcgttgccgcgccacggctcgtcaccatgcacccggagtacgttcaggacgccgtgcgacgcgccacgcagctcggcgtggcgcccggctcccagatgttccgccacgcgctctctaccgcgggatgcatcggccaggagaaggtcgatgccaaggtcgccgtcctgaaagagacgctcggctggtcgcaggaggaggtgaacctggccgtcagcaaggcaccgcggatcctggtcgcgtccgaggagaggctgcgccggaacgctgagttcctgctcaacgaggtcgggctgccgccgcagtacatcgcgcgccggtcggtgctcctcatgtacagcctcgagaggcgggtagtgccccggcaccttgtgctgaaggctctcaaggagaaggggctggttgaacaagatcggtgcttcttcaacgtggtcgcgccgaccgaagataagttcttggagaaattcgttgctccctacgaggaatccatccccggccttgcagatgcttatgagtctgcttgtgcggggaaggtgccagaggcatttcaacattgactgcaatggaaggagaatttggaggaatatctttggtcacagtgcttggttacaacttggaaatacaaattaactatgaaggaaggtctgcatttgtttcattgtcattgggctacgggagtacaaaattagtgttttccttgaagaagtgaaccatctcagccaagctatatatgcacaatgctgaggtgttacctaggcatccgttgacaacaatttcatcagaacacaagcaatacaacgacgtttggattttggatggaaggaatgctcctcttgtagaattcttcgtggctggagaggcgacttcagttggacaggctaacagactttgattctgttgtatgtaatatgtaaccccaggcttgatttgagaaaaattcctttttgagagttttctcatggagatgattctgtaaagagaggtagaagctgtgcagggtagctgccggagggatttgaacattgactagaaccacatggagagttagg

SEQ ID NO: 13673 - protein, 384 aa, Panicum virgatum
  misc_feature: Ceres CLONE 1770142
  misc_feature (46)..(353): Pfam Name: mTERF Pfam Description: mTERF
MPLLFLPGAALAAVSLLPPRCRLCLTLTRAAATPTPAPASTFAVEDYLVASCNLTPPQALKASKSLAHLKTASNADAVLAFLAGLGLFPKEVAAVVASNPRVLCARIDRSLAPISAELRALGLSPSQIARLAQITGRYFLCRSFVSKVRFWLPIFGSPERLLQASDWNYWLLTSDLEKVVEPNVAYLKQCGLSAADIAKLLVAAPRLVTMHPEYVQDAVRRATQLGVAPGSQMFRHALSTAGCIGQEKVDAKVAVLKETLGWSQEEVNLAVSKAPRILVASEERLRRNAEFLLNEVGLPPQYIARRSVLLMYSLERRVVPRHLVLKALKEKGLVEQDRCFFNVVAPTEDKFLEKFVAPYEESIPGLADAYESACAGKVPEAFQH

SEQ ID NO: 13674 - DNA, 855 bp, Panicum virgatum
  misc_feature: Ceres CLONE 1770143
  misc_feature: Encodes the peptide sequence at SEQ ID NO. 13675
agaccaacaggcaccttcaacttgagcggagcaggcgaggcggaggcggagatggcgctgcgacgggctctcctcagatcggccgagatctcccccgaccgcaaggctgcaattgagtattttcattcattatcaagggcacagcctgcttgttctctcaatggtgccggcctttgccctgctagcagatcatttagtacccaggctgctactacatcaagtacaccacagcctccaccaccacctccccctccagagaagactcacttcggtggcctcaaagatgaagaccgcatttttaccaacctctatggtctgcatgacccttttctgaaaggtgcaatgaagaggggtgactggcataggaccaaggatttggtgattaagggggcagactggatagttaatgaaatgaagaaatcaggcctccggggacgtggaggtgcaggtttcccctctggtctcaaatggtcctttatgcccaaggtttcagatggacgtccttcttatcttgttgttaatgctgatgagagtgagcctggaacttgcaaagatagagaaatcatgcgtcatgaccctcacaaacttctggaaggatgccttattgctggagttggaatgagggcatccgctgcttacatctacattagaggtgaatacgtgaacgagcgtctcaaccttgagaaagcccggcaggaagcatatgcagctggacttcttggtaaggatgcttgcggatctggttatgattttgatgtgcatattcattttggtgctggtgcatacatctgtggtgaagagactgccctacttgagagccttgaagggagcagggcaaacctaggctgaagccgc

SEQ ID NO: 13675 - protein, 265 aa, Panicum virgatum
  misc_feature: Ceres CLONE 1770143
  misc_feature (101)..(264): Pfam Name: Complex1_51K Pfam Description: Respiratory-chain NADH dehydrogenase 51 Kd subunit
  misc_feature: SWISSPROT Homolog: EC 1.6.99.5 NADH dehydrogenase (quinone)
MALRRALLRSAEISPDRKAAIEYFHSLSRAQPACSLNGAGLCPASRSFSTQAATTSSTPQPPPPPPPPEKTHFGGLKDEDRIFTNLYGLHDPFLKGAMKRGDWHRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYAAGLLGKDACGSGYDFDVHIHFGAGAYICGEETALLESLEGSRANLG

SEQ ID NO: 13676 - DNA, 800 bp, Panicum virgatum
  misc_feature: Ceres CLONE 1770158
  misc_feature: Encodes the peptide sequence at SEQ ID NO. 13677
gctggctccattcacatctcctccccctccaccccctcccccgtgaggtctctctcccatctcttcctccgatctcccccgcggccgccgccgccgcatcccgtccgaaccctagacccgtctacgcgcccattgcctccgatcgccatgtccgccgctcagctgttccgtcactcccgcaagctgcggagcttgcaaaatgctgtagattgcgagcgttctggtcttgttcggtatttctctagcagttccggttcctttatcgtcaaggaaaatggtgttggaaagagaactggaggcaccagattatctaagcatagccagcctgcaaaagagcttgagacattctcagtgggagtaaacagaagctacacttggacaagagcatccaacagccgtatcccaagtgctgttagcggtctcaatggttcattttcatgtggacaggtggcttcagctcgaccattctcaagtagtgcagacttgccaccacatcaagaaatcgggatgccgtcactttcgcccacaatgactgagggaaacattgccaagtggcttaagaaggaaggagacaaggtctcccctggtgaggttctctgtgaggtggaaactgataaagccactgtggaaatgaagtgcatggaagagggctatcttgctaagattattcatagagatggtgctaaggagattaaagttggcgagatcattgctgtaactgtggaagaagagggtgacattgagaagttcaaagattataagccgtcatcttctgctgaacctgtagctcctactgaatc

SEQ ID NO: 13677 - protein, 217 aa, Panicum virgatum
  misc_feature: Ceres CLONE 1770158
  misc_feature (117)..(191): Pfam Name: Biotin_lipoyl Pfam Description: Biotin-requiring enzyme
  misc_feature: SWISSPROT Homolog: EC 2.3.1.12 Dihydrolipoyllysine-residue acetyltransferase
MSAAQLFRHSRKLRSLQNAVDCERSGLVRYFSSSSGSFIVKENGVGKRTGGTRLSKHSQPAKELETFSVGVNRSYTWTRASNSRIPSAVSGLNGSFSCGQVASARPFSSSADLPPHQEIGMPSLSPTMTEGNIAKWLKKEGDKVSPGEVLCEVETDKATVEMKCMEEGYLAKIIHRDGAKEIKVGEIIAVTVEEEGDIEKFKDYKPSSSAEPVAPTE

SEQ ID NO: 13678 - DNA, 602 bp, Panicum virgatum
  misc_feature: Ceres CLONE 1770158-R
  misc_feature: Encodes the peptide sequence at SEQ ID NO. 13679
gaacgtgctgtggggatttatgattctttggtaaatataaacgcttatcaccagcctggtgttgaggctgggaaaaaggcagctggagaagtactgccacttcagaaaagggtgctgactgtattaaatgaggccgcttgcaaggaccctgctgagccattgaccttggatgaaattgcagatcgctgtcactgcccagaagatatcgagatgatctacaaaataatccagcacatggctgggaatgacagagcgcttatagcagcaggcagctgtggttctcctcgcagcgtcaaggtgtatcttggagaatgcaacgtagatgaagacatccaggctgcatagcttcggggcagtcggaattggtgtacaattgtgttggaataaaaagagcagcgccatggtgtggccctgcgtgcgtgttcccgatgtgccatcacccatttgtttcttgtttgactgtggcacggttgcggcaacgaagtatcttttattccccttgggtctccctttgcatacaaaatacaaagggatgaagaaagatagttgcatcactcacgctcgtttaaacgcatcttcaatttgaatatgcttttggcatc

SEQ ID NO: 13679 - protein, 114 aa, Panicum virgatum
  misc_feature: Ceres CLONE 1770158-R
  misc_feature: SWISSPROT Homolog: EC 5.3.1.9 Glucose-6-phosphate isomerase
  misc_feature: Useful for making plants with modulated flowering time
ERAVGIYDSLVNINAYHQPGVEAGKKAAGEVLPLQKRVLTVLNEAACKDPAEPLTLDEIADRCHCPEDIEMIYKIIQHMAGNDRALIAAGSCGSPRSVKVYLGECNVDEDIQAA

SEQ ID NO: 13680 - DNA, 3123 bp, Panicum virgatum
  misc_feature: Ceres CLONE 1770160
  misc_feature: Encodes the peptide sequence at SEQ ID NO. 13681
ctctctctctctctctctctctctctcccacgagattctattctacgccgccggaatcagacgtgccgcatcgtcggcgacctcgccgccggcgactcggttgtacagcggacccggggtccttgaactgaagtcctctctggtggcggtggtggtggagaggcgtctccctcgaccctcgtcctcctgctgccggccctctgctgcaggagctggagtggagatccatccaccccgcacctgccacgatctcttctttctcgtgtcggtagccgccccgcgattgcttggacggattgctctgagggttggctttgctggcggtctaatccaaatctgtctcgctccctctattctcttctctccgtccagttggccgcggatttgcgtgctgtgctgtggcgccgccctgaaatcgaatccatggttgggttcggcttggttcgtcttcatcagcgctcaggatcagtctagccggcgcgcgggcgccgtttggttgtcggaagacattttggagctcaagtgaaccccccatgccccaggtgaggtccggccccgatggcgccggcggggaatacatcaagtggatgtgcggcgccggcggccgagcgggcggcgccatggccaacctccagcgcggcgtcggctcccttgtccgggacatcggcgacccctgcctcaacccctccccagttaaggggaacagaatgctcaaaccagaaaaatggcagacatgttttgacagcgacggaagggttatatgtttccggaaagcccttaaattcattgtcttagggggagtggatccttctattcgagcggaagtttgggaatttcttcttggctgctatgccttaagcagcacgtcagaatataggggaaagttaagagctgctcgaagggagaggtatcattatttagttagacaatgccagagcatgcatgcaagcattggtacaggtgagcttgcctacgctatcggatcgaagcagatggatgtcaggactttgcccaaagaaatttgtactggagaagaagtcagcacgagtcagcaaacttcacatgaagcaccttgcaatgtagtggaaaattccaatttgaattgcgggtctgatggcacacctcagtctcagaaacgaaaaggctgtagtaaatcagcagaaccaattggttttaatatacataatgatagctctgtatatgattcttccagttttatggtaccttccacagcggtgaatagttgcttgagagatttcggagattatgatgacattggtgaaccaagatatgacagtgagaccttcaccaatttaccttccctgtctggtacaaacttggttgcaaatggtggtgagaatagcaatggagttgaggaaagtcattgtagtttctcggttcctgaagataggttaaggccccgtgatgaacgcatgcacagcttccaaatcaataataacatagatctgattatagagtcaaattcattctccaatgatctgtttcgacctagcaacagtgactcagccatctttcactccgatgcatacaagcaggatagatggttagatgatggctatagtaaggaaattatagactccttgaggatatctgatgcaccagaagcagatttagttgatggaaccaaatcaaatggttcaattgccgacaaggatagaatctccgaatggctttggacactgcatcgaattgtggtcgatgtggtgagaacagatagtcaccttgatttctttggagaatcaaggaatatggctagaatgtctgatatgcttgcagtttatgcatgggttgatccctccactggatactgtcaaggtatgagtgatctgctgtcaccttttgttgttatatatgaggatgatgcggatgccttttggtgctttgagatgctactgagaaggatgcgtgaaaatttccagatggagggaccaatgggagttatgaagcaattgcaagcattgtggaagatcatggaactgacagatattgaattatttgaacatttgtcggcaattggtgctgaaagccttcatttcgctttccggatgctgctagtgctttttcgccgggagctatcttttgaggaatcactgatcatgtgggagatgatgtgggctgctgattttgatgaagaagcaatcaggcgtttagaagagaactgtctaggaccattgctggttgatctgaggactgatttatcatgtgaagttaaagaagtgcctcggatgaacagttccacgagaagaaaatccaaaaccaggaaatcccatcgtaggaatggtgaaatctgtggagcttgccaccctggaacgagatccagtacaagaaatcatctttgtggtttgtcaggtgctactatatgggcaaggcctcagcagatgccacaactgagtgcaaatgtgctggcaaggagtggagatgacgaactgcctattttctgtgtagcggcaatcttgataatcaatcgccacaggataattagagggacccgctcaatagatgatgcaatcaagatgttcaacgacaatgtgctaaaaatcaatgtaaaaagatgcgtacgcttggccatcaagctgaggaagaagtacttgtacaagtcattgaaaggaggctcgagtgatgataaagaaagttgaagggcctgcatttccgttgtagaaaaatactaggtatttctccatcatgcattactgactagggttggtgaagcggtattggccagaagtccagcacatctccaagatccgttactcagcattgcaaggaaacatgtacatactagtatacttgaacacaacagatgaagctgttgaagtaaagaagaagaaaaaaagaattgattccaccgtgctgctgtattactggtgttgtcattgttttcgttgtgcccatttggcagggataatgcacgtgatgattgtatttatcgatctggaggtttgagtggggtgtgccctgtgcagggcatgcaaatcacacggaagaatggaacagaaaaagaaagggttgaagtgtacaaagtgtgaaccgggcaatccattctttggagcaaaactagtttaagcggtttcacgtcgttatgaatgcaaattatttcatatt

SEQ ID NO: 13681 - protein, 707 aa, Panicum virgatum
  misc_feature: Ceres CLONE 1770160
  misc_feature (345)..(545): Pfam Name: TBC Pfam Description: TBC domain
MPQVRSGPDGAGGEYIKWMCGAGGRAGGAMANLQRGVGSLVRDIGDPCLNPSPVKGNRMLKPEKWQTCFDSDGRVICFRKALKFIVLGGVDPSIRAEVWEFLLGCYALSSTSEYRGKLRAARRERYHYLVRQCQSMHASIGTGELAYAIGSKQMDVRTLPKEICTGEEVSTSQQTSHEAPCNVVENSNLNCGSDGTPQSQKRKGCSKSAEPIGFNIHNDSSVYDSSSFMVPSTAVNSCLRDFGDYDDIGEPRYDSETFTNLPSLSGTNLVANGGENSNGVEESHCSFSVPEDRLRPRDERMHSFQINNNIDLIIESNSFSNDLFRPSNSDSAIFHSDAYKQDRWLDDGYSKEIIDSLRISDAPEADLVDGTKSNGSIADKDRISEWLWTLHRIVVDVVRTDSHLDFFGESRNMARMSDMLAVYAWVDPSTGYCQGMSDLLSPFVVIYEDDADAFWCFEMLLRRMRENFQMEGPMGVMKQLQALWKIMELTDIELFEHLSAIGAESLHFAFRMLLVLFRRELSFEESLIMWEMMWAADFDEEAIRRLEENCLGPLLVDLRTDLSCEVKEVPRMNSSTRRKSKTRKSHRRNGEICGACHPGTRSSTRNHLCGLSGATIWARPQQMPQLSANVLARSGDDELPIFCVAAILIINRHRIIRGTRSIDDAIKMFNDNVLKINVKRCVRLAIKLRKKYLYKSLKGGSSDDKES

SEQ ID NO: 13682 - DNA, 821 bp, Panicum virgatum
  misc_feature: Ceres CLONE 1770161
  misc_feature: Encodes the peptide sequence at SEQ ID NO. 13683
cctgaccgccaggcagcctctcccctcccgagccgccgtcacctgcgcctccgcctcatccccgcgccgccgaagcggttagtcttcacctgcagccatgggtaaggagaagtcccacatcaacattgtggtcattggccacgtcgactctggcaagtcgaccaccaccggccacctgatctacaagcttggaggtatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagtttgagaccaccaagtactactgcaccgtcatcgatgcccctggacaccgtgacttcatcaagaacatgatcacgggtacctcccaggctgactgtgctgtccttatcattgactccaccactggtggttttgaggctggtatctccaaggatggccagacccgtgagcatgctctccttgctttcactcttggagtcaagcagatgatctgctgctgcaacaagatggatgccaccacccccaagtactccaaggcccgttatgatgagattgttaaggaagtctcctcctacctgaagaaggttggctacaaccctgacaagatcgccttcgtccccatctctggttttgagggtgacaacatgattgagaggtccaccaaccttgactggtacaagggcccaaccctgcttgaggctcttgaccagatcaacgagcccaagaggccttcggacaagcccctgcgtctcccccctcaggatgtgt

SEQ ID NO: 13683 - protein, 241 aa, Panicum virgatum
  misc_feature: Ceres CLONE 1770161
  misc_feature (5)..(225): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPPQDV

SEQ ID NO: 13684 - DNA, 2025 bp, Panicum virgatum
  misc_feature: Ceres CLONE 1770164
  misc_feature: Encodes the peptide sequence at SEQ ID NO. 13685
acaactagaaagcacagctgtgcactggccagtgcacgctgaaagccaccataccgttgtcaaacttttttttttaaaaaaaggagccgctcttacaagaggacgccgcttcccgtccccgagacagcaacggtcagacccgagctcccagaaggcgagaacaccaaggccaggcagcctccaacagagcagacgccagaggaagccgtggcagcattcatggccgccgcccagccgccccgggctctccccctcctcctcctgctgctctgcgccgccttctccttccacggtaagcgcgcgcgacgcgagccacccttctgtcctccgccgccacgccgtctcgccggcggaaggctggagctacggcgaactgagctgagctcaaagctcgtgtttttcttgggttatttttcttgcagtggaagcggcgcacggggcgagtggcggcgcccacgggctcggcgtcaactacggccgggtggcggacgacatcccctcgccgcggcggtccgtggagctcctccgcgcggctggcgccgggtccgtcaagatctacgacgccaacccgggcgtgctccgcgcgctggcgggcacgcgctggcccgtctccatcatggtgcccaacgagatcatcccggacatcgccgcctcgcccgccgccgcggaccgctgggtcgccgacaacctggtcccctactacccggcgacgcgggtcaagttcctgctcgtggggaacgaaatcctctccgactactccatcgccaactccacctgggcgcgcctcgtcccggcgatggagaacatccacctcagcctccgcaagcggggcatcagcagcgtcaagatcggcaccacgctcgccatggacgcgctcgccgacggcgccttcccgcgcccaccgtccgccgcggccttccgccccgacatcgccgggtccgtcgtgcgcccgctgctgcacttcctgaacgggaccaactcctactacttcgtcgacgcctacccctacttcgtctgggcgggcaacaacctcaccgtcccgctcgactacgcgctcttccagggcgggcgcacccgctacgtcgacccgggcaccgggctgacatacaccaacctgctcgacgaaatgcttgacgcggtggccatcgcgatggccaagctcgggtacggcggcgtcaagctggccgtcgcggagactgggtggcccaacggctgcgactacgaccagattggcggcaacgtccacaatgccgccatatacaacaggaacctcgcggcacggatggccaagaaccctggcacgccgctgcggccgggagccaagatgccggtgttcgtgttctctctctacaacgaggacctcaagggcgggcccggcaccgagcggcattggggtctgtactacgccaacggtacggcagtctacgaggtcgacctcaccggtcggcggccgctgtgttcgtacccgcctctgccggcgccggagaacaacacgccgtacaaggggccaatttggtgcgtcatgtctcccgccgccagcaagaagctgaacgagacggcggtggggaacgcgctatcgtacgcgtgcggccaaggaaacgggacctgcgacgccatccagcccgggaagaagtgctacctgccgaacacgacggtggctcatgccagctacgcgttcaactcgtactggcagcagttcaggaggactggagcgacgtgctacttcaacaacctcgcagagcagactatcaaagacccaagccatggatcctgcaagttccgcagctccttggactcctaagtcctaactgaccgggacgagaacagagggggataaaacaatgtgattcttgattttgtgtagtcatgatttagacgggcttgggggagctaggagggaggggacttgcttttggcaccgtagatgtcatgttccttctcatcacttcttactcagacttttggctgtgacagcggagacttgctcgtgctcacttcagaatcagaatgggaggtggaattgtc

SEQ ID NO: 13685 - protein, 394 aa, Panicum virgatum
  misc_feature: Ceres CLONE 1770164
  misc_feature (1)..(274): Pfam Name: Glyco_hydro_17 Pfam Description: Glycosyl hydrolases family 17
  misc_feature (299)..(388): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
MVPNEIIPDIAASPAAADRWVADNLVPYYPATRVKFLLVGNEILSDYSIANSTWARLVPAMENIHLSLRKRGISSVKIGTTLAMDALADGAFPRPPSAAAFRPDIAGSVVRPLLHFLNGTNSYYFVDAYPYFVWAGNNLTVPLDYALFQGGRTRYVDPGTGLTYTNLLDEMLDAVAIAMAKLGYGGVKLAVAETGWPNGCDYDQIGGNVHNAAIYNRNLAARMAKNPGTPLRPGAKMPVFVFSLYNEDLKGGPGTERHWGLYYANGTAVYEVDLTGRRPLCSYPPLPAPENNTPYKGPIWCVMSPAASKKLNETAVGNALSYACGQGNGTCDAIQPGKKCYLPNTTVAHASYAFNSYWQQFRRTGATCYFNNLAEQTIKDPSHGSCKFRSSLDS

SEQ ID NO: 13686 - DNA, 842 bp, Panicum virgatum
  misc_feature: Ceres CLONE 1770168
  misc_feature: Encodes the peptide sequence at SEQ ID NO. 13687
attaattttccgcgctgcgcttgtccttatctatccagcagagcgcagcaggatggtgtacgcgctcctgctggtcgccttggcggccgtcgccgccgcagcggtgctccgccactacctcccgctgctccgcggcggcctccccaagggcagcttcggctggcccctcatcggcgagaccatcggcttcctccacgcgcacccgtccaacaccgccggcggcttcctcaaggagcacgtcgccaggtacgggacggtgttcaagtcgcacctcttcggctcgccggcggtggtctcctgcgacgaggagctcaaccactttgtgctgcacaacgaggagcgcctgttcgagtgcagctaccccggcgccatccgcaccatcctcggcgagtcctccgcgctggtggtcaccggcgagcgccaccgccagatccggagcatgttcctcgccctcgtcgcctccacggggctcaaggcctcctacgtcgccagcgtcgacgagtccgcgcgctccctcatcgcgtcctggcgcggccgcgagaccatcagcttctgcgaggaagcgaggaagttcccctacaaggtaatcatggagcaggttctgggcctgccgccggacggcccggtggccctccggatcctggaagagtaccagatcttcatgaaggggatcatctccctccctatcaccctccccgggacaacattttccaaggccgtcaaggcaaggaagaggatatccgagaccatggagaagttcatcgaggacaggaagcgcagcccaaccaagcaggccgtcttcctcgacgtgctcctcgcgaacaaggagctcactcacgacg

SEQ ID NO: 13687 - protein, 263 aa, Panicum virgatum
  misc_feature: Ceres CLONE 1770168
  misc_feature: SWISSPROT Homolog: EC 1.14.13.93 (+)-abscisic acid 8'-hydroxylase
  misc_feature: Useful for making plants with modulated oxidative stress sensitivity
MVYALLLVALAAVAAAAVLRHYLPLLRGGLPKGSFGWPLIGETIGFLHAHPSNTAGGFLKEHVARYGTVFKSHLFGSPAVVSCDEELNHFVLHNEERLFECSYPGAIRTILGESSALVVTGERHRQIRSMFLALVASTGLKASYVASVDESARSLIASWRGRETISFCEEARKFPYKVIMEQVLGLPPDGPVALRILEEYQIFMKGIISLPITLPGTTFSKAVKARKRISETMEKFIEDRKRSPTKQAVFLDVLLANKELTHD

SEQ ID NO: 13688 - DNA, 857 bp, Panicum virgatum
  misc_feature: Ceres CLONE 1770186
  misc_feature: Encodes the peptide sequence at SEQ ID NO. 13689
aacatttcgcccaggtaaaactcgtttaccatttggctctcgcaactcgcgatttcttttactgtgctcgttccggcgcgcggcggcagagctcccgacgacgactgagccatgtgcggcggtgcgatcctcgccaacctcaccaagcagccgggcccgcgccggctcacggagcgggacctctggcaggagaagaagaagcccaagaggggcgccggcggggggaggcgctggttcctggctgaggaggatgaggacttcgaggccgacttcgaggacttccagggcgactccgatgagtcggatttggaactcggggagggggaggacgacgacgtcgtcgagatcaagcccttcgccgccaagaggacttcctccaaagatggcttaagcaccatgactactgctggttatgatggccctgcagcaaggtcagccaaaaggaagagaaagaatcaatacaggggcatccgccagcgcccttggggtaagtgggctgctgagatcagagatcctcagaagggtgttcgtgtttggcttggtactttcaacagtcctgaggaagctgcaagagcttatgatgctgaagcacgcaggatccgtggtaagaaggccaaggttaacttccctgatgcaccaacagttgctcagaagcgccgtagtgggccagctgctgctaaagcacccaaatcaagtgtggaacagaagcctaccgtcaaaccagcagtgaacaaccttgccaacgcaaatgcatcctacccacctgctgactacacctcaagcaagccatctgttcagcatgccaatatggcatttcatctagcaatgaactctgctagtcctattgaggatccagt

SEQ ID NO: 13689 - protein, 248 aa, Panicum virgatum
  misc_feature: Ceres CLONE 1770186
  misc_feature (115)..(166): Pfam Name: AP2 Pfam Description: AP2 domain
  misc_feature: Useful for making plants with altered alkaloid content
MCGGAILANLTKQPGPRRLTERDLWQEKKKPKRGAGGGRRWFLAEEDEDFEADFEDFQGDSDESDLELGEGEDDDVVEIKPFAAKRTSSKDGLSTMTTAGYDGPAARSAKRKRKNQYRGIRQRPWGKWAAEIRDPQKGVRVWLGTFNSPEEAARAYDAEARRIRGKKAKVNFPDAPTVAQKRRSGPAAAKAPKSSVEQKPTVKPAVNNLANANASYPPADYTSSKPSVQHANMAFHLAMNSASPIEDP

SEQ ID NO: 13690 - DNA, 738 bp, Panicum virgatum
  misc_feature: Ceres CLONE 1770187
  misc_feature: Encodes the peptide sequence at SEQ ID NO. 13691
actccctcttccggcgctgctgctgctcctactcctgtgattgggttggggcctttgagcattgcagcatcagcagctgtgggcagttgcagcttgtgccctcccctgtttgcacttgcaccctagcaaaaacagttaggcgctggctggctcttgcagggcagattggccacccattacaaaagcctctctttcagacgccttctctcacaagagaaaacagaggatacagttgttgacaggcatcaaggcgtgagtgtaaatgcagggagcccacggctacggtggctacggttacggcggctacggctacgacgccggtgcgtacagctccgcgggcggcggctacggctacggctacggcgccggcgcgtacggctccgcgggcggcgggtacggctacgacgccggcgcgtacggctccgtgggtggcgggtacggctacgacgctggcgggtactactactccagcgcatacccgccggcgccggcccacgaggacccgctcgcggccgggcggcgggcgcacgacgttccggcgtcgctcaacgggctcgagctgcagccgtcggaggcgtgccccaggaactacgtcatcttcgaccagacgtgcaccaagagccgggtcatgttccacccctccctggcgcacaagctcgggggtccgtcgtcaggccacggcggcggcagctgctacgcgcgggcgacggcgccgggaagaaggtcgcgtgcagggaa

SEQ ID NO: 13691 - protein, 158 aa, Panicum virgatum
  misc_feature: Ceres CLONE 1770187
  misc_feature: Useful for making plants with altered carbohydrate content
MQGAHGYGGYGYGGYGYDAGAYSSAGGGYGYGYGAGAYGSAGGGYGYDAGAYGSVGGGYGYDAGGYYYSSAYPPAPAHEDPLAAGRRAHDVPASLNGLELQPSEACPRNYVIFDQTCTKSRVMFHPSLAHKLGGPSSGHGGGSCYARATAPGRRSRAG

SEQ ID NO: 13692 - DNA, 824 bp, Panicum virgatum
  misc_feature: Ceres CLONE 1770192
  misc_feature: Encodes the peptide sequence at SEQ ID NO. 13693
gatggcagccgccaccaccgccctgatcacccctgcggccgccccgatggttcccccaccgtcctacccggcctcctccgcgtcctctgcctcgaatactgcgtccaccgaggacgacgacgacctctacggccgcctcaagtcgcttcagcgacacatggagttcgttgagatccaggaggagtacgtcaaggatgagcagaagaacctcaagcgcgagctcctacgcgcgcaggaggaggtcaagcggatccagtccgtgccgctcgtcatcggccagttcatggagatggtcgacggcaacaacggcatcgtgggctccaccacgggcagcaactactacgtccggatcctcagcaccatcaaccgcgagctgctcaagccctcggcgtccgtcgcattgcaccgccactccaacgcgctcgtcgacgtgctgccgcccgaggctgactccagcatctctctgctcggatcgtcagagaagcctaacgtcacctataatgatattggaggatgtgacatccaaaagcaggaaatacgtgaggcggtcgagttacccttgacacatcatgagttgtacaagcagattggtattgatcctccaagaggtgtgcttctgtatggtcctccaggtactggcaagaccatgcttgccaaagcagtggcacatcacactactgctgcttttatcagagtcgttggttcggagtttgtacagaagtacttgggtgagggacctagaatggttcgtgatgtgttccgtttggctaaggagaatgccccagcaatcattttcattgatgaggttgatgctatagcaactg

SEQ ID NO: 13693 - protein, 222 aa, Panicum virgatum
  misc_feature: Ceres CLONE 1770192
  misc_feature: SWISSPROT Homolog: EC 3.6.4.3 Microtubule-severing ATPase
MEFVEIQEEYVKDEQKNLKRELLRAQEEVKRIQSVPLVIGQFMEMVDGNNGIVGSTTGSNYYVRILSTINRELLKPSASVALHRHSNALVDVLPPEADSSISLLGSSEKPNVTYNDIGGCDIQKQEIREAVELPLTHHELYKQIGIDPPRGVLLYGPPGTGKTMLAKAVAHHTTAAFIRVVGSEFVQKYLGEGPRMVRDVFRLAKENAPAIIFIDEVDAIAT

SEQ ID NO: 13694 - DNA, 675 bp, Panicum virgatum
  misc_feature: Ceres CLONE 1770198
  misc_feature: Encodes the peptide sequence at SEQ ID NO. 13695
gacacatcacaacaaaagtcacacacacaaggcaacacactctcaattctccacaccacaagaccaccagctcagctctcagtaaaccccatccactcctttatcatcgtctccctccccctcatctcccttccctccattctcacctcagtcctcctgccatcaatggcgaatgcttctctccagtcctttcttcttccccaacatcattctttcgtcaacaacagcagcagccatgacagctccccttctgctctactgaacctctctaccaacaacagcggcagcatttccttcaggctctactccaacatctccccctcggtaaccacaacttcgaccaccaactcatcagctccgactccagtcacccctgccgcagcagcagactcgccacccaccccctccatagacctgcttggtcgccagctcgcagcaggggactaccgccaagctgatgataccacccgggcgctcctcatcgagctcgcgggggagtctgcgaggcgccgagggtacatcttcttctctgaggtccagttcatctccaccgaggacctccgcgccattgacaagctctggaaggagcacagcaatggcaagtttgggtacagcattcagcggcgactttgggagaagtcacagcgtgacttcacccgcttcttcatcaaggtg

SEQ ID NO: 13695 - protein, 169 aa, Panicum virgatum
  misc_feature: Ceres CLONE 1770198
  misc_feature (85)..(169): Pfam Name: GUN4 Pfam Description: GUN4-like
MANASLQSFLLPQHHSFVNNSSSHDSSPSALLNLSTNNSGSISFRLYSNISPSVTTTSTTNSSAPTPVTPAAAADSPPTPSIDLLGRQLAAGDYRQADDTTRALLIELAGESARRRGYIFFSEVQFISTEDLRAIDKLWKEHSNGKFGYSIQRRLWEKSQRDFTRFFIK

SEQ ID NO: 13696 - DNA, 573 bp, Panicum virgatum
  misc_feature: Ceres CLONE 1770198-R
ctgaaggtcacctgccgctcactaatgccctcagggggacacagctgctagggaacatcctcacccacccggcctttgaggaagagagccaggaaaatgaagtcgcagcagaggagagtgctacagctgctggtcagagcaaagatgataacaaaggtagggacagaccaaagtttatgaaagatttcaagcctaactactccttttgaggctggaaaaaaaggcatgggagtttgtgatgcagagatgctggcatggtgtaattgatttaaaagaacatgtatctatagttctatttgtcttactttcttcaacatacatgagaaattgtgcaatatattatgaatataattggttcaggtgttttctctgcacatgaatgatgcttgcagacaagaaagtgaaacagcctgcacaggacagacacaaatataaattatgaggaaagtatggatgcaaggcatcttgcagttaatggtatgtacatagagcaacgcgttaccgatgctgcatgcattttcattcagcaggcaacatcctaccaaataccatgcaaagatttgcaggtgcccc

SEQ ID NO: 13697 - DNA, 646 bp, Panicum virgatum
  misc_feature: Ceres CLONE 1770199
  misc_feature: Encodes the peptide sequence at SEQ ID NO. 13698
  misc_feature (219)..(219): n is a, c, t, g, unknown, or other
cacagcagggcggcgaccaggcagagggcggaccccgccgaccgcgccgggcggaggccgggagcacgccccggcagcaccgccgccagggaggcgccacgcgccgacgcgcgcggcgcgcagcccgccgccagggccaccggagagaacgcggggagggcgcccgccgaggccaagcgcaaggaggcgagcaacgggttttttcgcaacggccggaanccccgccggggccggcacggccgcaaggaccccccgttcttcgccccccccgccaacgacagcggaggcgacaagaacgcggcgcacctcctcaagtacgactcgatgctcggcaccttcaaggccgacatcaagatcgtcgacgacaccaccatcagcgtcgacggcaagctcatcaccgtcgtctccaacagggacccgctcaagctcccatgggccgagctcggcatcgacattgtcatcgagggtaccggagtcttcgtcgacggcccgggcgccgggaagcacatccaggccggcgcgaagaaggtcatcatcactgctccggccaagggcgccgacatcccgacccacgtcgtcggcgtcaacgagggcgactacgaccacggcgtggccgacatcatcagcaatgctccctgcacgacca

SEQ ID NO: 13698 - protein, 215 aa, Panicum virgatum
  misc_feature: Ceres CLONE 1770199
  misc_feature (60)..(213): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
  misc_feature (73)..(73): Xaa is any aa, unknown, or other
HSRAATRQRADPADRAGRRPGARPGSTAAREAPRADARGAQPAARATGENAGRAPAEAKRKEASNGFFRNGRXPRRGRHGRKDPPFFAPPANDSGGDKNAAHLLKYDSMLGTFKADIKIVDDTTISVDGKLITVVSNRDPLKLPWAELGIDIVIEGTGVFVDGPGAGKHIQAGAKKVIITAPAKGADIPTHVVGVNEGDYDHGVADIISNAPCTT

SEQ ID NO: 13699 - DNA, 782 bp, Panicum virgatum
  misc_feature: Ceres CLONE 1770205
  misc_feature: Encodes the peptide sequence at SEQ ID NO. 13700
gttcctcgctccaacctcccccacatcgcctcctctcgattcttgacgccagcagtaatcgctcgttaatcccttccaaatccgcgatattcccaagaatcttctctccccctctcaacccgactctctttcgctcctccccattgcgctccctccctcgcactcggattcctgctcgctttctccgtctccgtctccctctcggccgtccccctctcctccgcctcggattcgaccgccgcccccccccccccccctcatcctgctcctgccgccgcctttttcttccttcttctcctgtccgcccgggactccctccgcagttcttgctctttgcgtcgcgtcgcgtcgaggagagcgtgcctttcgttccggatcgcgcggcgcccccgacatgtgcgtggagggactggaggacgcagggaggctagaccaggacatcgacaagcacgccggtttcgcgatggagagagtttgtgagaacacagtgtctgttgatttcaagcagaactttgtcccattcatcctgtcaggggagtggtctgatatcggaggtcgtgattacatggaagatgcccatgtgtgcatctctgacctggcaaagaattttggctataaagcagctgatgatgaagtaatttccttctatggggtctttgacggacatggtggcaaagacgcagcccattatgtccgtgataacttgccacgaatcattgtggaagatgctgattttcctcttgagcttgaaaaggtagtcaagaggtcatttgtgcaaactg

SEQ ID NO: 13700 - protein, 129 aa, Panicum virgatum
  misc_feature: Ceres CLONE 1770205
  misc_feature: SWISSPROT Homolog: EC 3.1.3.16 Phosphoprotein phosphatase
MCVEGLEDAGRLDQDIDKHAGFAMERVCENTVSVDFKQNFVPFILSGEWSDIGGRDYMEDAHVCISDLAKNFGYKAADDEVISFYGVFDGHGGKDAAHYVRDNLPRIIVEDADFPLELEKVVKRSFVQT

SEQ ID NO: 13701 - DNA, 842 bp, Panicum virgatum
  misc_feature: Ceres CLONE 1770211
  misc_feature: Encodes the peptide sequence at SEQ ID NO. 13702
gcgatcggcgccgcacagggacagggctcccaaactccccaccggtctttattacccctccacctgcggcgccgttgcgtcagctcgactccaccaccgccccctcgtatctccgcatcgccgcgccgcgccgcctcgtatctctcgctttcgcctcgcttcgctagcgctcccggaggccgggccggaccggacccgccgcgccgccatggatgaggagtacgacgtgatcgtgctgggcacggggctcaaggagtgcatcctcagcggcctcctctccgtcgacggcctcaaggttctacacatggacagaaatgactactacggaggagattccacctccctaaacctgaaccagctctggaagaggtttaggggggaagagaagccaccggcccatctaggttcaagcaaagattacaacgtagacatggttccaaagtttatgatggcaaatggaactttggttcgtactctcattcatactgatgtgacaaagtatttgtcattcaaagctgttgatggaagctatgtcttcagcaaagggaagattcacaaggttcctgccactgacatggaggctctaaaatctcctttgatgggtatatttgagaaacgtagagcaaggaactttttcgtttatgtccaaaattacaatgaagctgatccagtaacacatcaggggttggacctcacaaggattacaactagagaattgatttcgaaacatggactgagtgatgacactgtggattttattggccatgcacttgctcttcacagggatgatcgttacctaaatgaaccagcccttgatactgtaaaacggatgaagctttatg

SEQ ID NO: 13702 - protein, 211 aa, Panicum virgatum
  misc_feature: Ceres CLONE 1770211
  misc_feature (1)..(211): Pfam Name: GDI Pfam Description: GDP dissociation inhibitor
MDEEYDVIVLGTGLKECILSGLLSVDGLKVLHMDRNDYYGGDSTSLNLNQLWKRFRGEEKPPAHLGSSKDYNVDMVPKFMMANGTLVRTLIHTDVTKYLSFKAVDGSYVFSKGKIHKVPATDMEALKSPLMGIFEKRRARNFFVYVQNYNEADPVTHQGLDLTRITTRELISKHGLSDDTVDFIGHALALHRDDRYLNEPALDTVKRMKLY

SEQ ID NO: 13703 - DNA, 1631 bp, Panicum virgatum
  misc_feature: Ceres CLONE 1770214
  misc_feature: Encodes the peptide sequence at SEQ ID NO. 13704
aacttcgagcgcctcacatcattcccgagacaactctctcgtcacctctagctccttaaacaaacacgtccaacttccgttctttcaacacaactgggattggcatgcatggataaccaccttgaatcgccctacttcgtcctactgctctgttgtattgctgcaacagtagcatatcctgctcgctgtgagctagctcatcagacgaactatcattctgtatcctacaacccacagccacatgatttcccaaatgagcaactataccgcgcctacctcgtcatccagcgcttcaagagcacaatcactagcgaccccaagaatgtcacggccacctggagcggtcatgatctctgcggagagaagacctacgttggattctactgcggatcgccgacggtgggggataagaaattgactgtcacaggggtcattttgaatggatacaatctgcatgcaccgacactgcaaggttttgtggatcagctcccggaccttgcacttttccatgccgcttccaacaattttggtggcgatatcccccgactcgccggccttgagtatatgtacaggctcagtgtcagcaccgattcgccactacagcctcaagatgatttggcaccaagagccactgtcagggggacaggaaaagcatcgcttggtcactgcctaactgctgacctagatttttctgttaatatcggtattgagcgcggccataagggaggcaagatgatacctggtgttacggatgctaaggctctccttctcaaccacaacagcctgtcgggacaacttccatcggacctcggcttatccaaggtgagctacctcgccctcgccaacaacaagctcacggggccaatcccaccgtcgatcgagcacctgcaggactccctcttcgagctgctcctcctcaacaaccagctctccggctgcctcccccacgagctaggcatgctccacaaggcggccgtcatcgacgccggcatgaaccagctcaccggcccgatcccgtcatccttctcctgcctcagcagcgtcgagcagctcaacctcgccgggaacagcctctacggcccggtgcccgacgcgctctgcaaactcgccgggcccgccgggcgcctcgctaacttcacgctggccggcaactacttcacctccgtcgggccggcatgcgcgtcgctgatcaaggacggcgtcctcgacgtgaagagcaactgcatcccgggcctcgccgaccagaggcgcccggcggagtgcgcggcgttccagagccagcccaagacgtgcccggcggcgagcactccggtggcatgccccgccgcagctgccgccaagggcgcggcggcgccgggggagaggaaggccagggactactccagctacgtgacctacgctactctgcatgagtgatgagcagcctcaggcctcagctcggcatgcagtaggagacagatcgtctcggtggcgttttggctatttgttctttgtattcttatgtagtaccccgtgtgtgtgtgttggtgtgattgtgattgttgcattgtctattttctccgcacgtgttgctgtcgcacctagatccatatttatttgtatccatttgagtgaaagattgttgttgttgt

SEQ ID NO: 13704 - protein, 435 aa, Panicum virgatum
  misc_feature: Ceres CLONE 1770214
  misc_feature: SWISSPROT Homolog: EC 2.7.11.1 Non-specific serine/threonine protein kinase
MDNHLESPYFVLLLCCIAATVAYPARCELAHQTNYHSVSYNPQPHDFPNEQLYRAYLVIQRFKSTITSDPKNVTATWSGHDLCGEKTYVGFYCGSPTVGDKKLTVTGVILNGYNLHAPTLQGFVDQLPDLALFHAASNNFGGDIPRLAGLEYMYRLSVSTDSPLQPQDDLAPRATVRGTGKASLGHCLTADLDFSVNIGIERGHKGGKMIPGVTDAKALLLNHNSLSGQLPSDLGLSKVSYLALANNKLTGPIPPSIEHLQDSLFELLLLNNQLSGCLPHELGMLHKAAVIDAGMNQLTGPIPSSFSCLSSVEQLNLAGNSLYGPVPDALCKLAGPAGRLANFTLAGNYFTSVGPACASLIKDGVLDVKSNCIPGLADQRRPAECAAFQSQPKTCPAASTPVACPAAAAAKGAAAPGERKARDYSSYVTYATLHE

SEQ ID NO: 13705 - DNA, 575 bp, Panicum virgatum
  misc_feature: Ceres CLONE 1770227
  misc_feature: Encodes the peptide sequence at SEQ ID NO. 13706
gatacgataccccacaacacaacaaacagagcagcgccaccgcggccgcggcgacctcgtcccccccccccccctcttcttccccgcaggccgcagcagcgccagcccaccagaaaraaaagagacgcgccgccgcgkggktggggggcggsttatgattgaggggggggccggcgccgcgcctgctatttagagagcccgcaccgtcgcgcgggaagcggagcgatcgaatcgtatcggccgagcaatcaatcagcctggttgctgctgcgggagagatggcgtcggggtaccgcgccgaggaggagtacgactacctggtcaagggggtgctgatcggggacagcggcgtgggcaagtccaacctggtgtcgcggttcgccagggaagagttcagcctcgagaccagggccaccatcggcgtcgagttcgccaccaagaccgtccagggcgacgagaagctcgtcaaggggcagatgtgggacaccgccgggcaggagaggtaccgcgccatcccgagcgcctactaccgcggcgcggtgggcgcgctgggggtctacgacgtgacccgccgc

SEQ ID NO: 13706 - protein, 98 aa, Panicum virgatum
  misc_feature: Ceres CLONE 1770227
  misc_feature (16)..(98): Pfam Name: Ras Pfam Description: Ras family
  misc_feature: Useful for making plants with altered lignin content
  misc_feature: Useful for making plants with altered alkaloid content
  misc_feature: Useful for making plants with altered terpenoid content
  misc_feature: Useful for making plants with modulated oxidative stress sensitivity
MASGYRAEEEYDYLVKGVLIGDSGVGKSNLVSRFAREEFSLETRATIGVEFATKTVQGDEKLVKGQMWDTAGQERYRAIPSAYYRGAVGALGVYDVTR

SEQ ID NO: 13707 - DNA, 812 bp, Panicum virgatum
  misc_feature: Ceres CLONE 1770231
  misc_feature: Encodes the peptide sequence at SEQ ID NO. 13708
atcacgccactccctcccctcctcctccccctcactctcgccactgctactaccaaggctctatagctgctagctcgtactagaacgagcactgccacttgctcgcctcaaggaactgcccagtgccggtttaagtaccacgccgtacggttcgctccagtgcccgcgatggcgtcggagtgggaaatggccatgggggtggagctcggcatgggcatgggcacgtaccacgcccaccaccacaacgcctccagcatcaccgccgcgccgacgagcagccaccacagaggcgccgccagcttcgccacgccgcaccaccaccattactacgggatgccgcccatggccggcgacgccatgcgggtcgacgagctcctcgacctctccaccggccccggcgccggcgcccatgacttcttccccaccgccgccgcggccgcggccacggacaacgggcatcatcactcgggggccatgggtgagccgtcgcccaccgccaactcgtcggatcaccagacgtcgctcctctccttcgccgacgagttctacatacccagcgaggaagctgcggagctggagtggctatccaagttcgtggacgactcctactccgacatgccgaattactcgtcggcagcgcatgccgcaatggcagcggctgccgccgctaacgctgccggcaacggtgcaggtggcaactcggccggtcaggacagctgcgtcacggccgcgcccgggcgcggcgcgcgcagcaagcggtcccgcgcgaccgccgcggccgctgcggcgtggcactccctcgtgccgcgccc

SEQ ID NO: 13708 - protein, 214 aa, Panicum virgatum
  misc_feature: Ceres CLONE 1770231
  misc_feature: The sequence is a functional homolog of SEQ ID NO 607 in the 10/374,780 US patent application
MASEWEMAMGVELGMGMGTYHAHHHNASSITAAPTSSHHRGAASFATPHHHHYYGMPPMAGDAMRVDELLDLSTGPGAGAHDFFPTAAAAAATDNGHHHSGAMGEPSPTANSSDHQTSLLSFADEFYIPSEEAAELEWLSKFVDDSYSDMPNYSSAAHAAMAAAAAANAAGNGAGGNSAGQDSCVTAAPGRGARSKRSRATAAAAAAWHSLVPR

SEQ ID NO: 13709 - DNA, 826 bp, Panicum virgatum
  misc_feature: Ceres CLONE 1770233
  misc_feature: Encodes the peptide sequence at SEQ ID NO. 13710
gcgcagcgtcaaactccccgacacggacaacgcgacggtggacatgagcgcgacgctggagcagtgcagggcgaggtgcctcgccaactgctcgtgcgtggcctatgcccccgccgacatccgaggaagtggcagtggctgcgtcatgtggaaggatggcatcgttgatctccggtatgtggaaaatgggcaggatctctatgtgaggctggcaaaggttgaatcagctaccaggaaggggaagaatgtggcaaaaattgtgcttccagttatggcgtctgtgctagtcctcacggccgctggcatgtaccttatttggatctgcaagcttcgaggcaaacgtcgtcagagcaaggatattttgaagaaggcaatccttggatactcgaatgcgccaaatgaacttggtgatgaaaatatagaacttccatttgtcagctttggagatattgcagctgcaacaaacaatttttctgagggcaatatgctcgggcaaggtggcttcggcaaggtttataagggtacgctgggacagaacatagaggttgcaataaaaaggcttggtcagggttccggacagggtgtagaggaattcagaaatgaagttgttctgattgcaaaattgcagcacagaaacctcgtcagacttcttggttgctgcatccatggagatgaaaagttgctgatttacgaattcttaccaaacaaaagcttggatttctttatttttgatgctgcaaatagatatctccttgattggccaacacgtttcaagataattaaaggaatatctagaggacttctttatctccaccagggattcaag

SEQ ID NO: 13710 - protein, 274 aa, Panicum virgatum
  misc_feature: Ceres CLONE 1770233
  misc_feature (1)..(57): Pfam Name: PAN_2 Pfam Description: PAN-like domain
  misc_feature (157)..(274): Pfam Name: Pkinase_Tyr Pfam Description: Protein tyrosine kinase
  misc_feature: SWISSPROT Homolog: EC 2.7.11.1 Non-specific serine/threonine protein kinase
RSVKLPDTDNATVDMSATLEQCRARCLANCSCVAYAPADIRGSGSGCVMWKDGIVDLRYVENGQDLYVRLAKVESATRKGKNVAKIVLPVMASVLVLTAAGMYLIWICKLRGKRRQSKDILKKAILGYSNAPNELGDENIELPFVSFGDIAAATNNFSEGNMLGQGGFGKVYKGTLGQNIEVAIKRLGQGSGQGVEEFRNEVVLIAKLQHRNLVRLLGCCIHGDEKLLIYEFLPNKSLDFFIFDAANRYLLDWPTRFKIIKGISRGLLYLHQGF

SEQ ID NO: 13711 - DNA, 773 bp, Panicum virgatum
  misc_feature: Ceres CLONE 1770257
  misc_feature: Encodes the peptide sequence at SEQ ID NO. 13712
gaacactgctgcggagcaagctgagatggcgcatgctgtgcacgccccagccccgcacgtcgtcgtgctcgccagccccggcgtgggtcacgtcgccccggtggccgagctcgccacgcgcctcgccgcgctccacggcgtcacctccacgatcgtcacctacaccaacctctcctctgccgcgagcttggcctccctcccgccgggcatctccaccgccgcgctcccggaggtgcccctcgacgacctccccgccggcgcgcacatcgggacccgcatcgtcaccgtcgtccagcgcacgctcccgcacctccgcgccctgctccgctccctcctcgacgacgcccccgccggcggagtcacggccttcgtcgccgacatgctctgccccgcggcgctcgccgtcgccggagagctcggcgtgccgcgctacgtcttctacacctcgagcctcatgtcgctggtcacgctgctctacgccccggagctcgcgaggaccaccacctgcgagtgccgcgacctcccgggtccggtcgccctcccggggtgcctgccgctgcacggagccgacctcgtcgaacccctccaggaacgcgccgaccccgtgtacggcctcttcgtcgacatgggcctcgactacctcctcagcgacggcttcatcgtcaacaccttcgatgccctggagcacgagaccatggaagcgttcagggagctctccgacaagggcgtctaccccccggcgtacgccgtgggcccgctggtccgctcggtgt

SEQ ID NO: 13712 - protein, 249 aa, Panicum virgatum
  misc_feature: Ceres CLONE 1770257
  misc_feature: SWISSPROT Homolog: EC 2.4.1.218 Hydroquinone glucosyltransferase
MAHAVHAPAPHVVVLASPGVGHVAPVAELATRLAALHGVTSTIVTYTNLSSAASLASLPPGISTAALPEVPLDDLPAGAHIGTRIVTVVQRTLPHLRALLRSLLDDAPAGGVTAFVADMLCPAALAVAGELGVPRYVFYTSSLMSLVTLLYAPELARTTTCECRDLPGPVALPGCLPLHGADLVEPLQERADPVYGLFVDMGLDYLLSDGFIVNTFDALEHETMEAFRELSDKGVYPPAYAVGPLVRSV

SEQ ID NO: 13713 - DNA, 812 bp, Panicum virgatum
  misc_feature: Ceres CLONE 1770274
  misc_feature: Encodes the peptide sequence at SEQ ID NO. 13714
agtagtgctgcgcacgtcaggagctctaccccctctccactgcatccgatattctgatcgcagccatgggaacccgcagcgtcgccctggtgctcctcgcggccgttctgctccaaaccctcctccccgcctcggcggcggagggtttggtgcgggtctcgctgaagaagcagcccatcgaccagaacagccgcgtcgcggagcgcctctccgcggaggagaggcagcgccttctccgtggcgccaactcgctgggctcgagcgatgagggcgacatcatcgcgcttaagaactacatgaacgcgcagtactttggggagattggcatcggcacgccagcgcagaagttcaccgtcatttttaacaccggcagctccaatctctgggtgccgtcctccaagtgctacttctcgatcgcttgctacgtccactcgcgctacaagtcagggcagtcgagcacttacaagaagaacggaaaacctgctgacattcactatggaactggtgcaattgctggttttttcagtgaggatagtgttaccttaggtgatctggttgtgaaagatcaggaatttattgaagctacaaaggagccaggccttactttcatggttgcaaaatttgatggtattcttggtctgggctttcaggaaatatctgttggcaatgcagtaccagtgtggtataacatgataaagcaaggtctcatcagcgaccctgttttctctttctggttcaaccgacatgctggtgaaggagaaggtggtgaacttgtgtttggtggaatggatcctaaccactacaagggtaac

SEQ ID NO: 13714 - protein, 248 aa, Panicum virgatum
  misc_feature: Ceres CLONE 1770274
  misc_feature (81)..(248): Pfam Name: Asp Pfam Description: Eukaryotic aspartyl protease
  misc_feature: SWISSPROT Homolog: EC 3.4.23.40 Phytepsin
MGTRSVALVLLAAVLLQTLLPASAAEGLVRVSLKKQPIDQNSRVAERLSAEERQRLLRGANSLGSSDEGDIIALKNYMNAQYFGEIGIGTPAQKFTVIFNTGSSNLWVPSSKCYFSIACYVHSRYKSGQSSTYKKNGKPADIHYGTGAIAGFFSEDSVTLGDLVVKDQEFIEATKEPGLTFMVAKFDGILGLGFQEISVGNAVPVWYNMIKQGLISDPVFSFWFNRHAGEGEGGELVFGGMDPNHYKG

SEQ ID NO: 13715 - DNA, 616 bp, Panicum virgatum
  misc_feature: Ceres CLONE 1770274-R
  misc_feature: Encodes the peptide sequence at SEQ ID NO. 13716
aagctgggaaatctaatggtggtctccgaagcgatccaatgtgcaatgcctgtgagatggctgttgtatggatgcagaaccaactcgcgcagaacaagaccaaggaactcatcctgaactacattaatcagctgtgcgaccgtctccctagtcccatgggagaatcatctgtggactgtgccagtcttaagtccatgcctgacattgcgttcaccattggcggcaagaagttctcgctgaaacctgagcagtacattctgaaggtcggtgaaggacctgctgctcagtgcatcagtggattcacagctatggatatcccgcctcctcgtggccccctctggattttgggtgatgttttcatgggagcgtaccacactgtcttcgactacggcaagctgagggttggcttcgcggagtctgcctgagcgtaccacacactgttaacgcatgcgccaggagaaaactttaccctgttttaacttgcgtatttatccggccggcgatgtgtgtacatatgctacttgttcagtgatgctttcccaagactcgtgataacgcccgtctgttttaacctggcaagaatatttctggatgtatttgccatcttcttggaccg

SEQ ID NO: 13716 - protein, 140 aa, Panicum virgatum
  misc_feature: Ceres CLONE 1770274-R
  misc_feature (11)..(49): Pfam Name: SapB_1 Pfam Description: Saposin-like type B, region 1
  misc_feature: SWISSPROT Homolog: EC 3.4.23.40 Phytepsin
AGKSNGGLRSDPMCNACEMAVVWMQNQLAQNKTKELILNYINQLCDRLPSPMGESSVDCASLKSMPDIAFTIGGKKFSLKPEQYILKVGEGPAAQCISGFTAMDIPPPRGPLWILGDVFMGAYHTVFDYGKLRVGFAESA

SEQ ID NO: 13717 - DNA, 2204 bp, Panicum virgatum
  misc_feature: Ceres CLONE 1770280
  misc_feature: Encodes the peptide sequence at SEQ ID NO. 13718
cttcctccgcgttgcttccccctttccgcactctgacgcggcaatctcgcgcccagcgccaagcgcccagcgccccgtctcccgcttcgcttcctcgtcgtcgacgtcgttctccgatcccccagccgctgctccaagtcggggctgagtgatctctccggccgacgagtccaggccgaggcgccatcgccggcagcaggaggcggggaatatctccggcaccatgtcgttcgattcggacgcctcctcgcaggtcggggaccaccggagtttccgccaaatcacgcgagatcgtctattatttgaaatgctaagatcaactaggaagaattcgaaatcaacatggaaggttcttatcatggataagtttacagttaagattatgtcgtatgcatgtaagatggcagatatcacagaagaaggagtttcattggtcgaagatttatacaaacggaggcaaccattgccttcactggatgccatatatttcatccaaccaactaaagaaaacattgtcatgttcctatctgacatgtcaggaagaagccctttgtacaagaaggcatatgtgtttttctgttctcccgtacataaagaattagttgctcaaattaagaaggattcaagtgtactacctcgtattggtgcacttagtgagatgaatttggagtacttcgctattgattcccagggtttcataactgaccatgagagggcattggaagaactttttagtgaaaatgcagaagggtcacacaagtacaatgcttgtctgaacacaatggctactcgtatatccacagtatttgcatcattgagggaattcccccgtgtacactaccgtgttgccaagacaattgatgcttctacaatgacaacactacgagacttggtccccacaaagcttgctgctggtgtatggaattgccttgcgaagtataaaatgacgatacctgaatttcctcaaacagaaacatgtgaattacttatagtagaccgttcaatagaccagattgcaccaattattcatgaatggacgtatgatgccatgtgccatgatctgctatgtatggatggcaacaagtatgttcatgaggttccaagtaaaaatgggtcagcaactgaaaaaaaggaggtcctgttagaagatcatgaccctgtctggcttgagcttaggcatgcccatatagcagacgcaagtgagagacttcatgataagatgacccacttcgtttcaaagaacaaagctgcacaactgcatcaagcaagaaatggtggagagctatctacaagagatttgcaaaaaatggttcaggctcttccacagtacagcgatcaaattgacaagctttccttgcatgttgagattgcaggaaaactaaataccataatacgggaacaatgtcttcgggatgttggacagctagagcaagatcttgtgtttggcgatgctggaacaaaagaactaatcaattttttgagaacacaattgggtgtaagtcgtgaaaataagttgcgcttgctgatgatttatgcagcacttaacccggagaagtttgaaagtgacaagggtgcaaaactgatgcagttggcaggattatctgatgatgacatgattgccgttaataatatgcgttgcttatgtgggcctgatacaaaaaagtccacaggaggaggttttacactgaaatttgatgttcataagaagaaacatgcacatagaaaagagcgaacaggggaagaatcagcatgggcgctgtcccgattttatcctgttatagaggaattgattgagaagctcagcaaaggtgagctgccaaaagatgagtataactgtatgaacgaccctagtcctagtgctcatggactgccaaccagtagctctctccaaacaagtccagctcactcaatgcgatctagacgaacaggtggcacatgggccagacctcgtggctcagatgatggatattcaagtgattctgtgttgaagcatgcatcaagtgacttcaaaaaacttggtcagcgtatatttgtttttgtcattggtggttctactcgttctgagttacgtgctgcacataaactttcatccaagctgaaaagggaggtcatccttggttcatctagccttgacgatcctccccaattcatcacaaaactgaagttgatgtcagcagacaaactgacacttgatgatcttcaga

SEQ ID NO: 13718 - protein, 660 aa, Panicum virgatum
  misc_feature: Ceres CLONE 1770280
  misc_feature (41)..(646): Pfam Name: Sec1 Pfam Description: Sec1 family
MSFDSDASSQVGDHRSFRQITRDRLLFEMLRSTRKNSKSTWKVLIMDKFTVKIMSYACKMADITEEGVSLVEDLYKRRQPLPSLDAIYFIQPTKENIVMFLSDMSGRSPLYKKAYVFFCSPVHKELVAQIKKDSSVLPRIGALSEMNLEYFAIDSQGFITDHERALEELFSENAEGSHKYNACLNTMATRISTVFASLREFPRVHYRVAKTIDASTMTTLRDLVPTKLAAGVWNCLAKYKMTIPEFPQTETCELLIVDRSIDQIAPIIHEWTYDAMCHDLLCMDGNKYVHEVPSKNGSATEKKEVLLEDHDPVWLELRHAHIADASERLHDKMTHFVSKNKAAQLHQARNGGELSTRDLQKMVQALPQYSDQIDKLSLHVEIAGKLNTIIREQCLRDVGQLEQDLVFGDAGTKELINFLRTQLGVSRENKLRLLMIYAALNPEKFESDKGAKLMQLAGLSDDDMIAVNNMRCLCGPDTKKSTGGGFTLKFDVHKKKHAHRKERTGEESAWALSRFYPVIEELIEKLSKGELPKDEYNCMNDPSPSAHGLPTSSSLQTSPAHSMRSRRTGGTWARPRGSDDGYSSDSVLKHASSDFKKLGQRIFVFVIGGSTRSELRAAHKLSSKLKREVILGSSSLDDPPQFITKLKLMSADKLTLDDLQ

SEQ ID NO: 13719 - DNA, 1238 bp, Panicum virgatum
  misc_feature: Ceres CLONE 1770283
  misc_feature: Encodes the peptide sequence at SEQ ID NO. 13720
agccatgagcgcacgcttgacccgctccaaggacctgacgacgatgggcgccgcctcgttggcgaccgtggtcgccctgctgctgggcctgctcgcgcggccgtccgagtgcgcccgcgccttcttcgtgttcggcgactcgctggtggacaacggcaacaacaactacctcatgaccacggcccgcgccgactcgccgccgtacgggatcgacttcccgacgcaccgcgccaccggccgcttctccaacggcaagaacatccccgacatcatcagcgagcacctcggcgcggagccgacgctgccgtacctgagccccgagctccgcgggcagaagctgctcgtcggcgccaacttcgcgtcggccggcgtcgggatcctgaacgacaccggcatccagttcgtggacatcctgcggatgagccgccagctgcgctacttcggcgagtaccagcgccggctccgcgcgctcgtgggcgccgcccgggcgcggcagctggtgcgccgctccctcacgctcatcaccctcggcggcaacgacttcgtcaacaactactacctcgtccccttctccctgcgctcccgccagttcgcgctcccggactacgtccgctacctcgtctccgagtacaagaagatcctcatcaggctgtacgcgatgggttgccggcgcgtgctggtgacgggcacggggcccctggggtgcgcgccggcgatcctggcgcagcggagccggaacggcgagtgcgcggcggagctgatgcgcgcggcgtcgctgttcaacccgctgctggcgcgggcgctggaggggctgaaccgccggtacggggccggcacgttcgtggcggcgaacgcgttccgcgtccacttcgacttcgtgagcgacccggccgcgtacgggttcgcgacggccaaggacgcgtgctgcgggcagggcccccacaacgggctggggctgtgcacgccggcgtccagcctgtgcgccgaccgggcccgctacgtgttctgggacccgtaccaccccacggagcgcgccaaccggatcatcgtcagccagttcatgcgcggctcgctcgactacgtcagccccatgaacctcagcaccatcctcgagatggacgccaggctcggcgcctgatccctcggctggctgaagagaagcaggagcagatgacatgccagcccaagaattggaatgagaagtcgtgaataaaatccgaagagttcgttgcttggcc

SEQ ID NO: 13720 - protein, 364 aa, Panicum virgatum
  misc_feature: Ceres CLONE 1770283
  misc_feature (27)..(339): Pfam Name: Lipase_GDSL Pfam Description: GDSL-like Lipase/Acylhydrolase
  misc_feature: SWISSPROT Homolog: EC 3.2.1.51 Alpha-L-fucosidase
MGAASLATVVALLLGLLARPSECARAFFVFGDSLVDNGNNNYLMTTARADSPPYGIDFPTHRATGRFSNGKNIPDIISEHLGAEPTLPYLSPELRGQKLLVGANFASAGVGILNDTGIQFVDILRMSRQLRYFGEYQRRLRALVGAARARQLVRRSLTLITLGGNDFVNNYYLVPFSLRSRQFALPDYVRYLVSEYKKILIRLYAMGCRRVLVTGTGPLGCAPAILAQRSRNGECAAELMRAASLFNPLLARALEGLNRRYGAGTFVAANAFRVHFDFVSDPAAYGFATAKDACCGQGPHNGLGLCTPASSLCADRARYVFWDPYHPTERANRIIVSQFMRGSLDYVSPMNLSTILEMDARLGA

SEQ ID NO: 13721 - DNA, 1821 bp, Panicum virgatum
  misc_feature: Ceres CLONE 1770284
  misc_feature: Encodes the peptide sequence at SEQ ID NO. 13722
agaaaatcgaacaaaaatcaaacaaacaaataaagaagggaagggaagccaccggcaccgtccccccaccgttcccttcccttcccgatcctcctcgcagatctccggcaccggccgccatgaactcctactccggcgaccgctcctcctcccgccccaccaccacctccttcgactcctaccagttcgacttcggcatcaacgcttcccgctcctccggctcccgccccctccgcgaccagcgcccgggcgcggccgccaacccctccaccaggccggccaccggcgcgccgtcgtggacccatcagccgtcccccgccgcggcgtcggcggcggggcccgccggatccggtccgacctccatggtcggcgacatcttcggccggagctggtcctccgccgcgccctcatcgggtctcggcatcccgcaggccaacaaccctgccctcttcagcgacctcctcggctccgcgctcggcggctccggctcctcccgcgcccagtccaacgcgccgctcagatctgccgcggcgccgcaggcctccaggcccaccggcgcgaatcccaatgccagcgccagcagctctgccttctccatgggcggcatggcgagcgcgctcccgaagacgaccggagcgccgatgggctccggtgaatacggcgttggtggccggccgatgaagcccgcgggcatggcggcgacgcccgccgcgcagccgacggggcagaagaaggatccgtttggctcgatagatccatttgcggcgaagccggggtccatgaatgcggctaagcaggctagttcggtcaagccggatcagggatttggggcgttccagggcgtgagttccagcgccaacgctggatttgggagcttccagagcgctgacgcaggattcggggctttccagagctctggtgccacgaaaccttccagctttacgcctccaccccaatcagctccagcgcctacccctgcggccgcagcagcgaactctagtgtggatcctttggacaatctgttcgcttcgaccacagctgcaccgactgcaaccgcggcgagcaatggtggtggtgggggtgacatgtttggtgagatggatggttgggtcgatgtggaggcagagtttggtggtggtgacagtggtggtgcaaccacagagctggacggcctgccaccgccaccatccggattgacaatatcggctgctaaggccaaagggatggatagttacaagggagggcagtatgctgatgccatcaagtggttgtcttgggctgttgtgctcattgagaaatcagggaaagatgtagacattgtcgaggtgttgtcttcaagggcttcctcatataaggaggttggtgagtacaagaaggccatcgctgactgctctaaggtgctggaccaagataaggagaatgtctcagtgctagtgcagcgtgctctcctttatgaaagcacggagaaatataggcttggggcagaggacctgcgtttggttctgaagattgaccctgcaaataggcttgccaggagtacaattcaccgcttgaacaagttggcagactagggatgtctttctagcgccctgatgtaatattgtactaccactgtactcaatccttggcacgagatttgtgagttgtttttaacactttgctatacctgtggcttttggggaatagtttgcagctatgctgttatcaagtatgaactacaaatcgacaaatttacatacagtatattctttgatttgtataatctatgtattgtatcatatattaatcttgaaaagctaatctttgtggcgtgagttctgc

SEQ ID NO: 13722 - protein, 483 aa, Panicum virgatum
  misc_feature: Ceres CLONE 1770284
  misc_feature (401)..(434): Pfam Name: TPR_1 Pfam Description: Tetratricopeptide repeat
  misc_feature: SWISSPROT Homolog: EC 5.2.1.8 Peptidylprolyl isomerase
MNSYSGDRSSSRPTTTSFDSYQFDFGINASRSSGSRPLRDQRPGAAANPSTRPATGAPSWTHQPSPAAASAAGPAGSGPTSMVGDIFGRSWSSAAPSSGLGIPQANNPALFSDLLGSALGGSGSSRAQSNAPLRSAAAPQASRPTGANPNASASSSAFSMGGMASALPKTTGAPMGSGEYGVGGRPMKPAGMAATPAAQPTGQKKDPFGSIDPFAAKPGSMNAAKQASSVKPDQGFGAFQGVSSSANAGFGSFQSADAGFGAFQSSGATKPSSFTPPPQSAPAPTPAAAAANSSVDPLDNLFASTTAAPTATAASNGGGGGDMFGEMDGWVDVEAEFGGGDSGGATTELDGLPPPPSGLTISAAKAKGMDSYKGGQYADAIKWLSWAVVLIEKSGKDVDIVEVLSSRASSYKEVGEYKKAIADCSKVLDQDKENVSVLVQRALLYESTEKYRLGAEDLRLVLKIDPANRLARSTIHRLNKLAD

SEQ ID NO: 13723 - DNA, 856 bp, Panicum virgatum
  misc_feature: Ceres CLONE 1770288
  misc_feature: Encodes the peptide sequence at SEQ ID NO. 13724
acgacacacagattacagcgctctcgctcgcacttcctccgctcgtctgacatctcctcccgtcctttcctttcgaagcctcggggatcccggcgatggtcaccgccgccaccctggtgtcggtcgacgacaagctcaaccagcttcgcgccgaggtcgccaagctcgaccagatcagcgagaacgagaagtccgggttcatcagcctcgtgtcgcgctacctcagtggggaggcggagcagatcgagtggagcaagatccagaccccgaccgatgaggtggtggtgccgtacgacaccctcgcgtcgcctcccgaagatctcgaggagacgaagaagctgctggacaagctcgttgtgctcaagcttaatggagggctcgggacgaccatgggctgcactggccccaagtctgtcattgaggtccgcaacgggttcacattccttgaccttattgtgattcaaattgagtctttgaacaagaagtatggatgcagtgtccctttacttctgatgaactctttcaacactcatgatgacacacagaagattgttgagaagtatgccaactccaacattgagattcacactttcaatcagagccagtatcctcgcattgatactgaagacttctcgctacttccaatcaagaaatctgggaaggatggctggtatcctccaggccatggtgatgtgttcccctctttgaacaacagtgggaaacttgacctcttattggctcagggcaaggagtatgtctttgttgcaaactcagacaacttgggtgctatagttgacatcaaaaatctaaaccatctgatcaacaaccagaatgagtactgcatggaggttactcc

SEQ ID NO: 13724 - protein, 253 aa, Panicum virgatum
  misc_feature: Ceres CLONE 1770288
  misc_feature (31)..(253): Pfam Name: UDPGP Pfam Description: UTP--glucose-1-phosphate uridylyltransferase
  misc_feature: SWISSPROT Homolog: EC 2.7.7.9 UTP--glucose-1-phosphate uridylyltransferase
MVTAATLVSVDDKLNQLRAEVAKLDQISENEKSGFISLVSRYLSGEAEQIEWSKIQTPTDEVVVPYDTLASPPEDLEETKKLLDKLVVLKLNGGLGTTMGCTGPKSVIEVRNGFTFLDLIVIQIESLNKKYGCSVPLLLMNSFNTHDDTQKIVEKYANSNIEIHTFNQSQYPRIDTEDFSLLPIKKSGKDGWYPPGHGDVFPSLNNSGKLDLLLAQGKEYVFVANSDNLGAIVDIKNLNHLINNQNEYCMEVT

SEQ ID NO: 13725 - DNA, 1349 bp, Panicum virgatum
  misc_feature: Ceres CLONE 1770298
  misc_feature: Encodes the peptide sequence at SEQ ID NO. 13726
actaggcaccaaaccatcacttcactcccaccctccccccacgcctctcgatcctcctccccgtccaccacgtaccaccaccacacctagctaccgcccgcgcgcgttgtctccggccatggccgagaagccgcctctgccgcccaagcccaagccgcccctgccgcccaggccgaggccgccgccgaaggcgccagccacggcagcgcggcccgcgccggcccccgccaatggcgccgccagacccgcgccgcctttcaagaagccagctctcgccccgccgctgccgacgcaggtgcccccgctcaagcccccgccggcgcgccagtacctccaccaccagcacccgccgccccccggcggcgcgcggaaggcgccggcgcggtaccgccagcagcagcggcgccgcggcggcggcggcgggtgctcgtgccgccgcgcgtgctgcctcgccgcggggttcgccctgctcgcgctctgcctggccctcgccgcggcgtgcctcgcgtacctctactaccgcccgcggccgccgtcgttccacctgcagccgctggcccccgtgcggctccgcctcggcggcaacgcctcggcggcgcccgcgctggaagccaccgtgggcgcccgcgccgtgtcgtggaaccccaacgagcgcgtggccttccggtacggcgccggcgagggccgcgtcgcgctggccgacgccgacggggacgtcgcgctcgggtgggcgcccgtcgccgggttcgagcacgcgccgcggagcgtcgccgccgtggcattcgtggcggccgccaggggcgtggtcgtcgacgaggccgtcgcggcgcgcgtgcgcgaccggtaccggaggcggcagcaggcgttcagggtggaggtggacacccacgtcggcgtccgcgtcggggcgctccgcaccggcatggtgccggtcaggctggtctgcggcggcggcgtgatggcgccgcgcggcgccgggaccgcggcggggcccctgagcagatgccaggtgtatctgttcagagtaagatggtttagcttgaactgaaggcgcatccggggcatcagggctgctattacctgcttagagaccacatcgaggcatcaagcagctaccaaaggcgccgaagctgcagacgccgtaaattatccgcatgtttcgccgacaagattggtttgctcccaacttgattggtcctgaatacatatttggatggcctgaagcatttagtaagagctaaagaaaccgagtttgtaactgtatattacactcccagctcccgattcttttgattgtgtggtgcatacatagcaggaatgaaaatggacgatgggtgtgtgttcttctc

SEQ ID NO: 13726 - protein, 309 aa, Panicum virgatum
  misc_feature: Ceres CLONE 1770298
  misc_feature (131)..(276): Pfam Name: Hin1 Pfam Description: Harpin-induced protein 1 (Hin1)
MAEKPPLPPKPKPPLPPRPRPPPKAPATAARPAPAPANGAARPAPPFKKPALAPPLPTQVPPLKPPPARQYLHHQHPPPPGGARKAPARYRQQQRRRGGGGGCSCRRACCLAAGFALLALCLALAAACLAYLYYRPRPPSFHLQPLAPVRLRLGGNASAAPALEATVGARAVSWNPNERVAFRYGAGEGRVALADADGDVALGWAPVAGFEHAPRSVAAVAFVAAARGVVVDEAVAARVRDRYRRRQQAFRVEVDTHVGVRVGALRTGMVPVRLVCGGGVMAPRGAGTAAGPLSRCQVYLFRVRWFSLN

SEQ ID NO: 13727 - DNA, 839 bp, Panicum virgatum
  misc_feature: Ceres CLONE 1770306
  misc_feature: Encodes the peptide sequence at SEQ ID NO. 13728
agttacttcgcttcgcctctcccccccttcgccagggctggggtccaggccacacatagaatgagctcacatggcgcccccatctctgatccttgatgcagaggtgatggttcccttcgcagtacttacttcccgcggcgttacggagacggcggtgtcactgactacttccttgtatcaccacaccactgatggctcaacgaagttccttaaacttgcgcttggtaaccttgcactcgggctgcccattctgctgggtgccaataactctctcactgatgaactggccctctcttcctctctgatgtcttaccctaggttccttgagtatattgacgaggacagagtgaagaaggttgatttgtttgagaatgggacaattgctatcgtggaggccatctctcctgagctcggcaatcgtgtgcagagagtccgtgtgcagcttccaggtctaagccaggagcttcttcagaagttgagggaaaagaacattgattttgccgcacacagcaaccaggaggactctggttcccttctgtttaaccttattggaaatttggcattcccccttatcctcattggtggtctatttttgctatcaagaagggcacaaggtggccttggcggaccaaatggtcctggctttccccttggttttggtcaatctagggccaagtttcagatggaacccaacactggtgttacatttgatgatgttgctggcgtcgatgaagcaaagcaagacttcatggaagtggtcgagttcttgaagaagcctgaaaggttcactgctgttggtgctcgcattcctaaaggtgttcttcttgttggtccacctg

SEQ ID NO: 13728 - protein, 256 aa, Panicum virgatum
  misc_feature: Ceres CLONE 1770306
  misc_feature (77)..(223): Pfam Name: FtsH_ext Pfam Description: FtsH Extracellular
MAPPSLILDAEVMVPFAVLTSRGVTETAVSLTTSLYHHTTDGSTKFLKLALGNLALGLPILLGANNSLTDELALSSSLMSYPRFLEYIDEDRVKKVDLFENGTIAIVEAISPELGNRVQRVRVQLPGLSQELLQKLREKNIDFAAHSNQEDSGSLLFNLIGNLAFPLILIGGLFLLSRRAQGGLGGPNGPGFPLGFGQSRAKFQMEPNTGVTFDDVAGVDEAKQDFMEVVEFLKKPERFTAVGARIPKGVLLVGPP

SEQ ID NO: 13729 - DNA, 847 bp, Panicum virgatum
  misc_feature: Ceres CLONE 1770309
  misc_feature: Encodes the peptide sequence at SEQ ID NO. 13730
tcttctctccgctccacccactcccgctctgctccctctcccaccgatctgccatctcgcccggccccgtccgctctagggattcgcgacggagatccgccggagattgaggaccgggacggaggcgtcggggccggggagcggcggcggcgaggcggcggggggatggacggccacggcggcgcgggcaagctgacgcggacgccctcctcgctcctgcgctcccccacggtgcggaactgctcctcgttccaggccgtggtggtcgaagacccggagcccgacgacaagaaggcccaggcgccccccaaggccccgccccaccagttccaccccggcgccggccccgcccacccgctcctcgtcctcgcgctcccgctcgccttcctgctcctcctcctcctgctccgcggcggcgacggccaccacctcgccctcctcgccgcctccgcggccgccgcgctcggcgccgcggccggggccgcgcgcctgctccggggccgcctccgccgctcgcccgggtccgggtccgtgcagtggttcatcggcgacgacgacgacaagcccccgaagcgggcggacaagggcgccgccgccgccgcgcacggccgcgtcgtgcgcgagggcgtcgagttctacagcaatggggactgctacgagggcgagttccacaagggccgctgcaacggcagcggcgtctacaacttcttcggcaagggcaagtacgagggcgactgggtcgacggcaggtacgacggctacggcatcgagagctgggcgcgcggcagccgctaccgcggccagtaccgccagggcctccgccacgggcacggcgtctactgcttct

SEQ ID NO: 13730 - protein, 227 aa, Panicum virgatum
  misc_feature: Ceres CLONE 1770309
  misc_feature (187)..(209): Pfam Name: MORN Pfam Description: MORN repeat
  misc_feature: SWISSPROT Homolog: EC 2.7.1.68 1-phosphatidylinositol-4-phosphate 5-kinase
MDGHGGAGKLTRTPSSLLRSPTVRNCSSFQAVVVEDPEPDDKKAQAPPKAPPHQFHPGAGPAHPLLVLALPLAFLLLLLLLRGGDGHHLALLAASAAAALGAAAGAARLLRGRLRRSPGSGSVQWFIGDDDDKPPKRADKGAAAAAHGRVVREGVEFYSNGDCYEGEFHKGRCNGSGVYNFFGKGKYEGDWVDGRYDGYGIESWARGSRYRGQYRQGLRHGHGVYCF

SEQ ID NO: 13731 - DNA, 682 bp, Panicum virgatum
  misc_feature: Ceres CLONE 1770311-R
  misc_feature: Encodes the peptide sequence at SEQ ID NO. 13732
acgagaccacctctgtgctgctctccattctcgtctatttcattgggaaatctcccagcatcatcgaccaactcaagaaagagcatgaggccatcaggtccacaaaggggaaggaggagcccttgacgcctgacgactacaggaagatggagtacaccagtcgtgttatcaatgagggactgagatgtggcaacatcgtcaagctagtgcacaggaaggttctcaaggacgtcacctacaaaggatacgtgatcccggctggttggaaaatcctgcccatcttgggtgctgtccacgtggacccatcgcatcatctggaacccgagcagtttcagcctcgcagatgggaggggctgaaccagccggctggcaagagcttcgcgccgttcggaggtggactgcggctctgccctggatcggagattgtcaaagtggaggctgctttcttcctgcaccaccttgtgctcaactacaggtggaggatgggtgaagaggacgctcccatgctgcaccagtacgtggaattcaagaagggcctgcccatacagctcgagccggtcagctgatgctcatcaagcctttgcctcgctcgctcttcgtcaagactccaagagagatgaaataagttgagacgtcggacccccgccagccagccagtcctgaatcgcgatttacaagtcac

SEQ ID NO: 13732 - protein, 187 aa, Panicum virgatum
  misc_feature: Ceres CLONE 1770311-R
  misc_feature: SWISSPROT Homolog: EC 1.14.13.93 (+)-abscisic acid 8'-hydroxylase
  misc_feature: Useful for making plants with modulated oxidative stress sensitivity
ETTSVLLSILVYFIGKSPSIIDQLKKEHEAIRSTKGKEEPLTPDDYRKMEYTSRVINEGLRCGNIVKLVHRKVLKDVTYKGYVIPAGWKILPILGAVHVDPSHHLEPEQFQPRRWEGLNQPAGKSFAPFGGGLRLCPGSEIVKVEAAFFLHHLVLNYRWRMGEEDAPMLHQYVEFKKGLPIQLEPVS

SEQ ID NO: 13733 - DNA, 851 bp, Panicum virgatum
  misc_feature: Ceres CLONE 1770311
ggatcctccctacccgctcacaaaaccctagcccaacaccgcccggccgccgccgccgccgccgccggggacgatggcgaagcctcggcgcggccgctccgcctcgcgctcttcctcgggctcctcctcccgctcgccgtcccgctccgtctcctccggctccgtctcgtcccgctcccggtcgcgctcccgctccttctcgtcctcctcctcccagtctcggagccgctcccctcccccacataagcgcagctcatcgggagcaaggaaaggtcaatcaccttcaccacctcctaaaaaaggttcaccctcaaagaaagtccgttcaccatcaccaccgcctaaaaaggcttcaccccctaggaaagcatctcctcctgctgagtctgctgttctctgcattgatcatttatcaaggaatgttaatgagtctcatttgaaagagatttttggaaactttggcgaagtggttaatgtggagctatcaatggatcgattggtcaatcttcctcgcgggtatggttatgttgaattcaagaagagagctgatgccgagaaagctcttctttacatggatggtggtcaaattgatggaaatgttgttaagttgcgatttacacttcaaccacgccaaagggctgcatcacctacgaaggttcctccccctccaaaaagagatgctcctccaaatgacaaaggtgctagcagtgctgaagaggatgcccagcagcgtcctagggaatcatctccacgaaagaagcctgcctcacctccacggaagcgatctcctccgaatcgaagggtcgagtcacccaggcatccacctgacccatcacctaggcgtcgtcctg

SEQ ID NO: 13734 - DNA, 2018 bp, Panicum virgatum
  misc_feature: Ceres CLONE 1770314
  misc_feature: Encodes the peptide sequence at SEQ ID NO. 13735
atctccgcctccgcctcctccagcgcctgctgctccggctgaggccctccttccctcctctcctcgtctcgcctgcgccgccaccaccaccgcctcctcgcagcgccccccggcctctcctcctcggcgcgcgctgccccgatcccgccggagtgcccgcgccgaccgccggcgaggagctccgggcggctggttcgccgtgacctcgcggggctgcgtcctcgtcgtccggctgttctcgcccgtcgtcgctgcttccgcgagtggcgccgtgtcggcggcgcatgccggcggcggcgcgggaacgaggcgagggcggcgcgccttgtcgccgcgcggactgacatgacttgagccttgagatttaggatgtgtacagaggggctgtattcttgtgtataggttctctttcaattgatcaaactgttgcagtttctgacggaatgttggagggtcaatcttgcctgatatcaaggtcactgccaagctcctgtgagcaggaatccagactagcttacatgactttccacctcctcgagatcacaaggagtaagcgcccacctgcaaacctgtctattgaacacgatgttgctgcagtggcagcgttgactaaacggaccaagtccgccgagaaccagaagggtgagccactggatagtcagggcagtaatgatcagggcgattcagattcaagcaccctgataagttccattggtcgggataactctatcaactgccttgcccgttgctctcgttctgattatggttctattgcatcactcaaccgaagcttccggtcacttgtccgcactggtgatctgtacaaggaacgtcggcagcttgggatttcagaacactgggtctacttctcttgcaatgtgcaggagtgggaggcgtatgatccctaccgttcacggtggatgacacttccaagaatgccccataacgaatgtttcatgtgctctgacaaggagtcacttgctgtgggcactgaacttctggtgtttggaaaggagattctttcacatattgttctgagctatagcattctgacaaattcatggtcgcggggtgttgaaatgaatgcccctagatgtttgtttggatcagctagtttcggagagaaagcaattatagctggtggcatggatgctgatggacgggtgcttcgctctgctgagctgtataactctgaaactaaaagatggataacacttccaaacatgaataaagctaggcggatgtgttctggtgtatttatggatggaaagttttacgtaattggtggaatggccagtaacacggaagtccttacctgtggagaagagtatgatttagatagaggtacctggcgggtgattgagaacatgtctgaggggctcaatggtgcaagtggtgctcctccacttgttgctgtagtcgaaaatgagttgtatgcagcgcaatacgcaggaaagctagtaagaaagtacaataaaagagagaactcatggataacattgggtgagttaccagagcgacctgaagccgtgaatggatggggcattgcattccggggctgtggagagcggcttttggttattggtggaccaagagtgttgggtggtgggatgattgagcttcattcttggatcccaagggaaggtccattacaatggaacatgatcggaagcaaaccttctggtaactttgtttataactgtgctgtcatggggtgctgatctgttctctctcaaacataccgtcgacaagaaagattgtgatattggttttatcatatggcataaagcactgattctacctgatgggtaatctctgcattctttttgacatttcagattttactcaaggccgaatagagtagtcagttccatgtactcgttaatagttacccattggtttctgttttcagcacatttgatttgcagtacctttgctccatatactctgttgaaatgagttctctgagatggatgcatataggtgacaaactgtaattgagataaccgtgcatttac

SEQ ID NO: 13735 - protein, 425 aa, Panicum virgatum
  misc_feature: Ceres CLONE 1770314
  misc_feature (216)..(262): Pfam Name: Kelch_1 Pfam Description: Kelch motif
  misc_feature (264)..(310): Pfam Name: Kelch_1 Pfam Description: Kelch motif
MLEGQSCLISRSLPSSCEQESRLAYMTFHLLEITRSKRPPANLSIEHDVAAVAALTKRTKSAENQKGEPLDSQGSNDQGDSDSSTLISSIGRDNSINCLARCSRSDYGSIASLNRSFRSLVRTGDLYKERRQLGISEHWVYFSCNVQEWEAYDPYRSRWMTLPRMPHNECFMCSDKESLAVGTELLVFGKEILSHIVLSYSILTNSWSRGVEMNAPRCLFGSASFGEKAIIAGGMDADGRVLRSAELYNSETKRWITLPNMNKARRMCSGVFMDGKFYVIGGMASNTEVLTCGEEYDLDRGTWRVIENMSEGLNGASGAPPLVAVVENELYAAQYAGKLVRKYNKRENSWITLGELPERPEAVNGWGIAFRGCGERLLVIGGPRVLGGGMIELHSWIPREGPLQWNMIGSKPSGNFVYNCAVMGC

SEQ ID NO: 13736 - DNA, 1895 bp, Panicum virgatum
  misc_feature: Ceres CLONE 1770316
  misc_feature: Encodes the peptide sequence at SEQ ID NO. 13737
actgtgttccctgccacatagaaacgagctgtcttgagctgagcaccactgaaccattggcgttctccccacagcacacagagcagagcaagaagccgccggcgatggcttccgccgcgctgccggaggccgtcgagcccaagaagaagggcaacgtccggttcgccttcgcctgcgccatcctcgcctccatgacctccatcctgctcggctatgatatcggagtgatgagcggggcgtcgctgtacatcaagaaggacctcaacatcagcgacgtgcagctggaggtcctcatgggcatcctcaacgtctactcgctcatcggctccttcgccgccgggcggacgtccgactggatcggccgccgctacaccatcgtcttcgcggcggtcatcttcttcgcgggcgccttcctcatgggcttcgcggtcaactacgcgatgctcatgttcggccgcttcgtggccggcgtcggcgtcggctacgcgctcatgatcgcgcccgtgtacacggccgaggtgtcccccgcgtcggcccgcggcttcctcacctccttcccggaggtgttcatcaacttcggcatcctcctcggctacgtctccaactacgccttctcccgcctgccgctccgcctcggctggcgcgtcatgctcggcatcggcgcggcgccgtccgtcgtgctcgcgctcatggtgctcggcatgcccgagtcgccccggtggctcgtcatgaagggccgcctcgcggacgccaaggtcgtgctgggcaagacctccgacacgccggaggaggccgcggagcggctcgccgacatcaaggccgccgccggcatccccgcggagctcgacggcgacgtggtcgccgtgcccaggggggagagcaacgaggaggcgcgggtgtggaaggagctcatcctgtcgcccaccccggccgtgcgccgcatcctcctctcgggcctcggcatccacttcttccagcaggcgtccagcatcgacgccgtggtgctctacagcccgcgcgtgttcaagagcgccggcatcacctccgacaacaagctgctgggcaccacctgcgccgtgggcgtcaccaagacgctcttcatcctggtggccacgttcctgctcgacaaggtcggccggcggccgctgctcctgagcagcgtggccggcatgattttctccctggccggcctcgccacggggctcaccgtcatcgaccaccaccccgacgccaaggtcccgtgggccatcggcgtggccatcgcgtcgaccatggcctacgtggccttcttctccatcggcctgggccccatcacgtgggtgtacagctcggagatcttcccgctgcaggtgcgcgcgctcgggtgcgcgctgggcgtggccaccaaccgcgtgaccagcggcgtcatctccatgaccttcatctcgctgtccaacgccatcaccatcggcggcgccttcttcctgtacgccggcatagcggcgctggcgtgggtgttcttcttcacctttctcccggagacccgcgggcggacgctggaggcgatgaccaaactgttcggcgccaccgacgaggacgacctcaagccgcaggacggcgccaccaaggacaagaagcagctcgagatggccagcgccgccaactaactcgctccaaattacaggacctcaagggggttccatgcgatcgaaaagcttgtgcagtaggcaccaggcggcacctagccagctgccattgttgccgtatatgagctagctagtaggctgaagtaacgtgggaagattcgctgatgatccggctgaaggccggcaagctcaggccagctcgtcgctctcttgatcagcctcttagtatctcctcttttttttttaagcacatggactgtgatttgctcc

SEQ ID NO: 13737 - protein, 513 aa, Panicum virgatum
  misc_feature: Ceres CLONE 1770316
  misc_feature (24)..(485): Pfam Name: Sugar_tr Pfam Description: Sugar (and other) transporter
MASAALPEAVEPKKKGNVRFAFACAILASMTSILLGYDIGVMSGASLYIKKDLNISDVQLEVLMGILNVYSLIGSFAAGRTSDWIGRRYTIVFAAVIFFAGAFLMGFAVNYAMLMFGRFVAGVGVGYALMIAPVYTAEVSPASARGFLTSFPEVFINFGILLGYVSNYAFSRLPLRLGWRVMLGIGAAPSVVLALMVLGMPESPRWLVMKGRLADAKVVLGKTSDTPEEAAERLADIKAAAGIPAELDGDVVAVPRGESNEEARVWKELILSPTPAVRRILLSGLGIHFFQQASSIDAVVLYSPRVFKSAGITSDNKLLGTTCAVGVTKTLFILVATFLLDKVGRRPLLLSSVAGMIFSLAGLATGLTVIDHHPDAKVPWAIGVAIASTMAYVAFFSIGLGPITWVYSSEIFPLQVRALGCALGVATNRVTSGVISMTFISLSNAITIGGAFFLYAGIAALAWVFFFTFLPETRGRTLEAMTKLFGATDEDDLKPQDGATKDKKQLEMASAAN

SEQ ID NO: 13738 - DNA, 779 bp, Panicum virgatum
  misc_feature: Ceres CLONE 1770323
  misc_feature: Encodes the peptide sequence at SEQ ID NO. 13739
gcagttgatttctgagcccgtggaagaacacggggtgcgccaacggcgttcgctccagcgccctccgtgtccccttggcgggcgccggcctcgccattggagatgatccggagctgaacccaaacccccgggaattcgggacgccgagcgccggagcaaatggagcagctggtggggattcacaatcaccaccaccaccaccactccctctcccctcggacccctcgcaccccgacccgcgcgcagccgcagccgcagccgctcctccaccacctgccgtccaaccggttccgggatccccagtcccagattcgcgccgctgccggcaggatcctccgcgccaccccgcccttcttcctcgtcctcctcgccgccgtctacctcctcgcctccgtcaccatcttctccgcccccacgccgctgctccgcctccgcgggacctctcccaggcccctcctcctctccatgcccgcgccgccgcccgcgccggagttcttcgagctccacggcggggggcttcgggtccgcctcaccaatgtcggcgccgccgtcacctcgctccttgccccggacaagaacggggttctcgctgatgtggtgcttgggttcgactcgctggatccgtatctgaacggaacttcaccttactttggctgcattgttggtcgagttgcaaatagaatcaaggatggaaagttcactctaaatggggtgcagcacaatctgagtatcaacaacccaccaaacactcttcatggtggatttaaagggtttgaaca

SEQ ID NO: 13739 - protein, 104 aa, Panicum virgatum
  misc_feature: Ceres CLONE 1770323
  misc_feature: SWISSPROT Homolog: EC 5.1.3.3 Aldose 1-epimerase
  misc_feature: Useful for making plants with altered oil content
MPAPPPAPEFFELHGGGLRVRLTNVGAAVTSLLAPDKNGVLADVVLGFDSLDPYLNGTSPYFGCIVGRVANRIKDGKFTLNGVQHNLSINNPPNTLHGGFKGFE

SEQ ID NO: 13740 - DNA, 1741 bp, Panicum virgatum
  misc_feature: Ceres CLONE 1770327
  misc_feature: Encodes the peptide sequence at SEQ ID NO. 13741
aggccgtaccgtccccgcaaaggcagccgtaccgcggcgcacgcccctgtggctctgtcgcgctcggcctgcctttccaccggcgcggcgctcccccgcttttccctctctctctctctctctctgccgcgcaccccgccccgcatgcgcccgcaactggccgagccgccccgagccccacgccgtcgccatcccccgccgttgccgtttcgattcacctgtcggagcagaggcggggagccatggcggacgcggcggcaccgccgcccgggctgccagtggcggcgggcagggacagggacaaggacaaggacgaccgccgccgctgggcggcccgctgcggcttcgccgtgctcggcatcatgggcactctcctcgtctacggcgtcctccaggaaaagatcatgagaattccctatggagcagagaaggagttcttcagatactcactttttcttgttttctgtaaccgcatcacaacatccatggtatctgcaatgttcttactggcaagtaagaaatcattggaccctgtggctccattgcacaaatatggtgttgtctctatatcaaatatgctgacgacaacctgccagtataaggccctcaagtatgtcagtttccctatccaaacacttgccaaatgtgcgaagatgatacctgtgatgatctggggcacaataataatgagaaagaagtatggtggaaaagattacttctttgctgccatcgtgaccctgggttgctcattgttcattctatatccggcatcgatggatgtcagtccattcaacaaaggcagagaaagcactatttggggtgtttcacttatgcttggttatcttggttttgatgggttcacaagcacgttccaagataaactcttcaaagggtatgacatggaaatacacaaccaaatattctacacgacaatgtgctcatgtcttcttagtttaactggtttgatactccagaatcatctgattccagctgtggacttcatgttccgtcatccagattgcttctctgacgtcgtaatcctatccagtgttgcgacggctagtcagttcttcatatcctacaccattcgaacatttggggctctcacatttgctaccataatgacaactagacagctggtgagcatattgctgtcctgtgtctggtttgtacatcctctcagctggatgcagtgggttggtgcggcaattgtatttggagccctgtacacaaagagtttcttgagaagtaaaccacagaagacagcggtcgcaagcccgccacgctgttctagcccgaatcctcctaacaacagttgacaaaataatataggaaaaaattgacttgttgcatcggaacgaagtctgtgtccgagatcaacagcgtcatgacaagttaaccgggcagatagattccagatctagctgtgttactaccccctgacctggaggagatgaaggtggacctagtgttagtttagcattcaggcagtccaacccttattatgtgagctgggttgccaattttgtagctcagccgtgttctctattagctctatgcctgtatcgcaacagtttcttggaccattctacttttggtctgtagaaaaattttatacactcaacataagcattgtgtatatgggtctatttttagttttgagaaaacactatttgtctgtcgacactagacatatttgtaatgttctttttttatcctagatttgtaatgttctagttgg

SEQ ID NO: 13741 - protein, 358 aa, Panicum virgatum
  misc_feature: Ceres CLONE 1770327
  misc_feature (33)..(339): Pfam Name: UAA Pfam Description: UAA transporter family
MADAAAPPPGLPVAAGRDRDKDKDDRRRWAARCGFAVLGIMGTLLVYGVLQEKIMRIPYGAEKEFFRYSLFLVFCNRITTSMVSAMFLLASKKSLDPVAPLHKYGVVSISNMLTTTCQYKALKYVSFPIQTLAKCAKMIPVMIWGTIIMRKKYGGKDYFFAAIVTLGCSLFILYPASMDVSPFNKGRESTIWGVSLMLGYLGFDGFTSTFQDKLFKGYDMEIHNQIFYTTMCSCLLSLTGLILQNHLIPAVDFMFRHPDCFSDVVILSSVATASQFFISYTIRTFGALTFATIMTTRQLVSILLSCVWFVHPLSWMQWVGAAIVFGALYTKSFLRSKPQKTAVASPPRCSSPNPPNNS

SEQ ID NO: 13742 - DNA, 823 bp, Panicum virgatum
  misc_feature: Ceres CLONE 1770329
  misc_feature: Encodes the peptide sequence at SEQ ID NO. 13743
aagttcccttccattctccatcagccatcacccagccgaatcgaaaactgcccccaaacccacccgcgaatcggacccaattcgaccgtggaatcgcgccatccggccgccccccgcccgccaccatgagcttctcgtccatgagcaagcagcaggtgctggacgccggcgagggcgcgggggaggaggtcgtggagctgatcccgggcctgccggaggaggtggccgagaagtgcctcctccacctgcccttcctctaccaccgcctcttccgcaccgtctcctccacctggaaccgcttcctcaccgacgcccccgccaagccgctgctgctcgcccccgcccccgccgctgcggcggccgctgtgtcggtgtcgttctcgctgccgttcctcttcgccttcgcgtttgaccccacgtcgcggcgcctccagtgccaggcgctcgacccgttctcccggaggtggctcctgctcccgccggtgcccggcggcgccgcggccgggtcgttcgcggtggtcgggctcccccgccgcggcgagatctacgtgattgggggcgtcgaggagggcggcgacaaggccgtgcggagcgtggccgtgtacagcgccgcgcggaacgggtggaaggcggcggcggcgatgcggacgccccgcgggtacatggcggccggggaggtgggcggacgcgtggcggtggccggggaggacggcgaggcggaggtgttcgacccggaggccgggcggtggctcccggcggcgccgcgccgcggcgcgacggtggcacggtacgacgccgcggcggcgggcgggaagctgtacgt

SEQ ID NO: 13743 - protein, 232 aa, Panicum virgatum
  misc_feature: Ceres CLONE 1770329
  misc_feature (24)..(71): Pfam Name: F-box Pfam Description: F-box domain
MSFSSMSKQQVLDAGEGAGEEVVELIPGLPEEVAEKCLLHLPFLYHRLFRTVSSTWNRFLTDAPAKPLLLAPAPAAAAAAVSVSFSLPFLFAFAFDPTSRRLQCQALDPFSRRWLLLPPVPGGAAAGSFAVVGLPRRGEIYVIGGVEEGGDKAVRSVAVYSAARNGWKAAAAMRTPRGYMAAGEVGGRVAVAGEDGEAEVFDPEAGRWLPAAPRRGATVARYDAAAAGGKLY

SEQ ID NO: 13744 - DNA, 2045 bp, Panicum virgatum
  misc_feature: Ceres CLONE 1770331
  misc_feature: Encodes the peptide sequence at SEQ ID NO. 13745
accaaccaaaggagagcacccgcgcatgtttagcttcgccgggcgcgcctccaccgcatcgagcatcgtcgccagcctcgccacccccgcgccgccgtccaagcccagcagccccgccttcgcctccgcccgccgccccaggctcatcatgagcgcgcccgtcttcgccgcccccagcgccgtcgcggatgtttgatgtgggtaggaattgatagaaagcagctgatagcctggtaatgtgctatatagcagtataaacagtatcagagcgagcggcctgcaagcaatggagccaacagttatagagtatcaagaattaaaacaaattacagatggattctccaagaatcgaaaaatcggtgaaggcggatatggaatagtttattgggggttacgtgaaaatggagatgagattgccgtgaagatgctccgagataatattcgtttagatgaaaagcaattccagaatgagtttggccaccatttcgagctcaagcatgataacattgtccgactagttggcttctgccatgagtccaaaggtgatgccataatgcaccaagggaattttgttcttgcagagacacgatatagagctttgtgcttcgagtatatgcacaatgggagccttcaaaagtatatatctgatgaatgtgataaacttgactggcataccagttacaaaataattaaggggacttgcgagggtttgaaatacctccacgaaagatccaaacctattttgcatttagatctgaaacccgacaatatattgcttgacaagaacatggtgcccaaacttgctgactttggcctgtccaaggacttccaggacagaaaaacaaggaccacaaaaaatgttgtaggaacgcatggatacatgccaccagaattcctaaaagaaaaaacgttttctgacaagaatgacatattcagcctgggagttataataattgagatcatgatgggacctgcaggctactcacaatttaaaggaatgtcttcagtctcttcagagagatccgataaaggaatgtcttttggtaaagacgataaaaaagaattatttattgatctggtacaagaaaaatggaggcgcaagttacaggcaacacatagtgattcctttttagaagagtattgcaagcaaataaagatatgcaccgacatagcaatagattgtgtgaatgatgataaggaaaaaaggcctaggatagtggagatcatcaaaaggttgaacgaggcaggacccacgattgaccaagaaaataatatcattgttcccacttatgggttaactgcacatacaacccatgacattgtgagcctgccagttgtcaagcttggaatgtggggtggaaatgagggaagatatcatgaccttagtgtgatgcctcgacgcctactaactatgacagttcgctgtggagaagctattgattcaattgaattttcttacattggtgtggatttgaaagagcatgtgtccggccggtggggtggtacttatggagaagcccctagaaagattatcttgggccctgatgagattgtacaggaaatttctggtacatatgccgattacagaagagaaagagacgttataagatcacttactattttcaccaattttgataaagagcattcttttggtgaacccataggaaatcctttccggattcctgtggataataatggccatatcgtgggtttctacgcacgttcgaaacagtttcttaacgcgatcggcatctatgttcatccatgaaaataacagatgcggagatccgtgcttattattctggtgttgaatgagttggacgtgggagatggcgcacgactgatcatcatcatcatcaggaggccagtcgcaatcttctgattgtaataaattaattatttctgtagccaataaatgcagaaaatactacatgcgctgtccatcgtgaaggcagcacaaaaacacactactactgcagtgtttcttgtcatgttagctacaggaacttgttagagaatcaaaacaagcattattgagcgtgggc

SEQ ID NO: 13745 - protein, 493 aa, Panicum virgatum
  misc_feature: Ceres CLONE 1770331
  misc_feature (18)..(317): Pfam Name: Pkinase Pfam Description: Protein kinase domain
  misc_feature (361)..(493): Pfam Name: Jacalin Pfam Description: Jacalin-like lectin domain
  misc_feature: SWISSPROT Homolog: EC 2.7.11.1 Non-specific serine/threonine protein kinase
MEPTVIEYQELKQITDGFSKNRKIGEGGYGIVYWGLRENGDEIAVKMLRDNIRLDEKQFQNEFGHHFELKHDNIVRLVGFCHESKGDAIMHQGNFVLAETRYRALCFEYMHNGSLQKYISDECDKLDWHTSYKIIKGTCEGLKYLHERSKPILHLDLKPDNILLDKNMVPKLADFGLSKDFQDRKTRTTKNVVGTHGYMPPEFLKEKTFSDKNDIFSLGVIIIEIMMGPAGYSQFKGMSSVSSERSDKGMSFGKDDKKELFIDLVQEKWRRKLQATHSDSFLEEYCKQIKICTDIAIDCVNDDKEKRPRIVEIIKRLNEAGPTIDQENNIIVPTYGLTAHTTHDIVSLPVVKLGMWGGNEGRYHDLSVMPRRLLTMTVRCGEAIDSIEFSYIGVDLKEHVSGRWGGTYGEAPRKIILGPDEIVQEISGTYADYRRERDVIRSLTIFTNFDKEHSFGEPIGNPFRIPVDNNGHIVGFYARSKQFLNAIGIYVHP

SEQ ID NO: 13746 - DNA, 651 bp, Panicum virgatum
  misc_feature: Ceres CLONE 1770337
  misc_feature: Encodes the peptide sequence at SEQ ID NO. 13747
accactcctccccttccaaccccagctcccggcggcggcggcgagcggcggagatgacgacgagcctgaagaagaaccggaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaggttctcctgcccgtcggtcaacgtcgagcggctctggtcgatggtgcccgccgacaaggccgcggaagcggcggccggcgcggacaaggccccgctggtggacgtgacgcagttcggctacttcaaggtgctcggcaaggggatgctaccgcccaagcccatcgtcgtcaaggccaagctcatctccaaggtcgcggagaagaagatcaaggccgccggcggcgccgtcgtgctcaccgcataggtctttttacatcttgtttcgtctatctgtgctaagaaaacttatgaatttgttgtggattctgagttttgagaacccccccccccctttttgtgcacttggtaacgaatgccagttcatttacatttcagattgcctgagatctgttgctgcg

SEQ ID NO: 13747 - protein, 147 aa, Panicum virgatum
  misc_feature: Ceres CLONE 1770337
  misc_feature (109)..(141): Pfam Name: L15 Pfam Description: Ribosomal protein L15
MTTSLKKNRKKRGHVSAGHGRIGKHRKHPGGRGNAGGMHHHRILFDKYHPGYFGKVGMRYFHKLRNRFSCPSVNVERLWSMVPADKAAEAAAGADKAPLVDVTQFGYFKVLGKGMLPPKPIVVKAKLISKVAEKKIKAAGGAVVLTA

SEQ ID NO: 13748 - DNA, 1763 bp, Panicum virgatum
  misc_feature: Ceres CLONE 1770342
  misc_feature: Encodes the peptide sequence at SEQ ID NO. 13749
gagcagtttccaatcttctccatctgtgagtagtcagcggagcaggagaagatgtctccttacgtgcttgccgccgtcggcgccgtgcttatcgtcttcctctatgtcgtcgagaaccgccagcgcggtaagctcccaccgtctcccccgtcgctgccgctgattggccacctccacctcatcggccgcctcgcgcaccgctccttgcacgacttgcaacttcgatacggcggcggcggcggcctcctcttcctgcagctcgggcgcaggcggacgctggtcgtgtccacggccgcggccgccgcggacctgttcaggaaccacgacctcgccttcgcctcccgcccgcgcagcgtggcagcggagaagctgtcgtacggctgcctcaacgtgtcgttcgcgccgtacggcgagaactggcgccggaccaagaagatcgccgtggtccacctcctctccccgcgccgcgtggagtcgttcgcgcccgtgcgcgccgccgaggtggccgcgctcgtcgcccggacccgccgcgccgcggaggcgggggaggccgtggagctgagggagctcctgtacggctacgcgaacgcggtgatcacccgcgcggcgaccggtgccgccggggcaacagccgagaagatgaagcagctgatggggaactccgaggcgctgatggcgggcttccagccggaggacgtgctgccggacgcgccggcgaggttcgtgagatgggcgacgggcttcgacaggaaggtcgacgacatggccgaggcgtgggacaagttcctgtccgagatagtggcggcacacaaggagaaggggggcgacggtgcaggcgaggaggatgaggacttcttggacgtcctgctgcggctgagggaagaaggcgccgacgggctcgagctcacagacgatcgtatcaaatccatcatcgaggacatgatagccgcggcaactgaaacatcgtcgcagacgctggaatggtccatggcagagctcgtcgccaacccgcgggtgatggcgaagctccaagacgagatcgcgcgcgtcgccaccgccgatcagccggccatcgcggaaccggacctgaacaggctggagtacctgaaggcggtgttcaaagaggtgctgcggctccacgcgccggcgccgctcctcgtcccgcacgaatcgacgacgccggcggtcgtgcaggggtacgagatcccggccaagaccgcgctcttcatcaacgcgtgggcgatcgggcgggaccccgcggcgtgggacgcgccggaggagttccggccggagcggttcgtgggcggcggcgccgcccccgcggacttcagagggaccgagtaccagctcatcccgttcggcgccggccggaggacctgccccggcatcaacttcgcgctgccggtcttggagctcgcgctcgccagcctcctgcgccacttcgactgggagctccccggcggcatgcgcccggcggacctcgatatgggcgaggcgccggggctgacgacgccgcggcgggttccccttgtcctagtccccaagaccaagacgctcgcctagccatcactctagtaggaatcggtgtgctgccaccagcaccaaatcggcatccttccatgggaactgggcaccgtggtttgtgcatgaactatgaagtagttgtcttgtggatcaaaactcatctctcgtgaatctatctgatgtgtaacaatttgattcatctattgcaatacgcatgttcccaagtcgaaattttccac

SEQ ID NO: 13749 - protein, 503 aa, Panicum virgatum
  misc_feature: Ceres CLONE 1770342
  misc_feature (29)..(496): Pfam Name: p450 Pfam Description: Cytochrome P450
  misc_feature: SWISSPROT Homolog: EC 1.14.13.68 4-hydroxyphenylacetaldehyde oxime monooxygenase
MSPYVLAAVGAVLIVFLYVVENRQRGKLPPSPPSLPLIGHLHLIGRLAHRSLHDLQLRYGGGGGLLFLQLGRRRTLVVSTAAAAADLFRNHDLAFASRPRSVAAEKLSYGCLNVSFAPYGENWRRTKKIAVVHLLSPRRVESFAPVRAAEVAALVARTRRAAEAGEAVELRELLYGYANAVITRAATGAAGATAEKMKQLMGNSEALMAGFQPEDVLPDAPARFVRWATGFDRKVDDMAEAWDKFLSEIVAAHKEKGGDGAGEEDEDFLDVLLRLREEGADGLELTDDRIKSIIEDMIAAATETSSQTLEWSMAELVANPRVMAKLQDEIARVATADQPAIAEPDLNRLEYLKAVFKEVLRLHAPAPLLVPHESTTPAVVQGYEIPAKTALFINAWAIGRDPAAWDAPEEFRPERFVGGGAAPADFRGTEYQLIPFGAGRRTCPGINFALPVLELALASLLRHFDWELPGGMRPADLDMGEAPGLTTPRRVPLVLVPKTKTLA

SEQ ID NO: 13750 - DNA, 2162 bp, Panicum virgatum
  misc_feature: Ceres CLONE 1770351
  misc_feature: Encodes the peptide sequence at SEQ ID NO. 13751
agcctggcttcgtttcgtcctcgcctcgcatcgcttctctctctagcccaccctcctctcctctcctcccccattcgcacagtgcccaatgccgcgcaaaccctagtgcccccactcccgatctcgcgcggcagccatgggcaactgctgccgctcgccggccgccgcggcgcgggaagacgtcaagtcgtcgcacttcccggcctccgccggcgggaagaagaagccccaccaggcgcggaacggcgccggggccggcgggggcggcggcgccgccggggagaagaagcggttgtcggttctcggggaggaggggtgcgacgtgggcgccgggatcgaggagaagtacgcgctggaccgggagctggggcgcggcgagttcggggtgacgtacatgtgcatggaccggggcacgcgggagctgctggcctgcaagtcgatctcgaagcggaagctgaggacgccggtggacgtggaggacgtgcgccgggaggtggccatcacgcgtcacctgcccaagagccccagcatcgtgtcgctgcgggaggcgtgcgaggacgacggcgccgtgcacctcgtcatggagctctgcgagggtggggagctgttcgaccgcatcgtggccaggggccactacacggagcgcgcggcggctgcggtcacgcgcaccatcgtcgaggtcgtgcagctctgccaccggcatggcgtgatccaccgggacctcaagcccgagaacttcctcttcgccaataagaaggagaactcaccgctcaaggccatcgacttcggcctctccatcttcttcaagcctggtgaaaagttttcggaaattgtgggaagtccctactacatggctcctgaagtcctgaagaggaactatggtcctgaaatagacatatggagtgctggtgtcatcttgtatattttgctatgtggtgttcctccattttgggctgagactgaacaaggagtcgcacaagctattcttcggggaaatatagattttaagcgagaaccctggcccaatgtttcagataatgctaaagatcttgttcgacagatgcttcagcctgatccaaaactcaggctaacggcaaaacaagttcttgagcatccctggctacaaaatgctaagaaagctccaaatgttcctcttggagacatcgtaaagtcaaggttgaaacagttttcaaggatgaacagattcaaaagaagagctctaagggtgattgctgatcacttgtctgctgaagaggttgaggacataaaagagatgttcaaagtgatggatactgataatgatggtatagtctcttacgaagagttgaagaacgggatcgcaaaatttggttcccatcttgcagaatctgaagtgcaaatgcttatcgaagctgtggatacaaatggtagaggagcacttgattatggtgaatttttggctgtctcacttcacttgcaaaggatggcaaatgatgagcaccttcggcgggccttcctattttttgacaaggatggcaatggtttcattgagcctgaggagcttcaggaagccctggtggaggatggaggagccgatagcatggatgtggtcaatgacatattgcatgaggttgacacggataaggatggtaaaattagctatgaagaatttgtcgcaatgatgaagactggcacagactggagaaaggcgtcaaggcattattcaagagggcgcttcaatagccttagcataaagcttataaaagatgggtctctaaaactgggtaatgagtgaggttgctgcttgcagccattgctcctctcctctgcgcattgtagtctgcccctcgggcccactaagtagaagtctgccccttggacccactaaaaaaaccctcatccatttgctaatgattattttgtctgggatttagataggtggagcccccctgattggttggctcatgtaattagtagccctttcagtatcactgagaagcatgtgctgaatgatgcgcccctgcttgcctgctgtccatctcctccggtgtacctgacgctcaagtgttgtaaaatgtttttctgttgacctcgaatgcaatttgctactttgatgtactggaattgtagattcatttgcattggtaaagaactagatatgaaatgaaacacagctgaagatg

SEQ ID NO: 13751 - protein, 545 aa, Panicum virgatum
  misc_feature: Ceres CLONE 1770351
  misc_feature (71)..(329): Pfam Name: Pkinase Pfam Description: Protein kinase domain
  misc_feature (376)..(404): Pfam Name: efhand Pfam Description: EF hand
  misc_feature (484)..(512): Pfam Name: efhand Pfam Description: EF hand
  misc_feature (448)..(476): Pfam Name: efhand Pfam Description: EF hand
  misc_feature: SWISSPROT Homolog: EC 2.7.11.1 Non-specific serine/threonine protein kinase
  misc_feature: The sequence is a functional homolog of SEQ ID NO 2 in US patent 7084323
MGNCCRSPAAAAREDVKSSHFPASAGGKKKPHQARNGAGAGGGGGAAGEKKRLSVLGEEGCDVGAGIEEKYALDRELGRGEFGVTYMCMDRGTRELLACKSISKRKLRTPVDVEDVRREVAITRHLPKSPSIVSLREACEDDGAVHLVMELCEGGELFDRIVARGHYTERAAAAVTRTIVEVVQLCHRHGVIHRDLKPENFLFANKKENSPLKAIDFGLSIFFKPGEKFSEIVGSPYYMAPEVLKRNYGPEIDIWSAGVILYILLCGVPPFWAETEQGVAQAILRGNIDFKREPWPNVSDNAKDLVRQMLQPDPKLRLTAKQVLEHPWLQNAKKAPNVPLGDIVKSRLKQFSRMNRFKRRALRVIADHLSAEEVEDIKEMFKVMDTDNDGIVSYEELKNGIAKFGSHLAESEVQMLIEAVDTNGRGALDYGEFLAVSLHLQRMANDEHLRRAFLFFDKDGNGFIEPEELQEALVEDGGADSMDVVNDILHEVDTDKDGKISYEEFVAMMKTGTDWRKASRHYSRGRFNSLSIKLIKDGSLKLGNE

SEQ ID NO: 13752 - DNA, 748 bp, Panicum virgatum
  misc_feature: Ceres CLONE 1770352
  misc_feature: Encodes the peptide sequence at SEQ ID NO. 13753
ggcttcttccgtccgtcgtccccaggaagagcgattcgtcggcgacaccccgcgagcatgctgtccttgcgctgccacgccgccgcgccggcgacccgcggcgtcgcatgcgaacatggggcgcgctcctcgtttcctctgcggcggagataaataagatcgacggaggataaaaaaaagggttcttgaagcgattgcggcggcggaatagaagggaggccgcggccggcggcgaactcgcctgcgtgttcccggcgatgaagtacgtctccgggccgtacttcgagccggacttcgatccgctcctcgaccgcttcggcacgcccggggtcgtcgtcgacaacgagacacgcgaggactgcacgctcgtcaaggttgacagcgtgaaccgggacggcgtgctgctcgagatggtgcagctgctcaccgatctcgacctcgtcatctccaagtcctacatctcctcagacggcggctggctcatggatgtgttccacgtcacggaccagatcgggcgcaagctgacggacccgtcgctccccgagttcatccagcgggcgctcgtgccgttccaccgggccggcagcggcccgtcgccccggttcacgacgtgcctcggcaacgtggtcggccctggcggccccgacgtgtcggactgcgccgccctcgagttcacggtgcacgaccgcccggggctcctgtcggccatcacctccgtgctggtggacaacgggtgccacgtcgagtc

SEQ ID NO: 13753 - protein, 163 aa, Panicum virgatum
  misc_feature: Ceres CLONE 1770352
  misc_feature: SWISSPROT Homolog: EC 2.7.7.59 [Protein-PII] uridylyltransferase
MKYVSGPYFEPDFDPLLDRFGTPGVVVDNETREDCTLVKVDSVNRDGVLLEMVQLLTDLDLVISKSYISSDGGWLMDVFHVTDQIGRKLTDPSLPEFIQRALVPFHRAGSGPSPRFTTCLGNVVGPGGPDVSDCAALEFTVHDRPGLLSAITSVLVDNGCHVE

SEQ ID NO: 13754 - DNA, 833 bp, Panicum virgatum
  misc_feature: Ceres CLONE 1770356
  misc_feature: Encodes the peptide sequence at SEQ ID NO. 13755
gcggccgcccccgcacgccgcacgccgcccgccagcccacaccctgcctcacaccccctccgcgctccaaaaccctagctcttcgtcggcgatggcggctgcggcgcagggcggcgccgcgggcccggcggcgggcgaggaggaggccggcgagagccgcaagctcttcgtgggcggcatcccgtccgcggcgcaggaggccgagctgcgggcgcacttcgcccgcttcggggaggtgcgctccgccatcgtgatgcgggaccgggagacgggccacggccgcggcttcggcttcgtcgagttcgaggacgaggccgccgcggccgccgcgctcggcgacggggacaagcccaggcacttcatctgcgaccggatggttgacgttaagagggccaggacaagagctccacggaaccagggcgagcagaactctcagcctcagcagcctgaaaacggccggggtcaggggcaccaggacaatcagcagcagccggctgggcacggtactgctgacagcggtaacaatgtgagctatgattcaaagaaggtcttcattggcggcttgcgggataatatcaccgaggaggagttcaaggcttactttgagacttttggcactgtaacagatgttgtggtgatttatgacagcttgacaagccgctcgagggggttcggttttgtcaccttcgattcggaggaagcagtgggaaaggtgatgcgacaaagcttccataacctgaatggaaccaaggttgaggccaagattgctatccccaaggatgagcagtattaccgtaacggtcgagggcgtggggcacgaccctttggcagca

SEQ ID NO: 13755 - protein, 247 aa, Panicum virgatum
  misc_feature: Ceres CLONE 1770356
  misc_feature (25)..(94): Pfam Name: RRM_1 Pfam Description: RNA recognition motif. (a.k.a. RRM, RBD, or RNP domain)
  misc_feature (153)..(223): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAAQGGAAGPAAGEEEAGESRKLFVGGIPSAAQEAELRAHFARFGEVRSAIVMRDRETGHGRGFGFVEFEDEAAAAAALGDGDKPRHFICDRMVDVKRARTRAPRNQGEQNSQPQQPENGRGQGHQDNQQQPAGHGTADSGNNVSYDSKKVFIGGLRDNITEEEFKAYFETFGTVTDVVVIYDSLTSRSRGFGFVTFDSEEAVGKVMRQSFHNLNGTKVEAKIAIPKDEQYYRNGRGRGARPFGS

SEQ ID NO: 13756 - DNA, 830 bp, Panicum virgatum
  misc_feature: Ceres CLONE 1770360
  misc_feature: Encodes the peptide sequence at SEQ ID NO. 13757
atccacgcacccgagcacgcccaacgcagcgacccaccaccggccgccgccatgccgcgctgctgcccctgcgcgacctcctcctctccctccctgttcctcctcccttccgttcccgcctcttccgcttccaaaaccgccagcagcaggagggttgccttctccccgtgcgatggcgccttcagctgtgtcagcgggaggctgcggtgggggacgagaccgagaggcaggtgcgcgacagtcgaggcgagcggcaaggacgggagtggtacggcggaagaggaaaaggaaaaggacgagccggggttcaatccgttcgggttcgtcacggacaacccctccagccgcagcgccatccagctgcccgcggttcccgccgaggacggcaatgtcggccagatgctctacaggatcgaggacaaggggagggagtacggctcgtatgtcaggtcaggagagttccgatggtttgtgagggaaacaggttcacgtgatgcacgacgtgggactattgtgttccttcacggggctcctactcaatcatttagttaccgcgtggttatggctcagatggcagatgctggctaccactgctttgcacctgactggatcggatttgggttcagtgagatgccacagcctggatatgggttcgactttaaagaggaggagttccacaaggcatttgatgatcttcttggtactctaaatatcactgagcccttcttcttaattgtccagggatttcttgtaggttcttatgggctgacatgggcactgaacaactcaaacaaagtccttaagttagcaatcctgaatagtccacttac

SEQ ID NO: 13757 - protein, 259 aa, Panicum virgatum
  misc_feature: Ceres CLONE 1770360
  misc_feature: SWISSPROT Homolog: EC 3.8.1.5 Haloalkane dehalogenase
MPRCCPCATSSSPSLFLLPSVPASSASKTASSRRVAFSPCDGAFSCVSGRLRWGTRPRGRCATVEASGKDGSGTAEEEKEKDEPGFNPFGFVTDNPSSRSAIQLPAVPAEDGNVGQMLYRIEDKGREYGSYVRSGEFRWFVRETGSRDARRGTIVFLHGAPTQSFSYRVVMAQMADAGYHCFAPDWIGFGFSEMPQPGYGFDFKEEEFHKAFDDLLGTLNITEPFFLIVQGFLVGSYGLTWALNNSNKVLKLAILNSPL

SEQ ID NO: 13758 - DNA, 438 bp, Panicum virgatum
  misc_feature: Ceres CLONE 1770360-R
tgaaggccctgatatccttcctgtaaacgtggagagagatcacaaggtcatctgcaagggtacgggaacaaatgaatatatgcatgctggctgccatgtcttcgcttcgtccaactgtctgatttcattgtgccgtggattgcttagatttggtggcgcgacacattgttacagagctccactaaggtacgtttcaaaagcataacatgcggagattatgataactggataagagttaaaatccagcaaggtatgtaagcgatcatacagtgtttctcgtgcgtataagaactaagccatactttttggtgcattctattgttaaccagagcattttggtcagtggtcacaccctgtacagcttgtatagttgtatgtaactttggatacatgtggtatatatttgcaccaagagatacaaaacgaccttaatttccc

SEQ ID NO: 13759 - DNA, 1564 bp, Panicum virgatum
  misc_feature: Ceres CLONE 1770370
  misc_feature: Encodes the peptide sequence at SEQ ID NO. 13760
acacgagccacgagcacgggtcgtcgccgttcgcccgcgtccgcacgcacgcacgcacgctcgccgccagagcagagctctcgggctctccgcccgccccgctcccagaaggtccgaccgcggcggcgggcgatggcgcggaagaagatccgggagtacgactccaagcgcctcctgcgggagcacctcaagcgcctcgccggcatcgacctccagatcctctccgcgcaggtcacacaatcaacggatttcactgagcttgcaaaccaggagccatggctctcatctatgaagttggttgtgaaaccagacatgctgtttggtaaacgtgggaagagtggacttgtggccctcaacctagaccttgcccaagttcgccaatttgttaaggagcggttgggagttgaggttgagatgggtggctgcaaagctccaattacaaccttcatagttgagccatttgtgccccatgatcaagagtactacctttcgattgtatcagacaggcttggctgcaccattagtttctccgagtgtggaggtattgagattgaggagaactgggacaaggttaagacaatctttcttcccacagagaagcaaatgacacctgatgcatgtgctcctttgattgccaccctgccattggaggtccgcacaaaaataggtgatttcattagaggtgtattttctgttttccaagacttggatttctcatttcttgagatgaacccattcaccttggtaaatggtgaaccatatcctctggatatgagaggagaactagatgacacagccgctttcaagaacttcaataagtggggtaacattgagttccctctacctttcgggagagttctcagtccctctgaaagctttatccatgaactggatgagaagacaagtgcttctctgaaattcacagtattgaacccaaagggacgcatttggacgatggttgcaggtggtggtgccagtgtcatatatgctgatacggttggagatttgggatatgcttcagagctaggaaattatgcagagtacagtggagctcccaacgaggaggaagttctgcagtatgctagagtggttctggattgtgctactgctgatcctgacgggcgcaagagagcccttctcattggaggaggcatcgctaacttcaccgacgtcgctgccacatttagtggcatcattcgggctttaagagagaaggaatccaaattgaaggctgcaaggatgaacatttacgtccggagaggtggtccaaactaccaaaccggactcgcgaaaatgcgcactcttggtgcagaacttggttttccaattgaggtgtacggaccagaggcgaccatgactgggatctgcaagcaagccattgaatgcatcatggctgcgtaggctaccgtatagttgcaccttctgcagttgcacccgttttgtactttgaatgcaagcgattgttcgagtgaaacagagaatgatcattgttgtgtaaactctacctttgtaccacaattgctcaataatcgagatcttggcttgggatgtgaatgtgtatggt

SEQ ID NO: 13760 - protein, 422 aa, Panicum virgatum
  misc_feature: Ceres CLONE 1770370
  misc_feature (5)..(204): Pfam Name: ATP-grasp_2 Pfam Description: ATP-grasp domain
  misc_feature: SWISSPROT Homolog: EC 2.3.3.8 ATP citrate synthase
  misc_feature: Useful for making plants with modulated root development
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSDRLGCTISFSECGGIEIEENWDKVKTIFLPTEKQMTPDACAPLIATLPLEVRTKIGDFIRGVFSVFQDLDFSFLEMNPFTLVNGEPYPLDMRGELDDTAAFKNFNKWGNIEFPLPFGRVLSPSESFIHELDEKTSASLKFTVLNPKGRIWTMVAGGGASVIYADTVGDLGYASELGNYAEYSGAPNEEEVLQYARVVLDCATADPDGRKRALLIGGGIANFTDVAATFSGIIRALREKESKLKAARMNIYVRRGGPNYQTGLAKMRTLGAELGFPIEVYGPEATMTGICKQAIECIMAA

SEQ ID NO: 13761 - DNA, 1461 bp, Panicum virgatum
  misc_feature: Ceres CLONE 1770374
  misc_feature: Encodes the peptide sequence at SEQ ID NO. 13762
actcgcgcatattccccttctcatgcctcgccttccaccctgcagcttcttccagaagcttctcgaaacctgaatccacgctcaccgcgtgatccccatggcctccggcgagggcgccggcgatccgcggggcgcggccgccgccagcggtgaggcggggtccaagatggaggcggaggagcaggaggggcccgcgctgtgcctcgacctgacgagctaccagctgcacgatctcagcgaggtggagatcccgcccacgctggaggaggtcgacctcaccgccaaccgcctctcctccgtcgacccgcgcatcggccggctcgccggcctccgcaagctctccttccgccagaacctcctcgacgacgccgccgtggcgccgctctcgtcctgggacgcaatcgccgggctgcaggagttggtccttagagacaacaaacttacaaggattcctgatgccagcatcttcaagagtctcctgattttcgatgtatctttcaatgagatatcttccttgaccgggctgtccaaggtttccaacacattgaaggagctttatgtttcaaaaaatgaagttgcaaagatggaagaacttgaacacttccatgcattggaaattcttgaacttggcagcaacagattaagggtgatggaaaatcttgaaaccttgacaaatctacaagagctatggctgggaagaaatcgaattcaaactgtcaacttgtgtggtctgaaactgatcaagaaaataagtttgcaaagcaacaggttaacttcaatggatgggtttcaggaatgtattgcattagaggaactgtacctcagccataatggtattcaaaagatggaaggcctctctaccttgcagaacctccatgttttggatgtttcatctaacaagctaactgctatagaaaatattgaaaccttaaccaggttggaggacctgtggttgaatgacaaccaaataccatcactagacaggatagaggctgctttggctggttcacgggagaagttgacaaccatatatcttgagcgaaatccctgtgcaaaaactccaaattactcatccacactgaagcaaatatttccaaatcttgagcaaattgattcagatatcatagcttgaaactggcaaattggttgcgcaaatactcagtcaaagtaggcttgtttcctttccttttcctttttccagagaaggcaagttgagctttgtgaaggaacagttcagacttttgatcaagctcagagacattatggaaacggttatctattggctgcaactgttgcgggcctatgttttgccaagccaactctgcccccatttagaaaagtcggtcaagagtatgtatgcttgagcccctacgagctgaatagtagtagtgatcggtgaccaaataatgaacgattgatgtttggacgagcagagatgtagtaggattgtcagtttgtcac

SEQ ID NO: 13762 - protein, 344 aa, Panicum virgatum
  misc_feature: Ceres CLONE 1770374
  misc_feature: SWISSPROT Homolog: EC 3.1.3.16 Phosphoprotein phosphatase
MASGEGAGDPRGAAAASGEAGSKMEAEEQEGPALCLDLTSYQLHDLSEVEIPPTLEEVDLTANRLSSVDPRIGRLAGLRKLSFRQNLLDDAAVAPLSSWDAIAGLQELVLRDNKLTRIPDASIFKSLLIFDVSFNEISSLTGLSKVSNTLKELYVSKNEVAKMEELEHFHALEILELGSNRLRVMENLETLTNLQELWLGRNRIQTVNLCGLKLIKKISLQSNRLTSMDGFQECIALEELYLSHNGIQKMEGLSTLQNLHVLDVSSNKLTAIENIETLTRLEDLWLNDNQIPSLDRIEAALAGSREKLTTIYLERNPCAKTPNYSSTLKQIFPNLEQIDSDIIA

SEQ ID NO: 13763 - DNA, 1786 bp, Panicum virgatum
  misc_feature: Ceres CLONE 1770408
  misc_feature: Encodes the peptide sequence at SEQ ID NO. 13764
ctcgatcgaatcggccggtctcctcctccactctccctccccaccgcacccgcggttagcacagcaccatcctctctctctctctctctctctctctctctctcttcccccaccacgcttaggcttagcttacctccgatccgtctccattctccagcgagagctagctcgctgctcgatcggcccagatccacaaccaacagcgctgcaacaatgccgggtccggggagcgtgcccctggcgctgggcctggacacggcgggcgtgcaggtgccctggtacttccgctgccccatctccctggagctcatgaccgaccccgtcaccgtgtccacgggccagacctacgaccgcgccagcatcgagtcctgggtcgccaccggcaacaccacctgccccgtcacccgcaccccgctcgccgacttcaccctcatccccaaccacaccctccgccgcctcatccaggagtggtgcgtcgcgcaccgctccatgggcgtcgagcgcatccccacgcccaagcagcccgccgacccggacctcatccgctccctcgtcgcccagggcccgggcctccccgcgctccgcaggctccgggcgctcgccagggagtccgacaagaacaggctcgtcatggccacgcgcgagaccaggaccgcgctcctcgacgccgccttcgcctccggggccgccgacgagctccaggccgaggccatggccgtgctcgcgctcgtcggcctcggggaggccgaggccgccgaggtcgtggcccgggaggaccgggtcgccaggctcggcaagctcctcgccgccgccggcccgctcgaggccacggtcaacgcgggcgccgtcgtcgaggccgccgcgtcggcgtcgggcgcggaggcccgggcggtgctcggcgccgccgagggggtcatggagggactggtggcgctggtggaggagaaggcccacgcgcgcgccgtccgcgtcgggatccggggcctcttcgcgctctgcctggccaaggagaaccggccccgcgcggtggccgccggcaccgcgtccgcgctcgcccggcgcgtggcggagggcggcgccgccggggagcccgagcgcgcgctggcggccgtggagcggctgtgccgcgccgagggcggccgcgacgccgtggtcgccggggccgggggcgggccggcggcgatggcggcgctggtgcgcgccatgtccgggcgcgcggcggagcacgcggcgggcgcgctggtggccgtggtgggcgggtcggaggcgctgcaggtggaggcggtccgggcgggcgccatgagccagctgctgctcatggtgcagggcgggtgctcggagcgcgccaagcgcaaggcacagcacctcctcaagctgctccgctccgcctggccgaccaccgactgcatcgccaactccgacgacttcctgcagccgtactgaccatcatcatcgctcgcccgcccatgtctcggtgggtggattccgttccccaagggcgaagtgaggaagatcactcactcgctcgccagtcgccgcaaacgcaaggaaagggagaagctgccggcttgtatggcctggccgtgcgagcaacgcaacggccgcggcgtccggcacgccggcgccggcggcgtgtatgtaatgaatggtggaggaacgcggtagaatttttttccctaatgtttgtccagttttgtacgtacgtaatgttggcagggaggggaggaggatgggttcttggcccatgtttagttacaaaattcaaaattccaattttttttccggc

SEQ ID NO: 13764 - protein, 409 aa, Panicum virgatum
  misc_feature: Ceres CLONE 1770408
  misc_feature (19)..(93): Pfam Name: U-box Pfam Description: U-box domain
MPGPGSVPLALGLDTAGVQVPWYFRCPISLELMTDPVTVSTGQTYDRASIESWVATGNTTCPVTRTPLADFTLIPNHTLRRLIQEWCVAHRSMGVERIPTPKQPADPDLIRSLVAQGPGLPALRRLRALARESDKNRLVMATRETRTALLDAAFASGAADELQAEAMAVLALVGLGEAEAAEVVAREDRVARLGKLLAAAGPLEATVNAGAVVEAAASASGAEARAVLGAAEGVMEGLVALVEEKAHARAVRVGIRGLFALCLAKENRPRAVAAGTASALARRVAEGGAAGEPERALAAVERLCRAEGGRDAVVAGAGGGPAAMAALVRAMSGRAAEHAAGALVAVVGGSEALQVEAVRAGAMSQLLLMVQGGCSERAKRKAQHLLKLLRSAWPTTDCIANSDDFLQPY

SEQ ID NO: 13765 - DNA, 1065 bp, Panicum virgatum
  misc_feature: Ceres CLONE 1770415
  misc_feature: Encodes the peptide sequence at SEQ ID NO. 13766
tcctcagcaagatcgatcgacgactcgccgtcgtacgtgtagaacaggccgccgggatcgagggagaagagatggcggagcactgctcgcggtggcggacctccggcgctcgtcgcccgcgactctcctgcgcgcttgtggctttccttagcttcgtggctgcagggccgttcgtgctcgccgagggcatcgtcttccacgtggccaaccggtgcccgttcccggtgtggccggcgtcggcgcccaacacggggcacccggtgctcgccggcggcggcttcctcgtgccgccgggcaagtcgaggcgcgtcgtcgcgccggccacctggaacggccgcttctgggcccgcaccggctgcaacttcaccgcgaacggcgccgccgccgcgtgcctgaccggcgactgcgagggccggctggcctgcaacgggtccgtgggcgccccgcccgccacgctcgtggaggtgagcatggacgcggaccccggcaaggggagctcctacgacgtgagcctggtggacgggtacaacctccccgtgtccgtgtccgccacgggcgccgccgaccccagcaggtgcgccatcgccgggtgcgccagggacgtgaacgcggcgtgcccgccggagctgcaggtcaccgccggcagcggcggcgccaaggcggcggtggtggcgtgcaagagcgcgtgcctggcattcgggctggacgtcttctgctgccgcggcgcgtacgcgacgcccgcggcgtgccgcggcagcgtgtactcgcggctgttcaaggacgcgtgcccggcctactacagctacgcgtacgacaccaccgccgcgacggcgagcgggtgccgcgcccgggagtacgtcatcaccttctgccccggcaggtggggcggcgagcccgacggcgccgccgccgccgcccagatctgatgccgagcatctctgtcgccaaccgacctttatgcacacaccctatgtgcatgtttctcactcccatgtactatgtactactacaaatatattatatataactataataaaagtgaaatgaaaaatcaaaatttgagat

SEQ ID NO: 13766 - protein, 284 aa, Panicum virgatum
  misc_feature: Ceres CLONE 1770415
  misc_feature (46)..(268): Pfam Name: Thaumatin Pfam Description: Thaumatin family
MAEHCSRWRTSGARRPRLSCALVAFLSFVAAGPFVLAEGIVFHVANRCPFPVWPASAPNTGHPVLAGGGFLVPPGKSRRVVAPATWNGRFWARTGCNFTANGAAAACLTGDCEGRLACNGSVGAPPATLVEVSMDADPGKGSSYDVSLVDGYNLPVSVSATGAADPSRCAIAGCARDVNAACPPELQVTAGSGGAKAAVVACKSACLAFGLDVFCCRGAYATPAACRGSVYSRLFKDACPAYYSYAYDTTAATASGCRAREYVITFCPGRWGGEPDGAAAAAQI

SEQ ID NO: 13767 - DNA, 776 bp, Panicum virgatum
  misc_feature: Ceres CLONE 1770416
  misc_feature: Encodes the peptide sequence at SEQ ID NO. 13768
attctgaccagaggtccaaggcggagtaaccgttaacgatggcttccgccaagctcgcagaggccgtcgagcctaggaagaagagcaacgtcaagtatgcctccttctgcgccatcctcgcctccacggcctccatcatcctcggctatgacattggggtgatgagcggagcggggatctacatcaagaaggacctcaagatcacggacgtgcagctggagatactgatgggcattctgaacgtctactcgctcatcgggtccttcgccgccggccggacgtcggactggatcggccgccgctccaccgtggtcttcgccgccgccatcttcttcgtgggcgcgctgctcatgggcttcgccgtcaactacgccatgctcatggcgggacggttcgtggccggcgtcggggtgggctacgcgatcatgatcgcgcccgtgttcaccgccgagatcgcgccggcggccgcccgcggtttcctcacgtcgttccccgaggtgttcatcaacatcggcatcctgctcggctacgtgtccaactacgcgttcgcgcgccttcccctccacctcggctggcgcgtcatgctcggcatcggcgccgtgccgtccgccctgctgtccctcatggtgttcggcatgcccgagtcgccccggtggctcgtcatgaagggccgcctcgcggacgccagggccgtcctggagaagacctgcgacacgccggaggaggcggcggagcgcctcgccgacatcaaggcggcggcgggcatccccaacgac

SEQ ID NO: 13768 - protein, 245 aa, Panicum virgatum
  misc_feature: Ceres CLONE 1770416
  misc_feature (24)..(245): Pfam Name: Sugar_tr Pfam Description: Sugar (and other) transporter
MASAKLAEAVEPRKKSNVKYASFCAILASTASIILGYDIGVMSGAGIYIKKDLKITDVQLEILMGILNVYSLIGSFAAGRTSDWIGRRSTVVFAAAIFFVGALLMGFAVNYAMLMAGRFVAGVGVGYAIMIAPVFTAEIAPAAARGFLTSFPEVFINIGILLGYVSNYAFARLPLHLGWRVMLGIGAVPSALLSLMVFGMPESPRWLVMKGRLADARAVLEKTCDTPEEAAERLADIKAAAGIPN

SEQ ID NO: 13769 - DNA, 790 bp, Panicum virgatum
  misc_feature: Ceres CLONE 1770475
  misc_feature: Encodes the peptide sequence at SEQ ID NO. 13770
agcagcgaagcaagcgccatggggaagaagcggcagctgatctgcctcgccgccgccgtcgccgccgcggccatcctcctgacaggcaccgaaggattctccgtctacgatctcgaccgtcttgtctgaaccgttcgccgcactgagatttgttcattttcgtctgcccgcctttgacgtgatttgcttgcgattttgtccccagcgtcggcaaagaagtccggcgatgtcaccgagcttcagatcggcgtcaagcacaagccagagtcatgcaccctgcaagcacacaaaggtgataaaattaaggtccattatcgtgggacactcactgatggatcagtatttgattctagctatgacagaggtgacccgtttgaatttactcttggaaatggccaagtgataaaaggttgggaccaaggattactaggtatgtgcgtcggtgaaaagcggaagctaaagatacctgcaaagatggattatggtgagcggggctccctaccgaagattccgggtggagcaactctgatcttcgacacggagcttatcgccgtcaatggaaagacatctggtgatgcaaatgcagaaagcaatagcgagctttaacacattgaagagtttcaacttgagcgtgtagcagcttcactaatagtggctcgcgtgagttcactagatgaaagggttgttgtgttatgatttagatgttacaaagacaaatctggttaagctctatgatctatgtaagcgactgttcatatgctgtggaaacttttttcgcttggttggatgg

SEQ ID NO: 13770 - protein, 57 aa, Panicum virgatum
  misc_feature: Ceres CLONE 1770475
  misc_feature: SWISSPROT Homolog: EC 5.2.1.8 Peptidylprolyl isomerase
MCVGEKRKLKIPAKMDYGERGSLPKIPGGATLIFDTELIAVNGKTSGDANAESNSEL

SEQ ID NO: 13771 - DNA, 756 bp, Panicum virgatum
  misc_feature: Ceres CLONE 1770486
  misc_feature: Encodes the peptide sequence at SEQ ID NO. 13772
acttttcgcctttccgcactcgcccttggacgtcgccttcttcgagttcccccagcctccaaatccccgccgagaaggaagccaggagcagcaagtccccgagaagaggagagatggcccgtacgaagcagaccgcccgcaagtccaccggagggaaggccccccgcaagcagctcgccaccaaggcggcgaggaagtcggcgccgacgaccggcggcgtgaagaagccccaccgctacaggcccgggaccgtggcgctccgcgagatccgcaagtaccagaagagcacggagctcctgatccgcaagctccccttcctttttctggtccgcgagatcgcgcaggacttcaagacggacctccggttccagagccacgccgtgctggcgctccaggaggccgccgaggcctacctcgtcgggctcttcgaggacaccaacctctgcgccatccacgccaagcgcgtcaccatcatgcccaaggacatccagctcgcccgccgcatccgcggcgagcgcgcctaagccgccgctgccgccgccgtaccagtaggggagagggaggaggtcaagatggaatcggcttgttgatctgcgccccgccgcgcgtagtggatcttgctagtagttgtcggtctcggtttggttagtgtaaaaacaggtttacaagtcttactttgtgatccgctcctattatggcttcgcttcgagatgaagccagcttgttaaagacttaattcgtgatgttactagcagc

SEQ ID NO: 13772 - protein, 136 aa, Panicum virgatum
  misc_feature: Ceres CLONE 1770486
  misc_feature (58)..(132): Pfam Name: Histone Pfam Description: Core histone H2A/H2B/H3/H4
MARTKQTARKSTGGKAPRKQLATKAARKSAPTTGGVKKPHRYRPGTVALREIRKYQKSTELLIRKLPFLFLVREIAQDFKTDLRFQSHAVLALQEAAEAYLVGLFEDTNLCAIHAKRVTIMPKDIQLARRIRGERA

SEQ ID NO: 13773 - DNA, 420 bp, Panicum virgatum
  misc_feature: Ceres CLONE 1770490
  misc_feature: Encodes the peptide sequence at SEQ ID NO. 13774
cacaacccagacaatcatctggaactggcccatgggtgtttttgaattcgacaagttcgctgttggaactgaggctgttgcgaagaagttggcagaacttagcggcaagggtgtcacaaccatcattggaggtggagactccgttgcagccgttgagaaggtgggagttgctgatgttatgagccacatttcaacgggaggtggtgccagcttggaattgttggaaggaaaggagcttcctggagttgttgcgttggatgaagccaccactgtgactgtatgaagctaagttctcaatttgtttcaccttcatcttcgtgtaccgtgtaaacttgctacattcttgctcgctccttgtcagccgctcgaaatgtaagagatcaatgctttatagagctactggaaattgtttgaataact

SEQ ID NO: 13774 - protein, 93 aa, Panicum virgatum
  misc_feature: Ceres CLONE 1770490
  misc_feature: SWISSPROT Homolog: EC 2.7.2.3 Phosphoglycerate kinase
TTQTIIWNWPMGVFEFDKFAVGTEAVAKKLAELSGKGVTTIIGGGDSVAAVEKVGVADVMSHISTGGGASLELLEGKELPGVVALDEATTVTV

SEQ ID NO: 13775 - DNA, 650 bp, Panicum virgatum
  misc_feature: Ceres CLONE 1770496
  misc_feature: Encodes the peptide sequence at SEQ ID NO. 13776
atccaccaccgctcgatcggccgaacaatctccccggacacgcgcgcagatcttctccgagggtgggctggactacctgggcaaccccaacctggtgcacgcgcagagcatcctagccatctgggcttgccaggtggtgctcatgggcttcgtcgagggctaccgcgtcggcggcgggccgctcggggaggggctcgacaaggtgtacccgggcggcgccttcgacccgctggggctcgccgacgacccggacaccgccgcggagctcaaggtgaaggagctcaagaacggccgcctcgccatgttctccatgttcggattcttcgtgcaggccatcgtcaccggcaagggccccatcgagaacctcttcgaccacgtcgccgaccccgtcgccaacaacgcctgggcctacgccaccaacttcgtcccgggcaactgatcaatctgctctgcttgtaggcgtgtagtagttgcacgcgccggcgtatgctccgtgtgctctcgtcagattcagattcagatcatcagcagctgcgtctgcctgcacgtgatgtaaacttgtaaactacgcacggagatgcatgtgtaagatcaatggtgtacgtgtaccataccattcatgagtggatcttcttgtcactcatccatcg

SEQ ID NO: 13776 - protein, 145 aa, Panicum virgatum
  misc_feature: Ceres CLONE 1770496
  misc_feature (3)..(112): Pfam Name: Chloroa_b-bind Pfam Description: Chlorophyll A-B binding protein
STTARSAEQSPRTRAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 13777 - DNA, 746 bp, Panicum virgatum
  misc_feature: Ceres CLONE 1770500
  misc_feature: Encodes the peptide sequence at SEQ ID NO. 13778
attttcattccgctttgagcttttgcttgcagctccagcaccaagcgcaggcccctcttgcattggtggctatctacgccatggccaccgtcctgagctgcagcctccgcgcgccggccagcttcatccccggcctccgcgccgccccggctcccgccgtcgtcgccatgcccgccgccaaggttgcccgcggcgccaggctgcgcgcgcaggcgacctacaacgtgaagctgatcacgcccgacggcgaggtggagctgcaggtgcccgacgacgtgtacatcctggaccaggccgaggaggaggggatcgacctgccctactcgtgccgcgcggggtcctgctcctcctgcgccggcaaggtcgtctccggcagcgtcgaccagtccgaccagagcttcctggaagacgaccaggtcgccggcggctgggtgctcacctgcgccgcgtaccccacctccgacgtcgtcatcgagacccacaaggaggaggagctcacctcctcctcgtaatgcttgcattattgcttatcatcgatctccgctgattacatttaatttcttggttacgtaagtgtcgtgctactatgcttaattggtttgcagttgagctataatgcatgctgtggaaatttatatttattttgcaataatatagctattttatttatttttgttgttgaagtaataaatcatatcatgtacgtatgggacacctaggtagctactctacatatagtgcgtggc

SEQ ID NO: 13778 - protein, 143 aa, Panicum virgatum
  misc_feature: Ceres CLONE 1770500
  misc_feature (52)..(127): Pfam Name: Fer2 Pfam Description: 2Fe-2S iron-sulfur cluster binding domain
MATVLSCSLRAPASFIPGLRAAPAPAVVAMPAAKVARGARLRAQATYNVKLITPDGEVELQVPDDVYILDQAEEEGIDLPYSCRAGSCSSCAGKVVSGSVDQSDQSFLEDDQVAGGWVLTCAAYPTSDVVIETHKEEELTSSS

SEQ ID NO: 13779 - DNA, 903 bp, Panicum virgatum
  misc_feature: Ceres CLONE 1770543
  misc_feature: Encodes the peptide sequence at SEQ ID NO. 13780
gattattgcccgctaatgcttccacgtgagcgaatcacgtggaaggccgagcatgaggagacctttgctcccgcattattgacatcatccattttcctacactgataagcccaagtatcagtatagccagctttcccttctcccccaactccggcggcggcgcggaaggcttccggtcggtctccgcctctcttttggcgccaaatccatccgcccctccgattccgggccttccaggtgccaacagttgagaatggcactgaagcgcctgaggagatgctgctgttgcagtgcaaagcacactgatggcgaggacaagattgattatgggggtggcaatgttcatgtcattacaagcaaagaaaactgggaccaaaaaattgaagaggcaaacaaggatgggaaaattgtggttgcgaatttcagtgcttcctggtgtgggccgtgccgagtcatctcaactgtttatgctgagatgtcgcagacgtacccacagctcatgttcttggcagtcgatgtcgacgagttaatggagttcagctcgtcgtgggacatccgggcgacaccgacgttcttcttcctgaagaacgggcagcaggtggacaagctggtcggcgccaacaagcccgagcttgagaagaaagtcgccgcggtcgccggtggcagcgtggcacctgacgccaagtgacaggacgacggtgtgggctgatatcatatcaacattcatcgaccagcccgtgcaaaactcgttctacccgtgcatgagcttgtttttcaccccgttgtgtagccgcattgatctgtgtgatagcttccccgatgtgtagactgtacagctccttcttggtgatgacgtaagcatgtaagtattggtttctgtggtagtaagttcattgtgttgct

SEQ ID NO: 13780 - protein, 144 aa, Panicum virgatum
  misc_feature: Ceres CLONE 1770543
  misc_feature (30)..(134): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MALKRLRRCCCCSAKHTDGEDKIDYGGGNVHVITSKENWDQKIEEANKDGKIVVANFSASWCGPCRVISTVYAEMSQTYPQLMFLAVDVDELMEFSSSWDIRATPTFFFLKNGQQVDKLVGANKPELEKKVAAVAGGSVAPDAK

SEQ ID NO: 13781 - DNA, 493 bp, Panicum virgatum
  misc_feature: Ceres CLONE 1770549
  misc_feature: Encodes the peptide sequence at SEQ ID NO. 13782
acgccgcagcagcagctcgcgttcgcaatccaatccgccggccaccggcggcgtgaagaggccgcaccgcttccgccccggcaccgtcgcgctccgcgagatccgcaagtaccagaagagcacggagctgctcatccggaagctccccttccagcggctggtgcgggagatcgcgcaggacttcaagacggacctccggttccagtcctccgccgtcgccgcgctgcaggaggccgcggaggcgtacctggtggggctcttcgaggacaccaacctgtgcgccatccacgccaagcgcgtcaccatcatgcccaaggacatccagctcgcgcgccgcatcaggggcgagagggcctgagcgccgagcctctgctgctgcactgtcgtcgtagcgctagaattagatgggggatttgtttcttgccgtgctatcttgtagtcagattctggtcgggttggacttgctgcaatggaacgtgattgctagtttctc

SEQ ID NO: 13782 - protein, 118 aa, Panicum virgatum
  misc_feature: Ceres CLONE 1770549
  misc_feature (40)..(114): Pfam Name: Histone Pfam Description: Core histone H2A/H2B/H3/H4
RRSSSSRSQSNPPATGGVKRPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 13783 - DNA, 575 bp, Panicum virgatum
  misc_feature: Ceres CLONE 1770615
  misc_feature: Encodes the peptide sequence at SEQ ID NO. 13784
tggtggacaaagacctgggtagcaactacgatagggtcgagctggaggaaatggttcaggtggctttgctatgcacacaatactacccatctcaccgccctcggatgtccgaggtaatcaggatgcttgaaggggacgggctcgcagagaaatgggaagcatcacagaacgtggacacacctaagtccgtctcatcggagctcttgcctccaaagtacatggactttgccgcggacgaatcctcgctgggcctagaagcaatggagctctccggaccaaggtgacccgactgaccggccggatcaagtcatagcatagatgcatagatgcttgccatatgaagcctattgctgtattacattcaatttgtttaggtgtagagccgagggaaggcgaaaaattttccagtcgatgtagggtgtgtgatctgttctgtggtctgtctatagctgtgctggcattcatttgtacatacagcagcattgtgcgaggtgagcccatccttgttgcgcatctgcttggtggcaaagagatgagatgaatgagtatatatagaaatgaaattttcccagtgc

SEQ ID NO: 13784 - protein, 93 aa, Panicum virgatum
  misc_feature: Ceres CLONE 1770615
  misc_feature: SWISSPROT Homolog: EC 2.7.11.1 Non-specific serine/threonine protein kinase
  misc_feature: Useful for making plants with modulated nitrogen use efficiency
VDKDLGSNYDRVELEEMVQVALLCTQYYPSHRPRMSEVIRMLEGDGLAEKWEASQNVDTPKSVSSELLPPKYMDFAADESSLGLEAMELSGPR

SEQ ID NO: 13785 - DNA, 747 bp, Panicum virgatum
  misc_feature: Ceres CLONE 1770618
  misc_feature: Encodes the peptide sequence at SEQ ID NO. 13786
acaaacaagtcctcccaccgcacgcaaccacggcagagagagtccacgagtccgccatggcgagcaagcagagcctcctcgtcctcgccgccgtcgccgcctgcctcctcctcctccccgccgcctcggtcgccaccgacgtcgactactgcagtaggggcaagaagtacccggtgaaggtgagcggggtagagatcgtgcccgatccggtccagcccggcaagccggccaccttcaagatctccgcttccactgataaaaccatccagaaggggaagctggtaattaatgttaagtatttcttcttctacgtgcactcggaaactcgcgacatctgcggagagactacctgtccagcaactggtagcttcatgctctctcatgagcagacactaccaagcttcactccaccgggttcttacaccatcaccatgaagatagttggggacgacaatgaggaactgagctgcatctcgttcgggttcagcatcgggttccttgcctccagctgaacggatgcatcttctatgagcaccggaagtttgccatggatgtaattatgaaccacactgtatcctacgactcccggtagtgttgaggtgcacgcgttgtgggtgtctgaggtgcacggattgcgggtgtcgcgaaacttactgctcaactaagacgttttttttatccagtgtcgaacaccacaataaagcaaaaatctggttatcatgaaacgagatgcgttgttacttggtt

SEQ ID NO: 13786 - protein, 151 aa, Panicum virgatum
  misc_feature: Ceres CLONE 1770618
  misc_feature (25)..(145): Pfam Name: E1_DerP2_DerF2 Pfam Description: ML domain
MASKQSLLVLAAVAACLLLLPAASVATDVDYCSRGKKYPVKVSGVEIVPDPVQPGKPATFKISASTDKTIQKGKLVINVKYFFFYVHSETRDICGETTCPATGSFMLSHEQTLPSFTPPGSYTITMKIVGDDNEELSCISFGFSIGFLASS

SEQ ID NO: 13787 - DNA, 913 bp, Panicum virgatum
  misc_feature: Ceres CLONE 1770627
  misc_feature: Encodes the peptide sequence at SEQ ID NO. 13788
ggtggtgattattccccatccacgcttggcttcccaccctataaagcgctcctcgatccagacctttgccaaaaataacaaggcgcaggggcaacctcgattcgacgtgcgcttcctcctcgctcgcggagatgtctgacgttgaggagtaccgttgcttcatcgggaacctgtcatggtcgacaactgatgagagcctcaaggatgcattcggcaaatttggaaacctcactgaggcaaaggtggttcttgacaaattttctggccgctctcgtggtttcggctttgtaacatttgatgagaagaaagctatggaagatgctattgaaggaatgaatgggctggacttggacgggaggaacattactgtcgataaagctcagccacaagggcttggtagagatcgtaatggtgaccgtgattatgaccgtggatctcgttatgaccgtggccgtgactatggtggtggtggtggtggtggacgtgcaccacgtggcggcggcggcggcggcggggactgcttcaagtgtggaaaacctggtcattttgctagggagtgcccatctggggatggtgggagaggggatagatatggtggcagagatgacaggtatggcggcggcggcagtcgttatggatctgaccgtggtggtggtggtggtgaccgatactctggccgtagccgagatggtggcagctacgggggcgaccgctacaaccgtgaccggtctggtccctactgatggcctagatcttgagcagtatgtgccatccaggtatgaaatctatctgctattataaaggtttgttatcgtgtgtctggaactttgtgatcctgtagctggagaactatgatgtaccgtgagaagatcatgctttgttatagaccgtattactgactggtttgttatcg

SEQ ID NO: 13788 - protein, 203 aa, Panicum virgatum
  misc_feature: Ceres CLONE 1770627
  misc_feature (9)..(80): Pfam Name: RRM_1 Pfam Description: RNA recognition motif. (a.k.a. RRM, RBD, or RNP domain)
  misc_feature (128)..(145): Pfam Name: zf-CCHC Pfam Description: Zinc knuckle
  misc_feature: SWISSPROT Homolog: EC 5.2.1.8 Peptidylprolyl isomerase
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: Useful for making plants with altered lignin content
  misc_feature: Useful for making plants with modulated biomass
  misc_feature: Useful for making plants with modulated nitrogen use efficiency
  misc_feature: Useful for making plants with modulated flowering time
MSDVEEYRCFIGNLSWSTTDESLKDAFGKFGNLTEAKVVLDKFSGRSRGFGFVTFDEKKAMEDAIEGMNGLDLDGRNITVDKAQPQGLGRDRNGDRDYDRGSRYDRGRDYGGGGGGGRAPRGGGGGGGDCFKCGKPGHFARECPSGDGGRGDRYGGRDDRYGGGGSRYGSDRGGGGGDRYSGRSRDGGSYGGDRYNRDRSGPY

SEQ ID NO: 13789 - DNA, 865 bp, Panicum virgatum
  misc_feature: Ceres CLONE 1770631
  misc_feature: Encodes the peptide sequence at SEQ ID NO. 13790
aaaactccaggctcctttccgcacactccaccaccttcgcgggcgccgccgtcgcacgcagccgtatccgccatgggggcgtacaagtacgtgtcggagctatggaggaggaagcagtcggacgtgatgcggttcgtgcagcgcgtgcgctgctgggagtacaggcagcagccagccatcgtccgcctcaccaggcccacccgccccgacaaggcccgccgcctcggcttcaaggccaagcagggctatgttgtttaccgtgtccgtgtcagacgtggtggtaggaagaggcctgtgcctaagggtattgtctatggcaagcccaagcaccagggtatcacccagcttaagttccagaggaacaagaggtctgttgctgaggagagggctggacgtaagcttggtggactcagggttctcaactcctactgggtcaatgaggatagcacttacaagtactttgagatcatcctggttgatgtggcccacactgccattcgcaatgacccaaggatcaactggctatgcaaggatgtgcacaagcaccgcgagctccgtggtctcacctctgcaggcaagaagtaccgtggtctgcgaggcaagggccacacacaccacaagaacaggccctcgaggagggccacctggaagcgcaaccaaaccctctccctccgccgctaccgctgagctcatatgtcttgatgctctcctgctgtggagcccgccccacccagactttgatagtatttggtacctttattgcattgtcaaattttgctgcttgtgttcccagcctgatgaactttgttagcagtgtgtactgtggagccaatgctgttaactatgtttgcgattcacctgtgtt

SEQ ID NO: 13790 - protein, 204 aa, Panicum virgatum
  misc_feature: Ceres CLONE 1770631
  misc_feature (2)..(193): Pfam Name: Ribosomal_L15e Pfam Description: Ribosomal L15
MGAYKYVSELWRRKQSDVMRFVQRVRCWEYRQQPAIVRLTRPTRPDKARRLGFKAKQGYVVYRVRVRRGGRKRPVPKGIVYGKPKHQGITQLKFQRNKRSVAEERAGRKLGGLRVLNSYWVNEDSTYKYFEIILVDVAHTAIRNDPRINWLCKDVHKHRELRGLTSAGKKYRGLRGKGHTHHKNRPSRRATWKRNQTLSLRRYR

SEQ ID NO: 13791 - DNA, 693 bp, Panicum virgatum
  misc_feature: Ceres CLONE 1770641
  misc_feature: Encodes the peptide sequence at SEQ ID NO. 13792
gattcccctcgcctcctcccaacccgctcactcccgtccccatctgccgcgatggcctcaagcctcgccgtcgccgtctccgtctccgtcgccgccgccgccccgccccgcgtcgccctccgccgcggcctcccgccgatgtgccgcgcgctccgcgcccgcccgcgctcccgcggcccggccgtcgtgtgccaggcccagggcggccaggacaccgccatccaagttcctgatgtgagcaaatctacatggcaatcgcttgtggtggagagcgagctgccagtcctcgtagagttctgggcctcatggtgcggaccgtgcaaaatgatagaccccatcgtcggcaagctctcaaaggagtacgaagggaagctgaaatgctacaagctgaacaccgacgagaaccctgacatcgcgacccagtttggcatccggagcatccccacaatgatgatattcaagaacggcgagaagaaggatgctgtaattggggccgtgcccgagagcaccctgatcacgtgcatcgagaagtatgttgacgggaggtgaaatcgaactcaatctgagccgcttagccttggactacaatatgtagatggatgggtatgtatgggtataccgttgtcactgaactgctactgaagtagctataagtagataataatgtaagataacatggaataaatgcgattc

SEQ ID NO: 13792 - protein, 165 aa, Panicum virgatum
  misc_feature: Ceres CLONE 1770641
  misc_feature (58)..(161): Pfam Name: Thioredoxin Pfam Description: Thioredoxin
  misc_feature: SWISSPROT Homolog: EC 1.8.1.8 Protein-disulfide reductase
  misc_feature: Useful for making plants with modulated heat sensitivity
MASSLAVAVSVSVAAAAPPRVALRRGLPPMCRALRARPRSRGPAVVCQAQGGQDTAIQVPDVSKSTWQSLVVESELPVLVEFWASWCGPCKMIDPIVGKLSKEYEGKLKCYKLNTDENPDIATQFGIRSIPTMMIFKNGEKKDAVIGAVPESTLITCIEKYVDGR

SEQ ID NO: 13793 - DNA, 624 bp, Panicum virgatum
  misc_feature: Ceres CLONE 1770684
  misc_feature: Encodes the peptide sequence at SEQ ID NO. 13794
agcggagctgttcacactaaagatatcaaggtcaaataagaacacaagtcaacatgtcgaaggggttcttaacttgattgatttagctgggagcgagcgtcttgctaaaagtagttccacaggtgatcgcttgaaggaaactcagtcaatcaataaaagcttgtcagctctaagtgatgtaatctttgcgattgcaaaaggagatgaccatgttcccttcagaaattcaaaacttacatacctattgcagccttgccttggaggggactcgaaagctctcatgtttgtcaatatttcacctgaggcatcatctgttggggagacaatatgctcattgaggtttgcttcaagggtgaatgcttgtgagattgggataccaagacgtcggacaagcacgtccatttgattgtaggctgagttatgggtaaagtcgttgtagccatcattgtaatgtgatgtatgatgagctggtttatgccacatttggccacaaagttgaaactcaacataaatcttggtaacttgtacagtgtaggtagtggcaatatgctgagagcagcatatgttttgagtaccgaaaccttctcacgcttttcgtttggtatatatatagtagatttcagt

SEQ ID NO: 13794 - protein, 134 aa, Panicum virgatum
  misc_feature: Ceres CLONE 1770684
  misc_feature (1)..(122): Pfam Name: Kinesin Pfam Description: Kinesin motor domain
AELFTLKISRSNKNTSQHVEGVLNLIDLAGSERLAKSSSTGDRLKETQSINKSLSALSDVIFAIAKGDDHVPFRNSKLTYLLQPCLGGDSKALMFVNISPEASSVGETICSLRFASRVNACEIGIPRRRTSTSI

SEQ ID NO: 13795 - DNA, 755 bp, Panicum virgatum
  misc_feature: Ceres CLONE 1770708
  misc_feature: Encodes the peptide sequence at SEQ ID NO. 13796
agaccccacacaacaaccgcatccgtccgtccaggtccagtgtgtccactcatcgcgtgagaaagaagagagcggtagtgcgcgcccgcgagacagagatggcaactccggcgacggaggcggcgacaccggaggcaccggctgaggagtcggtgatcgcgatccacagcctggacgagtggagcacctatatcgagagcgccaacagcgccaagaagctggtggtgatcgacttcaccgcatcttggtgtgggccatgccgcattatggctccaatttttgctgatttggccaagaagcatccaaatgctgttttcctaaaggttgatgttgatgaactgaaggccattactgagcaattcagtgtcgaggcgatgccgaccttcctgttcatgaaggaaggtgacgtcaaggacagggttgttggcgcaatgaaggacgaactggtccagaagcttgcgttccacatgacccatgtagaccagtaatgctatagtgaagtagtattcgcctaaataagaagcagcatcaactcagagagaactagtgcctctacgatggtacttcgtatgtagtattaactatcctactctgctgcccagtttctggataacgataagatcaggccttgcttgttccaagattgtgctttgcatatcatgtttccagcttcctctttgagctgagatgctataatggtgaatcagatatcttggaaaatatttgactatcatagtcatctagtttttaaggtc

SEQ ID NO: 13796 - protein, 129 aa, Panicum virgatum
  misc_feature: Ceres CLONE 1770708
  misc_feature (19)..(123): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MATPATEAATPEAPAEESVIAIHSLDEWSTYIESANSAKKLVVIDFTASWCGPCRIMAPIFADLAKKHPNAVFLKVDVDELKAITEQFSVEAMPTFLFMKEGDVKDRVVGAMKDELVQKLAFHMTHVDQ

SEQ ID NO: 13797 - DNA, 888 bp, Panicum virgatum
  misc_feature: Ceres CLONE 1770736
  misc_feature: Encodes the peptide sequence at SEQ ID NO. 13798
gatctccttccaccctcttccctacccttcttcttcccatctcgcgctgctcgaggaagtggacggcgggaggacgcgagggggtgagggagcggggcggcgacgatggtggacgtctcgcgcgtgcagaaggagctcaccgagtgcaaccgcgaccgggaggtctcgggcgtctccatcgcgctgcacgacggcgctaacatctcccacctcaccggcaccatcgccgggcccgccgacagcccctacgagggcggcaccttcgtcatcgacatccgcctccccggtggatatccctttgaacctccaaagatgcagttcgtcactaaagtatggcatcctaacatcagcagccaaaatggagcaatttgcttggacattctgaaagatcagtggagcccagctcttactttgaagactgcgttgctttcccttcaagctctgctttcttctcctgcacctgatgatcctcaggatgctgtcgttgcacaacagtacctgcgtgattatccaacattcgctgctacagctcgctactggacagaggccttcgcaaagagcacgtccactggcatggaagagaaggtgcagaagctggttgagatgggcttcccagaggatctggtgagaagtaccctgaatagtgtcgatggtgatgagaacatggctctcgaaaagctctgctctggctgaaccacccttatggtggatatatgaactgtaaattgcatccccattggttattatattatataagataagagaacaatgcctgctaattcccctgctctgccatttcagtgtggccatttatcgagacaatatatataggggattggaccatgggactcgtgaaaaccgcctttatgataacttcagagttcgttc

SEQ ID NO: 13798 - protein, 195 aa, Panicum virgatum
  misc_feature: Ceres CLONE 1770736
  misc_feature (6)..(146): Pfam Name: UQ_con Pfam Description: Ubiquitin-conjugating enzyme
  misc_feature (156)..(192): Pfam Name: UBA Pfam Description: UBA/TS-N domain
  misc_feature: SWISSPROT Homolog: EC 6.3.2.19 Ubiquitin--protein ligase
MVDVSRVQKELTECNRDREVSGVSIALHDGANISHLTGTIAGPADSPYEGGTFVIDIRLPGGYPFEPPKMQFVTKVWHPNISSQNGAICLDILKDQWSPALTLKTALLSLQALLSSPAPDDPQDAVVAQQYLRDYPTFAATARYWTEAFAKSTSTGMEEKVQKLVEMGFPEDLVRSTLNSVDGDENMALEKLCSG

SEQ ID NO: 13799 - DNA, 817 bp, Panicum virgatum
  misc_feature: Ceres CLONE 1770737
  misc_feature: Encodes the peptide sequence at SEQ ID NO. 13800
gactcgggcagacaaatcctatcctcctccacctagtcaccacagtcgtctctccctgcgccgcgtgagctgccaacgatggcccttgagacgtgcttcagagcgtgggcgctgcacgccgcccctgccggcggcaaggacaggctcgccgtcggcggcggcggcagcagcagcagcagcagcagcttcgcgccgtccaagcgggccgccgccgccgccgcgccgctgtccgtcggccgcgtcgccacgcggcggccccggcacgtctgccagtccaagaacgccgtcgacgaagtgctggtggcggatgagaagaactgggacgggatggtgatggcgtgcgagacgccagtgctggtggagttctgggcgccgtggtgcgggccctgccggatgatcgcgccggtgatcgacgagctggccaaggactacgccggcaagatcaagtgctgcaaggtgaacacggacgactgccccaacgtcgcctccacctacggcatccgcagcatccccaccgtgctcatcttcaaggccggcgagaagaaggagagcgtcatcggcgccgtgcccaagaccacgctcaccaccatcatcgacaagtacatcggcagctcgtgatcgagccaactggggttgatgggtgatgttgttgttggggatgaactaaatacatacgtgtccgtgctcacgcatacacaccatgcatctcttgttgcgtaaggatgatgcgataactcaggcagccgtctgctcctgctcccttatactatgtcgaatccaactccattaattagtttccagtgcatgatttcacagt

SEQ ID NO: 13800 - protein, 179 aa, Panicum virgatum; identical to SEQ ID NO: 13067
  misc_feature: Ceres CLONE 1770737
  misc_feature (72)..(175): Pfam Name: Thioredoxin Pfam Description: Thioredoxin
  misc_feature: SWISSPROT Homolog: EC 1.8.1.8 Protein-disulfide reductase
  misc_feature: Useful for making plants with modulated heat sensitivity

SEQ ID NO: 13801 - DNA, 818 bp, Panicum virgatum
  misc_feature: Ceres CLONE 1770774
  misc_feature: Encodes the peptide sequence at SEQ ID NO. 13802
acttcgcgttgtgctcttgcgtttccgtgttgagacttgagagagagggagagaggagctgccgtgtggggccggagagtagcgaccgcgagcgagagaaggcgatggcggggatcgggccgatcaggcaggactgggagccggtggtggtgcggaagaaggcgcccaccgccgccgccaagaaggatgagaaggccgtcaacgccgcgcgtcgctccggcgccgagatcgataccatgaagaagtacaacgctgggacgaacaaggccgcgtccagcggcacatccttcaacaccaagcggctcgacgacgacactgagaatctagcccatgagcgcgtcccaagtgacctgaagaaaaacctcatgcaagcaaggctggataagaagatgacccaggcacagcttgctcagatgatcaatgagaagccacaggtgatccaggagtatgagtcgggcaaggcgatccctaaccagcagataattagcaagcttgagagggcactcggaacaaagctgcgtgggaagaaataactttcaaacttgtgccccgtagcagcatgaagctgaaggagacaaggcagtctgtctgcttattatctatgcttggttttcaatgtcatgcagactgtttctgtgtttggtacatgagtgaataacagtgtcgtggtggaccttgtaatgccttgctgcttttatgtgtcatatgatccctggtacgtaagagttacgctacgttgtgaactgatagcgtaacctgcgtggtgcatgatgcctcagctgcttgccggagtatatattgttatgttggatagaggc

SEQ ID NO: 13802 - protein, 142 aa, Panicum virgatum
  misc_feature: Ceres CLONE 1770774
  misc_feature (9)..(79): Pfam Name: MBF1 Pfam Description: Multiprotein bridging factor 1
  misc_feature (87)..(141): Pfam Name: HTH_3 Pfam Description: Helix-turn-helix
  misc_feature: The sequence is a functional homolog of SEQ ID NO 1 in US patent 7238857
  misc_feature: Useful for making plants with altered lignin content
  misc_feature: Useful for making plants with modulated heat sensitivity
MAGIGPIRQDWEPVVVRKKAPTAAAKKDEKAVNAARRSGAEIDTMKKYNAGTNKAASSGTSFNTKRLDDDTENLAHERVPSDLKKNLMQARLDKKMTQAQLAQMINEKPQVIQEYESGKAIPNQQIISKLERALGTKLRGKK

SEQ ID NO: 13803 - DNA, 944 bp, Panicum virgatum
  misc_feature: Ceres CLONE 1770818
  misc_feature: Encodes the peptide sequence at SEQ ID NO. 13804
aaatcccagtgacactgcaccaccaccaccccggctccagcgagatccagacccaaaacatcccagacctcgcccgcgccagcggcagccggccttctctgctcggaggggagcaatggctgccaacggaggcgggtaccgggccgaggacgactacgactacctcttcaaggtggtgctcatcggcgactccggcgtcggcaagtccaacctcctctcccgcttcaccaagaacgagttcagcctcgagtccaagtccaccatcggcgtcgagttcgccacccgcagcctccaggtcgacggcaaggtcatcaaggcccagatttgggacaccgccggccaggagaggtaccgtgctattacaagtgcctattaccgtggagctgtaggagcattacttgtctatgatgtcacccgccgtgctacattcgacaacgtcagccgttggctaagggagctcagagaccacactgatcaaagcatcgttatcatgctgattggcaacaaatctgatctccgccacttggtgaccgtctcaactgaggatgcgaaagagtttgcggaggctgagtccatgtacttcatggaaacgtctgcgctggacgccaccaatgtggacaacgcgttctcagaggtcctgacccagatataccagatcgtgagcaagaagacagtggaggcaccggaggatggcgcggctgccccgggcaaaggggagaaaataaacgtgaaggatgatgtgtccgcaatgaagagaggggggtgctgctcaaactaaggcgaatacaaatggtttgttcatttttcatgtaggtaaggtactgtcggcttgcaggataagaaatgtattggattctgtttctggtggtgttgccgaggcttagggtcaagaacaattcaaactatcgatttaaattatcaactatgaatttgtgattctgtcg

SEQ ID NO: 13804 - protein, 220 aa, Panicum virgatum
  misc_feature: Ceres CLONE 1770818
  misc_feature (19)..(180): Pfam Name: Ras Pfam Description: Ras family
  misc_feature (19)..(133): Pfam Name: Miro Pfam Description: Miro-like protein
  misc_feature: SWISSPROT Homolog: EC 2.7.11.1 Non-specific serine/threonine protein kinase
  misc_feature: Useful for making plants with altered lignin content
  misc_feature: Useful for making plants with altered terpenoid content
  misc_feature: Useful for making plants with altered alkaloid content
MAANGGGYRAEDDYDYLFKVVLIGDSGVGKSNLLSRFTKNEFSLESKSTIGVEFATRSLQVDGKVIKAQIWDTAGQERYRAITSAYYRGAVGALLVYDVTRRATFDNVSRWLRELRDHTDQSIVIMLIGNKSDLRHLVTVSTEDAKEFAEAESMYFMETSALDATNVDNAFSEVLTQIYQIVSKKTVEAPEDGAAAPGKGEKINVKDDVSAMKRGGCCSN

SEQ ID NO: 13805 - DNA, 974 bp, Panicum virgatum
  misc_feature: Ceres CLONE 1770906
  misc_feature: Encodes the peptide sequence at SEQ ID NO. 13806
aggggaggatcatcctcaatgcagccgggatctcctctcgacccagctccggccagttgaatccgcccggcgccacctccgcccggcgggccttgatcgacggcggtttgctgaggccgcggcgctccggcactgccatgagaggatgacccccgcgcaggatccgttctacatcgtcaaggacgagatccaggactcgattgacaaagtgcaagatactttccaccaatggaaaaagacccctgaaaatactggagagtatgtgcatctgaccaaagaactattaaccagctgcgaaagtatccaatggcaggtggatgaattggataaggcaatttcagttgctgagagagatccagcattctatggacttaacgaggtcgaaattgggagaagaagaagctggacaagcactgcacgtaaccaggtgctctctttaaggcggaatgttgaatctggaaggaaaaagattttgcttggacattcggccaacccctctgaatcgatcagatccaagaagcacatttcacaagacaatgacgaatttattgcttcagaatctgatcagcagatgctcctgataaagcgacaagatgaggagttggatgcgcttagtgctagtgtccagcgaattgaaggcgtaggtctcactatacatgatgagcttgtcgggcaggagaagcttttgggtgagctgaacctcgagatggaaactacttcaaatcggctagactttgtgcagaaaagagtggctatggtcatgaagaaggccagcttgaaggggcagatcatgatgattgcgttcctcgtgattcttttcattattcttttcgttttggtgtttttgacttgagatataggtgtgagctgggtgtaattctgtaccatatcgagttcagaacggtgctggatgagcaaaatttgagccatccatacaactatacaggtgaagacagtaagcacatgttgtttgt

SEQ ID NO: 13806 - protein, 235 aa, Panicum virgatum
  misc_feature: Ceres CLONE 1770906
  misc_feature (6)..(99): Pfam Name: Syntaxin-6_N Pfam Description: Syntaxin 6, N-terminal
  misc_feature (148)..(210): Pfam Name: SNARE Pfam Description: SNARE domain
MTPAQDPFYIVKDEIQDSIDKVQDTFHQWKKTPENTGEYVHLTKELLTSCESIQWQVDELDKAISVAERDPAFYGLNEVEIGRRRSWTSTARNQVLSLRRNVESGRKKILLGHSANPSESIRSKKHISQDNDEFIASESDQQMLLIKRQDEELDALSASVQRIEGVGLTIHDELVGQEKLLGELNLEMETTSNRLDFVQKRVAMVMKKASLKGQIMMIAFLVILFIILFVLVFLT

SEQ ID NO: 13807 - DNA, 675 bp, Panicum virgatum
  misc_feature: Ceres CLONE 1770915
  misc_feature: Encodes the peptide sequence at SEQ ID NO. 13808
cccccatttttcatcccctcaccccccgccgccgcaggaagcccggctcgctaatcgccatggcccggatcaaggtgccagagctgcgggcgaagaacaaggcggagctgcaggcacagctcaaggagttcaagtcggagctctccctcctccgcgttgccaaggtcaccggcggcgcccccaacaagctctccaagatcaaggtggtgcgcacctccatcgcgcgcgtgctcaccgtgatctcgcagaagcagaaggcggcgctgcgggaggcgtacaagaacaagaagctgctcccgctcgacctccgccccaagaagacccgcgccatccgcaggcgcctcaccaagcaccagctctctttgaagactgagagggagaagaagcgtgagaagtatttccccatgaggaagtatgctatcaaggcctagattagtgaaagtgaacatgtttaccccttgtcaagttttgcccagaagttaccagaatttgatgtatcgcacatctattgtcatctaagtacaatgtagctgatcaactgcgtgatgaaaaatgtgtactctttgcttggtgaaatatgctggccattgttagttttgcttccacttgatcctcgtcagctttgctgtagcttggtatttgaatctatgttttcaagattactcatttgggcct

SEQ ID NO: 13808 - protein, 123 aa, Panicum virgatum
  misc_feature: Ceres CLONE 1770915
  misc_feature (6)..(64): Pfam Name: Ribosomal_L29 Pfam Description: Ribosomal L29 protein
MARIKVPELRAKNKAELQAQLKEFKSELSLLRVAKVTGGAPNKLSKIKVVRTSIARVLTVISQKQKAALREAYKNKKLLPLDLRPKKTRAIRRRLTKHQLSLKTEREKKREKYFPMRKYAIKA

SEQ ID NO: 13809 - DNA, 459 bp, Panicum virgatum
  misc_feature: Ceres CLONE 1770946
  misc_feature: Encodes the peptide sequence at SEQ ID NO. 13810
aatattcacaggcattgaactcacgaaccggcagccagagccgaaagaagccatggcgctgtccctctccctcgcgcgcgccgcgcccctcgccgtctccgcgggcgccggggccaggaggatccccgccgccagcctccccttccctcccaagtccttcttcggagcgccgctggccgccaccgccgcctccgtcgcgtcgccgctcccgcgcaggccggctacctccacctcgctcgaggtcgtcgcggaggggaagaaggggtacaagatgaagacccacaaggcgccggcgaagcggttcagggtgacggggaggggcaagatcgtgcgccggcgcaccgggaagcactacctgctcggcaagaacaacaccaatcgcaagaagaggctctccaagatggtccaagtaaacaagagtgactaccacaatgtgacaagcgcactgccctacctcaa

SEQ ID NO: 13810 - protein, 135 aa, Panicum virgatum
  misc_feature: Ceres CLONE 1770946
  misc_feature (74)..(132): Pfam Name: Ribosomal_L35p Pfam Description: Ribosomal protein L35
MALSLSLARAAPLAVSAGAGARRIPAASLPFPPKSFFGAPLAATAASVASPLPRRPATSTSLEVVAEGKKGYKMKTHKAPAKRFRVTGRGKIVRRRTGKHYLLGKNNTNRKKRLSKMVQVNKSDYHNVTSALPYL

SEQ ID NO: 13811 - DNA, 713 bp, Panicum virgatum
  misc_feature: Ceres CLONE 1770960
  misc_feature: Encodes the peptide sequence at SEQ ID NO. 13812
cctccctccacagatcccgattcgatcagccgccatggcccgctcctcctcgcagtcccagtcctccgtcggcggcgccggcgccggagcccgcccggccaccgttggcccccgcggcacggcagcagctgccgccggcatgcgccgccgccgcgccaccgctagcgccgggggagcttctccggcggcggcgggagcaacatgcttcggttctacaccgacgaggccccgggcctgcgcctctcgccaaccatggtgctcgtcatgtcgctgtgcttcatcggattcgtcaccgccctccacgtcttcggcaagctctaccgctcccgcaccgccgcagcctccgcgtgacccatccccatcccatccctccggcgcgactatcatcagatcaaggttttcaatatatcatcatcagtctacttactcttgtcttgcctagctttccttcctgtgctagtgctagatctggagggagatgaatggaaccctacaacttgaagttagtgatgatgccctttctgttgccttattcttcccctttccttgttttagtgcctttttatttactcccagatgcaaatagttgtgcctagtcactgtaatcatggggattgctacaattaattttgcatctcggtaacttagcgtgtgctcgaggatttctacaatcctgcatcttgcttctaaatctattactcgcttaaccatcc

SEQ ID NO: 13812 - protein, 49 aa, Panicum virgatum
  misc_feature: Ceres CLONE 1770960
  misc_feature (1)..(40): Pfam Name: Sec61_beta Pfam Description: Sec61beta family
MLRFYTDEAPGLRLSPTMVLVMSLCFIGFVTALHVFGKLYRSRTAAASA

SEQ ID NO: 13813 - DNA, 543 bp, Panicum virgatum
  misc_feature: Ceres CLONE 1770971
  misc_feature: Encodes the peptide sequence at SEQ ID NO. 13814
ggcggcaccggccagggcccagggcctctcgacccgcggccgccgcgcgaccaccaacgccggcgacggcggcaccggcaagaagaacaagaccgacaagcccgacgggagcggaggcggccccaccgacgaccacgacgccaccgggaggaaggccaagggcaagggcgcgcaccagcccgacgacaaggacggcgccaacgccgacggacacagcccaaacgacaaagaggaggacagggcacccaccggcgacttttttgtcggtggaaccactggacttctgatctgggccgtcaccctcgccgggctccttggcggcggcgccctccttgtttacaacaccagcgccctcgccagctaagaacactattcatgcatagtccatgcaagcgcttgtggttcatgtaagatcagctcgggtgtctgtcgtctgtaatctagcctgcagctttgatgcgcaatataatgcttggttcatgtaacaatgctactacggccctccatacttttgggacagttattatattaactaggtagaaa

SEQ ID NO: 13814 - protein, 120 aa, Panicum virgatum
  misc_feature: Ceres CLONE 1770971
  misc_feature (24)..(120): Pfam Name: PsbR Pfam Description: Photosystem II 10 kDa polypeptide PsbR
AAPARAQGLSTRGRRATTNAGDGGTGKKNKTDKPDGSGGGPTDDHDATGRKAKGKGAHQPDDKDGANADGHSPNDKEEDRAPTGDFFVGGTTGLLIWAVTLAGLLGGGALLVYNTSALAS

SEQ ID NO: 13815 - DNA, 529 bp, Panicum virgatum
  misc_feature: Ceres CLONE 1770982
  misc_feature: Encodes the peptide sequence at SEQ ID NO. 13816
acccccccaccccctctggttcgaatcgtgcttcgagacccaaggaacgcgaaatagtatggcccgtaccaagaaaattgctaacgagaccggggtagggaccgctcacttcaaggactttgtcactcaggctgtctttgacccggcccctgccactggagaagtgaagaacccccttcgctacctccctgtcactgttgccctccgtgtgatccttgcctgcaacaagagggctgttgtgttgatcatgacgctgcccttgcgcagggttgtcaggaaaattgccctcgagttcgtgacggatctgcatttccagatccgtgctgtggttgtcctccttgatgctgctgaagcgtttgttgttgctctgtttgaggactccgctgtgcgcccccttcatgctaagactgtgactgttgtgcctgatgacatcctgctggatgttatgatccgtggcgagagggcttagtcatctgtctcatgacgatcggatgctgctgtcatagtcgtgatcttctgggacgccctg

SEQ ID NO: 13816 - protein, 136 aa, Panicum virgatum
  misc_feature: Ceres CLONE 1770982
  misc_feature (58)..(132): Pfam Name: Histone Pfam Description: Core histone H2A/H2B/H3/H4
MARTKKIANETGVGTAHFKDFVTQAVFDPAPATGEVKNPLRYLPVTVALRVILACNKRAVVLIMTLPLRRVVRKIALEFVTDLHFQIRAVVVLLDAAEAFVVALFEDSAVRPLHAKTVTVVPDDILLDVMIRGERA

SEQ ID NO: 13817 - DNA, 558 bp, Panicum virgatum
  misc_feature: Ceres CLONE 1770989
  misc_feature: Encodes the peptide sequence at SEQ ID NO. 13818
  misc_feature (47)..(47): n is a, c, t, g, unknown, or other
  misc_feature (51)..(51): n is a, c, t, g, unknown, or other
  misc_feature (54)..(54): n is a, c, t, g, unknown, or other
  misc_feature (57)..(57): n is a, c, t, g, unknown, or other
  misc_feature (62)..(62): n is a, c, t, g, unknown, or other
  misc_feature (79)..(79): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
agaaccaaggattgggttgccctcgccgaccttgaggaggggggagnaggnggnganggggngaaagaggggagggggnaaaagaggggannngggggggggatgctgctgctgatcgccggcgacgccggggcggccgccgaggagccggcggtggctgcggactcggcggccggcgcggaggaggccgcggctgctgctgcggcggcgaaggcagagggggcggcggaggcggcggcgctcagggcggagctggagcagctcagggcgaagatctccaacttagagtcaggcatagcagagcggtcccaggaattgaagaacaaggatgattttttttcaaagctggagaaagtgattgaggagagatcaaagaagattgcttctctgcaggccgagattgcttccctccaagcacagggatctattgctgctgaggagcaggcaggcaaggccaacgcccgggctattgagcttgagaagcaggtcgagaagctcaaaaaggatattgaaacacaaagtagccagagaacagcacttgagtctagggctaatgat

SEQ ID NO: 13818 - protein, 185 aa, Panicum virgatum
  misc_feature: Ceres CLONE 1770989
  misc_feature: SWISSPROT Homolog: EC 3.6.3.14 H(+)-transporting two-sector ATPase
  misc_feature (16)..(16): Xaa is any aa, unknown, or other
  misc_feature (19)..(19): Xaa is any aa, unknown, or other
  misc_feature (21)..(21): Xaa is any aa, unknown, or other
  misc_feature (27)..(27): Xaa is any aa, unknown, or other
  misc_feature (31)..(31): Xaa is any aa, unknown, or other
RTKDWVALADLEEGGXGGXGXKEGRGXKRGXGGGMLLLIAGDAGAAAEEPAVAADSAAGAEEAAAAAAAAKAEGAAEAAALRAELEQLRAKISNLESGIAERSQELKNKDDFFSKLEKVIEERSKKIASLQAEIASLQAQGSIAAEEQAGKANARAIELEKQVEKLKKDIETQSSQRTALESRAN

SEQ ID NO: 13819 - DNA, 734 bp, Panicum virgatum
  misc_feature: Ceres CLONE 1771015
  misc_feature: Encodes the peptide sequence at SEQ ID NO. 13820
aagccggaggcccccaccccgacaagcgcggcgcggccgcggcggccccaggcgcagcagcccccgcggccgcaggcgacggcggcggcggcggcggcggccgcgccgcgcccggcgcaggcggagcagaaggagaaggcggcgccccccgacaccaacccgacgcccccggcgaacgcgaccgagcaccggcagcgcacggacgcgcttttttttctctacttcacgccgctcggcaagttcatggacgagcgggacgccaagatccgcggcgagctcggcgacgtcaaggacgcctccgaggaggtcaagcagctggaggagcaggccgccgccatcatgaaggcggcgcgcgccgagatcgccgcggcgctcaacaagatgaagaaggagaccaccgccgagctggaggccaagctggacgagggccgccgccgcgtcgaggccgagctcgtcgaggcgctcgccaacctcgaatcccagaaggaggaggccctcaaggcgctcgacgcgcagatcgcctcgctcagcgacgagatcgtcaagaaggtgctcccatccgcgtgagggggaatcgaaacagcgagccagccttcttccttgctcagctttctgatctgtgtgtatacgcttgttgggccgccgtccgttgccggccctgctttatcctatgatgactgtaactgcatcaacattttgtggcaagtataaatgaatcaatcatatttttgtag

SEQ ID NO: 13820 - protein, 188 aa, Panicum virgatum
  misc_feature: Ceres CLONE 1771015
  misc_feature (69)..(186): Pfam Name: ATP-synt_B Pfam Description: ATP synthase B/B' CF(0)
  misc_feature: SWISSPROT Homolog: EC 3.6.3.14 H(+)-transporting two-sector ATPase
KPEAPTPTSAARPRRPQAQQPPRPQATAAAAAAAAPRPAQAEQKEKAAPPDTNPTPPANATEHRQRTDALFFLYFTPLGKFMDERDAKIRGELGDVKDASEEVKQLEEQAAAIMKAARAEIAAALNKMKKETTAELEAKLDEGRRRVEAELVEALANLESQKEEALKALDAQIASLSDEIVKKVLPSA

SEQ ID NO: 13821 - DNA, 724 bp, Panicum virgatum
  misc_feature: Ceres CLONE 1771016
  misc_feature: Encodes the peptide sequence at SEQ ID NO. 13822
agactgccgcctccactttataagttcctctcgtctctctcctccgcgaaacccttgttctggtcctcgtcccgccaccgccgccgccgcctgcaccacccgccgcccagcagcagccgtcgccggagaagaaggggagagagccatgggtcgcgtccgcaccaagaccgtgaagaagacctccaggcaggtgatcgagaagtactactcccgcatgaccctcgactttcacaccaacaagaaggtgctggaggaggtctcgatcctgccctcgaagcgcctccgcaacaaggtggccggcttcaccacccacctgatgcgccgcatccagcgcggccccgtccgcggcatctcgctcaagctccaggaggaggagcgcgagcgccgcatggatttcgtcccggagaagtcggcgctcgaggtggaggagatccgcgtcgacaaggagaccatggagatgctcgcttccctcggcatggccgacctcccgggcgtcgagcgccaagctgaggtctccagcgcccctacctacggtcgcccgcagtacggtggcccccgccgcgaccgcgtctaggcttctagccggttgcagtggttggatcttgatcgcttcacttatcgttgttattgtgctactatgtcaaacttattttaggtcagtggttgctttgtggcgattgagtcttgaacctatctgttttgctataaattctgcactgttttt

SEQ ID NO: 13822 - protein, 142 aa, Panicum virgatum; identical to SEQ ID NO: 10208
  misc_feature: Ceres CLONE 1771016
  misc_feature (1)..(122): Pfam Name: Ribosomal_S17e Pfam Description: Ribosomal S17

SEQ ID NO: 13823 - DNA, 557 bp, Panicum virgatum
  misc_feature: Ceres CLONE 1771020
  misc_feature: Encodes the peptide sequence at SEQ ID NO. 13824
aagtaccacacgggacagaccagagcccctttaaagtcgccatggcctcccagctctccgccgccgcgtccatgtccgccgccgtgccgcagttccacggcctgtttggctacgcctcgccccggtccgtggcggcgctgccgccggtgagggccggcaggaagcgggcgcagggcatccggtgcgactacatcggctcggccaccaaccagatcatggtgctgtcgacgacgctgatgctggtcgcggggcggttcgggctggcgccgtcggcgaaccggaaggcgacggcggggctgaagctggagtcccgcgactccggcctgcagactttttaccccgccgggttcacgctcgccgacacgctggcctgcggcgccgtcggccacatcatcggcgtcggcatcgtgctcgggctcaagaacaccggcgcgctcgaccagatcatcggctaggtccattgtctgccttgtctctctcgccgccggccggtgcccatgtaaccatgcatctcgtttcgtttcaatggacatagcttgttgcttcttttgcccccc

SEQ ID NO: 13824 - protein, 137 aa, Panicum virgatum
  misc_feature: Ceres CLONE 1771020
  misc_feature (52)..(132): Pfam Name: PSI_PSAK Pfam Description: Photosystem I psaG / psaK
MASQLSAAASMSAAVPQFHGLFGYASPRSVAALPPVRAGRKRAQGIRCDYIGSATNQIMVLSTTLMLVAGRFGLAPSANRKATAGLKLESRDSGLQTFYPAGFTLADTLACGAVGHIIGVGIVLGLKNTGALDQIIG

SEQ ID NO: 13825 - DNA, 797 bp, Panicum virgatum
  misc_feature: Ceres CLONE 1771023
  misc_feature: Encodes the peptide sequence at SEQ ID NO. 13826
aacaacacatcaattcaagaaaagtcgagctaggctttgcgctcgtcgacgtagccaagctttttgagtccacgaggagaggcggcaggtcaagcgagcaagaagctttggatcggaggtcagcagcggggcgcatggccatggaggtccagggctccaggcggcaccaggacgccggcgtgaaggtcaagttcatcgagacgcagttcatcagctccgacgccgccagcttcaaggccgtcgtgcagcgcctcaccggcaagtcccccgccgcctcgtcgaggccggcccaggcggtactggcgcctcagccgcagaggccgcgcccgtgccggccggccttcgctggcgcggggcagcaccatcaggccgccaggtggccggagcagcaccaagctggcgcctacctggtcgcgccggcgccgaagcaggcgccgctcgcggcggcgccgagcctggaggagatgcaagagctctgcgacttcgccgacctgttctacaccaccagcggcgccacgggcgcgcggcgcgacattgccggcagcgccttcccttactgaatttgtttttccgagcaccaatgcttgtagtttgcctttgcaaattcgcagtgtgttgagcacattaatggtcgtcgaggagctagatgcgacgagagatggtcatagtcatgtagtagttccacacgcacagtactggaattgacgaggggcctgaaagtatagtgaaatgctgcagcctagaatttgtaacgtgcaaacgacagatcatgttgcaatatacgtcgaatttttctc

SEQ ID NO: 13826 - protein, 139 aa, Panicum virgatum
  misc_feature: Ceres CLONE 1771023
  misc_feature (17)..(47): Pfam Name: VQ Pfam Description: VQ motif
MEVQGSRRHQDAGVKVKFIETQFISSDAASFKAVVQRLTGKSPAASSRPAQAVLAPQPQRPRPCRPAFAGAGQHHQAARWPEQHQAGAYLVAPAPKQAPLAAAPSLEEMQELCDFADLFYTTSGATGARRDIAGSAFPY

SEQ ID NO: 13827 - DNA, 319 bp, Panicum virgatum
  misc_feature: Ceres CLONE 1771026
  misc_feature: Encodes the peptide sequence at SEQ ID NO. 13828
accctgtcgtacctgccgccgctctccaacgaggacctcttgaggcatatctactacctgatccggaacaactgagtacattgcctcgagttcggctagatcagcttctacttccgcgagaacaccacttcccccgggtaatactatggccgctactggaccatgtggaacctgcccatgttcagatgctccgacgccaatcccgtgtacaccgagatcgaggagtgtaagaaggcataccccaacaactacatcctcatccacatattccagaacgccagggaggtgcagtgcgtcatgttcatcgcctagaagcccg

SEQ ID NO: 13828 - protein, 49 aa, Panicum virgatum
  misc_feature: Ceres CLONE 1771026
  misc_feature: SWISSPROT Homolog: EC 4.1.1.39 Ribulose-bisphosphate carboxylase
MWNLPMFRCSDANPVYTEIEECKKAYPNNYILIHIFQNAREVQCVMFIA

SEQ ID NO: 13829 - DNA, 244 bp, Panicum virgatum
  misc_feature: Ceres CLONE 1771044
  misc_feature: Encodes the peptide sequence at SEQ ID NO. 13830
gctccaactgcaagagcggcaacaagtaccccgacctagaggagaagaaccgcggcgggcctcaggcccccctcctgctcggcctggccccggagaacaaggccggccactacgaggcggcggcggagcccggggagaccgcccacgcccgcaagcgcgataacagctgccgctgccacccccgcaactgctgattccgatggggaacgtcagaacacacctgcacgaccgctagctactagct

SEQ ID NO: 13830 - protein, 63 aa, Panicum virgatum
  misc_feature: Ceres CLONE 1771044
  misc_feature (1)..(63): Pfam Name: Metallothio_2 Pfam Description: Metallothionein
SNCKSGNKYPDLEEKNRGGPQAPLLLGLAPENKAGHYEAAAEPGETAHARKRDNSCRCHPRNC

SEQ ID NO: 13831 - DNA, 671 bp, Panicum virgatum
  misc_feature: Ceres CLONE 1771072
  misc_feature: Encodes the peptide sequence at SEQ ID NO. 13832
gcgccggccgccgctcccatttcaaattccgacccccagccgccaccgtcctccctccggcctcctcctcgacgcagctcgtcgccgtcttcctcactcacctcacctcgcctccctcccgtggccgccactctcgcgtgcgatggcggcgcgtcaggagtggagcatgtcggacttcgagatcggcaagtacatcggcgagggaaagttcggcaaggtctacctcgcccgcgagaagcagagcgggtacgtggtggcgctcaaggtgacgtacaaggccaagctggagaagtaccgcttccacgcgcacttgcggcgagagattgagatccagcacggactcgaccaccccaacgtgctccgcctcttcgcctggttccaggacgaagagcgcgtcgtcctcgtcctcgaatacgcggcccgtggtgagctatacaaggtccttcgcgctgctggccacttcacggagcgcaccgccgccacctacgttgcaagccttgctggtgcactggcgtactgtcacaagaagcaggtcattcatagggacatcaaacctgagaatttgctacttgatattgagggccgacttaaaattgcagattttggatgggcagctcggtcaaatgctaaacgacacacactttgtggcacgattgattatctggcaccag

SEQ ID NO: 13832 - protein, 176 aa, Panicum virgatum
  misc_feature: Ceres CLONE 1771072
  misc_feature (12)..(176): Pfam Name: Pkinase Pfam Description: Protein kinase domain
  misc_feature: SWISSPROT Homolog: EC 2.7.11.1 Non-specific serine/threonine protein kinase
MAARQEWSMSDFEIGKYIGEGKFGKVYLAREKQSGYVVALKVTYKAKLEKYRFHAHLRREIEIQHGLDHPNVLRLFAWFQDEERVVLVLEYAARGELYKVLRAAGHFTERTAATYVASLAGALAYCHKKQVIHRDIKPENLLLDIEGRLKIADFGWAARSNAKRHTLCGTIDYLAP

SEQ ID NO: 13833 - DNA, 549 bp, Panicum virgatum
  misc_feature: Ceres CLONE 1771074
  misc_feature: Encodes the peptide sequence at SEQ ID NO. 13834
ctcctgttggtccgcccggggacggcaaaccctacccccgcttctctctccttctcctcctgtctcagggcgagatccctccgttcccgcgccaccactactccccccggacagaccatttcggaacacagcgtcaccgacgcgccaccggaaggggatgggacaggaactcccttgccatcttccattgaggatgacggagagcaatgtgcacccaagcgaaacataataatccagctgcgttcctactgggttcctttgtgataggactcccgcaacaagataattgatgctgccaaaactaccaatggaaagacaatgcggcctgttcctctgccaaccaagattagagtatattgtgtactcgactcgccccatgtgcacgacgattctcgtgtccattgcgagatccagactcatctgcgtatgattgatatcatgtatcccactgcgcaaatgattgactcactgatgcagctacagctcctcgctggtgtgtacgttgatgttaaactataattctgattgaagccgaggtttcacactttg

SEQ ID NO: 13834 - protein, 66 aa, Panicum virgatum
  misc_feature: Ceres CLONE 1771074
  misc_feature (3)..(64): Pfam Name: Ribosomal_S10 Pfam Description: Ribosomal protein S10p/S20e
MRPVPLPTKIRVYCVLDSPHVHDDSRVHCEIQTHLRMIDIMYPTAQMIDSLMQLQLLAGVYVDVKL

SEQ ID NO: 13835 - DNA, 715 bp, Panicum virgatum
  misc_feature: Ceres CLONE 1771093
  misc_feature: Encodes the peptide sequence at SEQ ID NO. 13836
gaagcgaccgtccgttgagctgcgcgcgaggcaaggccatcatccgccatgacgctctccctctccacctccttcctccccacccccgccgccgcgagggccagtgcccccaccctccgctccgtcgtcccgtcacaggtactcgtatgcttgtctgatatctgtttcccgcacgaatagtcatcagcgcggccactgattcggagaccggaacctggacggggcggtggtgcaggggatgcgctgctcgatgcgcaagaaggggctgcacccgcagatctacgaggacgctaaggtgtactgcaacggcgagctggtgctggtgacggggagcaccaagccggagtacacggtggacgtgtggtccgggaaccacccctactacgtcggcgacacctcggcgctggtggtgatggacagccagatcgagaagttccgcaagaagtggggccacatcaaggagtactggcccgaggaccagtggagggagatgcaccccgacggggacccggagttcgagcccgagggggacaactgatcgacggcggctcccccattcatcgtcttcctcctcctcctcttcttcttcccgccctcacccggtgcgtggtcacggctcctgtttaccttgctctcttggttggaatttgagactttggcacgttcgcaatgctctccaggtgttcgattaatgttcgcaatgtaatggtaccag

SEQ ID NO: 13836 - protein, 99 aa, Panicum virgatum
  misc_feature: Ceres CLONE 1771093
  misc_feature (5)..(73): Pfam Name: Ribosomal_L31 Pfam Description: Ribosomal protein L31
MRCSMRKKGLHPQIYEDAKVYCNGELVLVTGSTKPEYTVDVWSGNHPYYVGDTSALVVMDSQIEKFRKKWGHIKEYWPEDQWREMHPDGDPEFEPEGDN

SEQ ID NO: 13837 - DNA, 640 bp, Panicum virgatum
  misc_feature: Ceres CLONE 1771099
  misc_feature: Encodes the peptide sequence at SEQ ID NO. 13838
attcagctgagtgtgctcgatcatcaagcaatcaacaaagcctcccaattatcctttcatcagatcatcttccttcttccaaaatgtcttgcagctgcggatcaagctgcaactgcggctccaactgcaagtgcggcaagatgtaccctgaccttgaggagaagagcagcggcggcgctcaggccaccatcgtcctcggcgtggccccggagaagaaggccggccagttcgaggcggcggcggagtccggcgagaccgcccacgcctgcaagtgcggtaacagctgcacctgcgacccctgcaactgctgatttggatggggaacgtacacacctgcgtgcatgctagctactgcctactctgcttgtgtgtgacttgattgaacaagaataaggatgagcctgagccaacgtgcccgatgtatcggtttggctccggcctcatccagcatgcatgcgtcgtctgcccttatgtgtgctttgctacctccttattaccttgtgcttggcgtcagtcatgtatctgtatgtgtctgtatgtgttgatcattgcaaataaaccatgcaggcatgatgcatctctgcatgtgtctctgtaatgatcggtccagagtgatgaatatataaaactggtttgcttt

SEQ ID NO: 13838 - protein, 75 aa, Panicum virgatum
  misc_feature: Ceres CLONE 1771099
  misc_feature (1)..(75): Pfam Name: Metallothio_2 Pfam Description: Metallothionein
MSCSCGSSCNCGSNCKCGKMYPDLEEKSSGGAQATIVLGVAPEKKAGQFEAAAESGETAHACKCGNSCTCDPCNC

SEQ ID NO: 13839 - DNA, 976 bp, Panicum virgatum
  misc_feature: Ceres CLONE 1771129
  misc_feature: Encodes the peptide sequence at SEQ ID NO. 13840
gagagagctcctcgctccgagtccgactccgcctcgtcgcccgccaccctcgcttctcccccatcccgatccacctcgcaaggccagcccgcgccgcactggcatggcctcctcgtcctgcctcgcctcgccggccggcgccgcggcgctgatctgccgcgcgcggcggccgaggcgccgcgtggcgtgctcggcgagcgagaagagcgccgagccggcgtggctcgcggccgggggcaggagcgccggcggccgcctcgcgtgcggcgtgctggcggcctgggccgtcgcgtccgcgtccagcccggtcattgccgcgagccagagattgcctccactctcaactgagccaaacagatgtgagcgtgcattcgtggggaacacaattggtcaggcaaatggggtgtatgacaagccccttgatctccggttttgtgattacacgaacgagaaaactaatctgaaaggcaagtctctagctgcggcgttgatgtccgatgcaaagtttgatggtgccgacatgtctgaagttgtcatgtccaaagcttatgctgttagcgcaagcttcaaaggaaccgacttcacgaatgcagtgatagaccgtgtcaatttcgagaaggctgatctcacaggggcaatcttcaagaatacagtcttgtcaggatcgaccttccatgatgctaagatggaagatgttgtgttcgaggacacaatcatcggctacattgaccttcagaagctgtgcacaaacaccagtatcagcgcagacaatagattagagctggggtgtaggtgattcagcagattccatctaatcatctgcaatcgttcatgttaatatgctggtatcgttcgatgagtgttcatgcctgtctatagagcctccatgacaagatgcgacgatttttctccatgtctatgtacaaacatctctgtgtacctcaaatatcagcagcaatgcaaccatgtttcttac

SEQ ID NO: 13840 - protein, 230 aa, Panicum virgatum
  misc_feature: Ceres CLONE 1771129
  misc_feature (163)..(202): Pfam Name: Pentapeptide Pfam Description: Pentapeptide repeats (8 copies)
  misc_feature (118)..(157): Pfam Name: Pentapeptide Pfam Description: Pentapeptide repeats (8 copies)
MASSSCLASPAGAAALICRARRPRRRVACSASEKSAEPAWLAAGGRSAGGRLACGVLAAWAVASASSPVIAASQRLPPLSTEPNRCERAFVGNTIGQANGVYDKPLDLRFCDYTNEKTNLKGKSLAAALMSDAKFDGADMSEVVMSKAYAVSASFKGTDFTNAVIDRVNFEKADLTGAIFKNTVLSGSTFHDAKMEDVVFEDTIIGYIDLQKLCTNTSISADNRLELGCR

SEQ ID NO: 13841 - DNA, 732 bp, Panicum virgatum
  misc_feature: Ceres CLONE 1771140
  misc_feature: Encodes the peptide sequence at SEQ ID NO. 13842
gcaaggacaggcttggggagtgctggctgaagaaacaaaaggacgtgatggctcctgctgttattgcaagcggggaggacgtcatgtggacgtctggtctagtctttgcaaaaggagagggaattgtggcgcttgaaacaagtcttgggacacttcatattcaattgctgcctggttgtgcaccgcggtctgtggactacttcatcgagctcttgggcttgcacaactgtgctgggtgcagattttatcgcgcggaaggacgtgggaatgtctgggatgcagaaggcaatcatgacaaaaatgctgcttttggtcccccgtatgcattgcttcaagggacactggaagttgatggtgtgcctttcaagggcataacaagagaagcatgcccggaggtgaaaagagggtccattgcctgggttggatcagggccggagttcctgatcagcttagcaaaccacgaggagtggaaggacgcctacactgtgttcggccacgtgctgcccgaggacatggcgatagccgaggagatggcactgctgccagcgagcacggacgtgtggagcaatgtaacggtgaaggtgctgagagatcctgtctacttcaaggtgaagaggagctgccatgctagttctgtctaggtgaggcatatttctttcatcaggtgttggggcagatacatgtgtagccaaaagctatagagcagatgatcgctttattactgtgcatgcg

SEQ ID NO: 13842 - protein, 212 aa, Panicum virgatum
  misc_feature: Ceres CLONE 1771140
  misc_feature: SWISSPROT Homolog: EC 5.2.1.8 Peptidylprolyl isomerase
KDRLGECWLKKQKDVMAPAVIASGEDVMWTSGLVFAKGEGIVALETSLGTLHIQLLPGCAPRSVDYFIELLGLHNCAGCRFYRAEGRGNVWDAEGNHDKNAAFGPPYALLQGTLEVDGVPFKGITREACPEVKRGSIAWVGSGPEFLISLANHEEWKDAYTVFGHVLPEDMAIAEEMALLPASTDVWSNVTVKVLRDPVYFKVKRSCHASSV

SEQ ID NO: 13843 - DNA, 611 bp, Panicum virgatum
  misc_feature: Ceres CLONE 1771146
  misc_feature: Encodes the peptide sequence at SEQ ID NO. 13844
gttcccagcgcagcaggagaaaagaatcgtctcgtctcgtctattctctccatccccgtagtccggattcccgaccaggttccagaaaaacccccgtccaattcgcgagatggcggagcaccccaccccccagccccaagtggaggagaaggaggtggtggtggagcagccgcagcaggagccgaagagggccccccacctgaggtacctggatttctcccatgtggcggcggcgcaggccgtggtgtgcctggcggggctctacgggctccccaagagccaccgccggcccgctccgccccggcatcaacaccgtcgagtccgcggtgaagggcgtcgtcggccccgtctacgatcgcttcctcagcgcgcccctcgacgtcctcgccttcgtcggccgcgtggtggatgataccgtgcacgagctggataagcacctcactggtgcgctgaaggccgcgtcggcgcatgtttacgcggaggcccgaggagtctgggaggtggtgcgcgagctcgccgctgaggcgctgctgtccggcgtgatggtcgctgcctgcgcggcgctgaccacagtggtccccgcggccggggacgtgtatgggtgcgtggcg

SEQ ID NO: 13844 - protein, 129 aa, Panicum virgatum
  misc_feature: Ceres CLONE 1771146
  misc_feature (21)..(127): Pfam Name: REF Pfam Description: Rubber elongation factor protein (REF)
MWRRRRPWCAWRGSTGSPRATAGPLRPGINTVESAVKGVVGPVYDRFLSAPLDVLAFVGRVVDDTVHELDKHLTGALKAASAHVYAEARGVWEVVRELAAEALLSGVMVAACAALTTVVPAAGDVYGCV

SEQ ID NO: 13845 - DNA, 551 bp, Panicum virgatum
  misc_feature: Ceres CLONE 1771147
  misc_feature: Encodes the peptide sequence at SEQ ID NO. 13846
agccctccatttcacctctccacttcttccttcactatccctgtatctctccagcatcacttggggaatgagctcccccgtcctctgtctcctcccctgctgtgtgctcccctcagacgcctccacgaagtcatcccaagccaacgccataatcacgctgcccccgttcttcaggaaaagctcaagatcctccgctccatctcccactcccacactctgacctacgcctccctaatcgtggacgcatcgacgtacctcacggatctcaagcagactgtggtgaggctgaaccaggacatcgcctgcgcgcagcatgactcgctgacacatggctcctcctacccgacggtgaccgtggaaaccctagtgggcggggacggtgcgttcctcatcaacgtcttctccgacaagagctgcccggagctgctcgtctccgagctcgaggacttcgacgagatggggctcagcgtcctccaggccaccgcgtcctgcgccgaccactccttccgcctcgaggtcgtgcgtggatgagaacgtggccgataacctgc

SEQ ID NO: 13846 - protein, 176 aa, Panicum virgatum
  misc_feature: Ceres CLONE 1771147
  misc_feature: Useful for making plants with modulated biomass
SPPFHLSTSSFTIPVSLQHHLGNELPRPLSPPLLCAPLRRLHEVIPSQRHNHAAPVLQEKLKILRSISHSHTLTYASLIVDASTYLTDLKQTVVRLNQDIACAQHDSLTHGSSYPTVTVETLVGGDGAFLINVFSDKSCPELLVSELEDFDEMGLSVLQATASCADHSFRLEVVRG

SEQ ID NO: 13847 - DNA, 637 bp, Panicum virgatum
  misc_feature: Ceres CLONE 1771157
  misc_feature: Encodes the peptide sequence at SEQ ID NO. 13848
gagcgctggcatcactcggagccttgcctcccttagtagagagtgtgttgtttgcagggggaagaagggaagagggcaatggcgacctccttccaggggacgacctccaagtgcaccgcctgcgacaagacggtgtacctcgtcgacaagctcaccgccgacaaccgcgtctaccacaaggcctgcttccgctgccaccactgcaagggaaccctcaagcttgcgaactacaactccttcgagggggtgctctactgcaggcctcacttcgaccagctgttcaagaggacggggagtctggacaagagcttcgaaggaacccccaaggttgtcattttttttagaaagaatgagaatgctattaaagtctccagtgcctttgctggcaccagagagaaatgtgttggatgcagcaagacagtctatccaattgagagggtaactgtcaacaacactatgtatcacaagagctgcttcaagtgctgccatggaggatgcaccatcggcccttcgaactacatcgcgcacgaggggaagctctactgcaagcatcatcacatccagctgatcaaggagaaggggaacttcagccagctcgagaatgatcatgagaagacatcacaggctggatcgctgg

SEQ ID NO: 13848 - protein, 186 aa, Panicum virgatum
  misc_feature: Ceres CLONE 1771157
  misc_feature (108)..(164): Pfam Name: LIM Pfam Description: LIM domain
  misc_feature (12)..(68): Pfam Name: LIM Pfam Description: LIM domain
  misc_feature: SWISSPROT Homolog: EC 2.7.11.1 Non-specific serine/threonine protein kinase
  misc_feature: Useful for making plants with altered carbohydrate content
  misc_feature: Useful for making plants with modulated heat sensitivity
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
MATSFQGTTSKCTACDKTVYLVDKLTADNRVYHKACFRCHHCKGTLKLANYNSFEGVLYCRPHFDQLFKRTGSLDKSFEGTPKVVIFFRKNENAIKVSSAFAGTREKCVGCSKTVYPIERVTVNNTMYHKSCFKCCHGGCTIGPSNYIAHEGKLYCKHHHIQLIKEKGNFSQLENDHEKTSQAGSL

SEQ ID NO: 13849 - DNA, 607 bp, Panicum virgatum
  misc_feature: Ceres CLONE 1771178
  misc_feature: Encodes the peptide sequence at SEQ ID NO. 13850
aggatcctccggcacatgtcgaccgggccgccggggtcgatccagctggacccctacggcggcgccatggcgcgggtagggagcggcgcgacgccgttccctcaccgcgccgggcacctgtacagcatccagtacgccgtcacctggaacgcgtcggatcatcgtctcggccgtgcggaggagcgcatcggatggctccggtcgttccacgagttcatggcgcgctacgtgtcgaggaacccgcgccgcgcgtacgtcaactacttggacctcgacttggggaccaatggctgggcgaatgcgacgggcggaacgtcgggcgagtccgtggcgcgtgcggcgtcgtggggcgagcgttacttcttcacgaactttgatcggctggttcgggccaagactaaggtggatcctgaaaatgtgttcaacaatgcgcaaagcattccacccttacggcatgatgatcgagagcactaaatctataatggcacgtaattgccacaataaataaatagatagtttaatgtttggagtagcaatgttttcgtcttcaataaacactggtcggctggctgtggctgtggctggtgctgatttgttgttgtgacag

SEQ ID NO: 13850 - protein, 157 aa, Panicum virgatum
  misc_feature: Ceres CLONE 1771178
  misc_feature (84)..(148): Pfam Name: BBE Pfam Description: Berberine and berberine like
  misc_feature: SWISSPROT Homolog: EC 1.21.3.3 Reticuline oxidase
RILRHMSTGPPGSIQLDPYGGAMARVGSGATPFPHRAGHLYSIQYAVTWNASDHRLGRAEERIGWLRSFHEFMARYVSRNPRRAYVNYLDLDLGTNGWANATGGTSGESVARAASWGERYFFTNFDRLVRAKTKVDPENVFNNAQSIPPLRHDDREH

SEQ ID NO: 13851 - DNA, 765 bp, Panicum virgatum
  misc_feature: Ceres CLONE 1771183
  misc_feature: Encodes the peptide sequence at SEQ ID NO. 13852
gttacagagtcacgagcgccaaattccagaatcttccagaagcgtcgggactcgggagagccggaagctaccagcaatggcggagaagctggcccccgagaagcgtcacgccttcgtccacaacgagcagaaggtgttcgaatgggaccagacgctggaggaggtgaacatgtacatcgagctccccaagggcgtgcccaccaagctcttctgctgcaccatccaggcaggccacgtcgaggtcggcatccgcggcaacccgccatacctcaaccacgacctgacgcaccccgtgaagacggactcgtcgttctggacaatagaggatggtgagatgcatatcacactgcaaaaaagagagaaggggaagacatggtcatctcccatacaagggcaaggtatcttggacccatatgcggcagatcaagagcaaaaacggcttatgctgcaaaggtttcaagaagagaaccctgggttcgacttttcgcaggctcagttcagtggaacctgccctgacccaaggaccttcatgggaggaatacgctcggaatgaatcttcctggctgaaccacattttctccctatgctcctgctgctacccccagcatctttgttagatgcagcagctatactgtatgaatccattatgtaaattggttggtgtttacccttcaaataatgatgatgactcttgtaagttcatcagctgactggaagttcccagaatcgggctaccggtgtaaatgctaactttttttttaggac

SEQ ID NO: 13852 - protein, 158 aa, Panicum virgatum
  misc_feature: Ceres CLONE 1771183
  misc_feature (19)..(93): Pfam Name: CS Pfam Description: CS domain
MAEKLAPEKRHAFVHNEQKVFEWDQTLEEVNMYIELPKGVPTKLFCCTIQAGHVEVGIRGNPPYLNHDLTHPVKTDSSFWTIEDGEMHITLQKREKGKTWSSPIQGQGILDPYAADQEQKRLMLQRFQEENPGFDFSQAQFSGTCPDPRTFMGGIRSE

SEQ ID NO: 13853 - DNA, 710 bp, Panicum virgatum
  misc_feature: Ceres CLONE 1771203
  misc_feature: Encodes the peptide sequence at SEQ ID NO. 13854
ctgccaacgatggcccttgaaacgtgcttcagagcgtgggcgctgcacgccgcccctgccggcggcaaggacaggctcgccgtcggcggcggcggcagcagcttcgcgccgtccaagcgggccgccgccgccgccgcgccgctgtccgtcggccgcgtcgccacgcggcggccccggcacgtctgccagtccaagaacgccgtcgacgaagtgctggtggcggatgagaagaactgggacgggatggtgatggcgtgcgagacaccggtgctggtggagttctgggcgccgtggtgcgggccctgccggatgatcgcgccgttgattgacgagctggccaaggactacgccggcaagatcaagtgctgcaaggtgaacacggacgactgccccaacgtcgcctccacctacggcatccgcagcatccccaccgtgctcatcttcaaggccggcgagaagaaggagagcgtcatcggcgccgtgcccaagaccacgctcaccaccatcatcgacaagtacatcggcagctcgtgatcgagccaactggggttgatgggtgatgttgttgttggagatgaactaaatacatacgtgtccgtgctcgcgcatacacaccatgtatctcttattgcgatgatgcgataactcaggcagccgtctgctcctgctcccttatactatatcgaatccaactccattaattagtttcc

SEQ ID NO: 13854 - protein, 174 aa, Panicum virgatum; identical to SEQ ID NO: 10152
  misc_feature: Ceres CLONE 1771203
  misc_feature (67)..(170): Pfam Name: Thioredoxin Pfam Description: Thioredoxin
  misc_feature: SWISSPROT Homolog: EC 1.8.1.8 Protein-disulfide reductase
  misc_feature: Useful for making plants with modulated heat sensitivity

SEQ ID NO: 13855 - DNA, 656 bp, Panicum virgatum
  misc_feature: Ceres CLONE 1771236
  misc_feature: Encodes the peptide sequence at SEQ ID NO. 13856
acctttccttttcttcagttcctcccctccccctccccctccccctccgtcgtcagtcttctttgctgccttcggcccttcacagttcacacttcgccagatcaccaccccgaccgcgactgccgacgcaagccacgaggccggcgacccccgcacctcctcgcctccggcgaccgtcccgagggagaaacatgggtagcgtctggagtggcggtggaggaggtggtggctctgcttcctcgggaggtcatggtggctcggccaaccctggtggaggcggcggcaagatgatgaaggcgcccggcagcggcggcgcgtacatctcccgccctggcttcgagtccaaccctcagggctacttccaggacctccgcaagggaggcaagtagatgtaggcttgcccggagagcgcctcccggtgcctgcgagtatgtgtcatcagtatggaccgtgagagtccatagcttctaaataatgcacaggtcgctgcaccaggaggcggcagcagtctattttataaataatgtacaactgctgcaccagtagccggcagcagcctagctagccttctgctgctccacgtcctgtttcggtttgctcgcttgtttcaaagtacctgctccctcctttaataaaagaaacgcaatattcgatcc

SEQ ID NO: 13856 - protein, 65 aa, Panicum virgatum
  misc_feature: Ceres CLONE 1771236
  misc_feature: Useful for making plants with modulated biomass
MGSVWSGGGGGGGSASSGGHGGSANPGGGGGKMMKAPGSGGAYISRPGFESNPQGYFQDLRKGGK

SEQ ID NO: 13857 - DNA, 222 bp, Panicum virgatum
  misc_feature: Ceres CLONE 1771252
  misc_feature: Encodes the peptide sequence at SEQ ID NO. 13858
gcccccaaccccgagccccccaagacgcccacccccccgaggaagccgcgcccgcccacgccggccaccagccccaccaaacccaccgccagcaccccccgccccgacaggcccgagagcgcccacaaggaggccgatttttttatcgcaccagccgcaacaggccagaggggcgcattgccaggccatgttgctatttttgccgagctcaagccgggtgcc

SEQ ID NO: 13858 - protein, 73 aa, Panicum virgatum
  misc_feature: Ceres CLONE 1771252
  misc_feature: SWISSPROT Homolog: EC 3.6.3.14 H(+)-transporting two-sector ATPase
APNPEPPKTPTPPRKPRPPTPATSPTKPTASTPRPDRPESAHKEADFFIAPAATGQRGALPGHVAIFAELKPG

SEQ ID NO: 13859 - DNA, 654 bp, Panicum virgatum
  misc_feature: Ceres CLONE 1771257
  misc_feature: Encodes the peptide sequence at SEQ ID NO. 13860
gagagagagagagaggcgtctgcgtgcgtggtcggtgccggtgcgtggcgtggtggccgtgcggtcccctcttcctctcggcgccggcggacgtgtcggggggaggaatggccgcgccgagggctccgctcggggcggtcgcggtggccgcgctcgtcgtcgccatcttcatgccggccgcggcggcgcaggggccggcgccggctcccaccagcgacggcacatcaatcgacctgggaatcgcgtacatcttgatgctggtggccctggtgctcacctacctgatccacccgctggacgcgtcctctccctacaagctcttctaatccctgttcgttttgtttgttcgtcgatgatgttatgggtctgataggatttttagccatgcaagacgtttaggtgaggtttggagatttagaatgaacgtcaacgtctgatctgatcttggcatgtatggtaagttttttggtggtctgaatgcctgattggttgtatcggattccatgatcttgtgcccagttgtgcttgctgttggccgttgctggattctatttccgctggtcccgcccgggtgctcattgacatgtgctctgccatggatgccgttgcaagttgcaacaccaaacatgtgaaggactgggtcatggctgtgcc

SEQ ID NO: 13860 - protein, 72 aa, Panicum virgatum
  misc_feature: Ceres CLONE 1771257
  misc_feature: Useful for making plants with altered carbohydrate content
  misc_feature: Useful for making plants with altered cell wall content and/or composition
  misc_feature: Useful for making plants with modulated nitrogen use efficiency
  misc_feature: Useful for making plants with modulated salt sensitivity
MAAPRAPLGAVAVAALVVAIFMPAAAAQGPAPAPTSDGTSIDLGIAYILMLVALVLTYLIHPLDASSPYKLF

SEQ ID NO: 13861 - DNA, 707 bp, Panicum virgatum
  misc_feature: Ceres CLONE 1771277
  misc_feature: Encodes the peptide sequence at SEQ ID NO. 13862
ctccactccctcccccgcctccactactcccctcccaggcgctgcccaggtaagtcggcggcgatgacgacccgcttcaagaagaaccgcaagaagcgcggtcacgtgtccgccgggcacggccgtatcgggaagcacaggaagcaccccggtggccgcggtaacgccggtggcatgcaccaccaccgcatcctctttgacaagtaccatccggggtacttcggcaaggtgggcatgcgctacttccacaagctccgcaacaggttcacttgcccggctgtcaacgtcgagcgcctctggtcgatggtgcccgccgagaaggcggcggaggccggcgccgacaaggccccgcagatcgacgtcacccagttcggctacttcaaggtgctcggaaaggggaagctgccgtccaagcccatcgtcgtcaaggccaagctcatctccaaggttgccgagaagaagatcaaggccgccggcggcgccgtcgtgctcactgcctaggtttcagtccttgtctgcctcggttttgagatctatatctgaactagtagtgctttcctgtctcatctatttgtgttaagaagacttgctagcttttaaattgctctggctcctgcctgggagagtgcttatgaggatttttgcacttagtgatgtcagttcatatcaaatatctcagatatatcaacgctatctttttactaccg

SEQ ID NO: 13862 - protein, 145 aa, Panicum virgatum
  misc_feature: Ceres CLONE 1771277
  misc_feature (107)..(139): Pfam Name: L15 Pfam Description: Ribosomal protein L15
MTTRFKKNRKKRGHVSAGHGRIGKHRKHPGGRGNAGGMHHHRILFDKYHPGYFGKVGMRYFHKLRNRFTCPAVNVERLWSMVPAEKAAEAGADKAPQIDVTQFGYFKVLGKGKLPSKPIVVKAKLISKVAEKKIKAAGGAVVLTA

SEQ ID NO: 13863 - DNA, 841 bp, Panicum virgatum
  misc_feature: Ceres CLONE 1771312
  misc_feature: Encodes the peptide sequence at SEQ ID NO. 13864
agaagggagaggggaaaagggaaagatggcggctcggcgagggcgggagtgggatggggacgagctggtcggtccgccgcagacacctctcgccgcacccgtcgtctgcctcctgcgctccgccggggacctcgctgccggtgccttcgtcggctcgctcgtcggatatggcaaaggtttgatcacaaaccaaggtatgaaggcttcacttagcaacgctggatcgtctgccaagacttttgcagctcttgctggtgttcaaagtttcataatgtgcttattgagaagactgcgtgggaaagatgacatgatcaatgctggcatggctggttgttgcacaggccttgctttgagttttccaggtgcaccccaagcaatgttccacagctgcgtcaccttcgcagcattctcatgcataatggatgggctcaacaagctgcaggccgccatggccctcacacttgatgggaaatcctcatttgccaagagccaggaggccagcgttctcccacctttcacacttcccccacttctggatgcttcggacgctttagcttcactgtgccagacccatgttaagcctaaacactagactttgttgaagtctgattcccaaaagagagcgatccgtaggttctctatgtgtggtggtttagcattctgaatttgtgaccagtgatgtggatccatttcggcgttgaacttggatcaggtttggtaattgtagtggtgccatagcgcaaatgcccaatttttgtatctagtatccatgatgcagtttgtaggaagcgcactgaagagataattactatattcagtgtttaggttctgttgcgatgtc

SEQ ID NO: 13864 - protein, 188 aa, Panicum virgatum
  misc_feature: Ceres CLONE 1771312
  misc_feature (21)..(139): Pfam Name: Tim17 Pfam Description: Tim17/Tim22/Tim23 family
  misc_feature: Useful for making plants with modulated salt sensitivity
MAARRGREWDGDELVGPPQTPLAAPVVCLLRSAGDLAAGAFVGSLVGYGKGLITNQGMKASLSNAGSSAKTFAALAGVQSFIMCLLRRLRGKDDMINAGMAGCCTGLALSFPGAPQAMFHSCVTFAAFSCIMDGLNKLQAAMALTLDGKSSFAKSQEASVLPPFTLPPLLDASDALASLCQTHVKPKH

SEQ ID NO: 13865 - DNA, 724 bp, Panicum virgatum
  misc_feature: Ceres CLONE 1771329
  misc_feature: Encodes the peptide sequence at SEQ ID NO. 13866
atcccaaacacagcaagctcagagtactcaagctagctaaagcaagcagctcataccacacacttgaagctctagctagctaatagaaatggcgccatcaaagcttgccatgttcctcgccttgactgtcctcgccttcgcggcggctgtgcacggctgcacgccgtcctgtcctaccccaccagtggttcccagcccgccgccgccggttgtgccgacgccgtccggcggtggtggctcctgcccaatcaacgcactgaagctggaggtgtgcgccaatgtgttgaacctcctgaagctcaacatccctgtcacggagagcgaccagtgctgcccgctgctgcaggggctcgtcgaccttgacgccgcagtctgtctctgccttgctatcaaggccaacgtcctcggcatcaacatcaatgtgcccatcgacctgagcctcctcctcaaccactgtggcaagatctgccctgcagatttcacctgccccaattagcatccatcatctgaatcttcatccactgccttgcctgcgatcttgtgcacctatgccgtcggtctatgtgttggtttgcatcagcatgcacccatatatgtgttgttctcttctgttcgggttccaatgatggcatgcaaattgtcgttctcgttcgttcgaacaatatgttatgtttgtctgtaacttcattatatacgtgaaataaaaatttatacaagttgtgtc

SEQ ID NO: 13866 - protein, 135 aa, Panicum virgatum
  misc_feature: Ceres CLONE 1771329
  misc_feature (52)..(133): Pfam Name: Tryp_alpha_amyl Pfam Description: Protease inhibitor/seed storage/LTP family
  misc_feature: Useful for making plants with modulated biomass
  misc_feature: Useful for making plants with modulated flowering time
MAPSKLAMFLALTVLAFAAAVHGCTPSCPTPPVVPSPPPPVVPTPSGGGGSCPINALKLEVCANVLNLLKLNIPVTESDQCCPLLQGLVDLDAAVCLCLAIKANVLGININVPIDLSLLLNHCGKICPADFTCPN

SEQ ID NO: 13867 - DNA, 633 bp, Panicum virgatum
  misc_feature: Ceres CLONE 1771334
  misc_feature: Encodes the peptide sequence at SEQ ID NO. 13868
agaagcttcagtgggcagagaggaaggaaggagagaagagagatggggaggaagctgggcctcgacagggtcctggactgcttctcgctttcgctgtgcgcctttgcctgcgcctgcgtgcactcgatggagaaggacgaggacgaggccgacgagcgcaaggccctggtgagcaaccagctggaggagctggtcaagctcagggacttcgtcgacggagcggccaagacccttgctttccatctagagcccaagacagtggagctcaaggtgtccatgcactgctacggatgcgccaagaaagtccagaagcacatctccaagatggccggcgtgacgtcgttcgaggtggatttggagaggaagaaggtggtggtgatcggggatgtcacgccgtacgaggtgctggagagcgtctccaaggtgatgaagttcgcggagctgtgggtggcgcccaaccccaagccgcaggccgcggaggagaggcagtagacgttgctaggtgctttggtcgccgtcgatctctcatgcgtcaacggtctcggcctcgtctccagttctccacctatcatgcgtagaaagaacacggccgctctgacagacccgtcgagttgaaacgtttaattaagccgt

SEQ ID NO: 13868 - protein, 149 aa, Panicum virgatum
  misc_feature: Ceres CLONE 1771334
  misc_feature (74)..(142): Pfam Name: HMA Pfam Description: Heavy-metal-associated domain
MGRKLGLDRVLDCFSLSLCAFACACVHSMEKDEDEADERKALVSNQLEELVKLRDFVDGAAKTLAFHLEPKTVELKVSMHCYGCAKKVQKHISKMAGVTSFEVDLERKKVVVIGDVTPYEVLESVSKVMKFAELWVAPNPKPQAAEERQ

SEQ ID NO: 13869 - DNA, 702 bp, Panicum virgatum
  misc_feature: Ceres CLONE 1771370
  misc_feature: Encodes the peptide sequence at SEQ ID NO. 13870
tcttccgtacatccaccaaagtcccccaaaagacaacagcaagcaagcaagcaagaggaagggacatcgcaggccattagttagttcagccggcgagcaacatccccggtggcagccatggcgtccattgtaacagcagctaacagccattggggagccctgcacacctgcacagcctcctcaagggcgctcactggcgatggtgtttgccagatgatagtagtagtagcatctctgaattgcaggctaccgggtgacttcggcttcgatcccctggggctcggggaggaaccggctgccttgaagtggtacgtgcaggccgagctcgtgcactgccggttcgccatggcaggggtcgccggcatccttgtaaccgacttgcttcgcgtatcagggatccgggatctaccagtgtggttcgaggcaggtgcagccaaatttgacttcgccaacaccacgtcactcttcttcgttcagcttctcctgatgggattcgctgaaaccaagaggtacatggatttcatcaatccgggatcacaagcagaggaaggaaccttcataggcctagaggctgcactcgtgggctcacagccaggctacccaggaggtccactgtttaatccgttaggactcgcaaaagatatagagaatgcacatgaagagaagctgaaagaaatcaagaatgggaggttgggcatggta

SEQ ID NO: 13870 - protein, 194 aa, Panicum virgatum
  misc_feature: Ceres CLONE 1771370
  misc_feature (35)..(194): Pfam Name: Chloroa_b-bind Pfam Description: Chlorophyll A-B binding protein
  misc_feature: Useful for making plants with modulated nitrogen use efficiency
MASIVTAANSHWGALHTCTASSRALTGDGVCQMIVVVASLNCRLPGDFGFDPLGLGEEPAALKWYVQAELVHCRFAMAGVAGILVTDLLRVSGIRDLPVWFEAGAAKFDFANTTSLFFVQLLLMGFAETKRYMDFINPGSQAEEGTFIGLEAALVGSQPGYPGGPLFNPLGLAKDIENAHEEKLKEIKNGRLGM

SEQ ID NO: 13871 - DNA, 101 bp, Panicum virgatum
  misc_feature: Ceres CLONE 1771370-R
cttcctgagaattctgcccccaatgcaaacgtttgtttttgctgtacagtgctatggcacaaaaagataacaatgtttcccaacaggaactgcattctttt

SEQ ID NO: 13872 - DNA, 601 bp, Panicum virgatum
  misc_feature: Ceres CLONE 1771384
  misc_feature: Encodes the peptide sequence at SEQ ID NO. 13873
acctcccccccgctcgggccgccacctctgattgattgcgcggagattgcctgagcccgccgcgagtctcacccctgttgcgttcgttgccttccaacactatgtctggagccggagaggacgacaataatccggcggagggcggcgcccacttctatctcaaggtcaaaggacaggatgggaatgaggtgttcttccgtattaagaggtccacccagctgaagaagctgatgaacgcctattgcgaccgccagtctgtggacttgaatgccattgcattcctttttgatggccgcatgcttcgcggtgagcacaccccagatgagctggagatggatgatggtgatgagattgatgccatgcttcaccagaccggtggctacgtgcctagtgcttaaaaagcccttgtcgcagcctcgttttgctgcgctgtgcgctctaccttctgtagtaaactaaagaagtcatggaggaacttgtgaggctctggccctatgtgtgccattgctgaaggacatctgtagtcttgtttagcaagatttggtacttcggcgtgtcgtgactcgtttatctatcccctaatatatccctccctgtgtgt

SEQ ID NO: 13873 - protein, 98 aa, Panicum virgatum
  misc_feature: Ceres CLONE 1771384
  misc_feature (21)..(91): Pfam Name: ubiquitin Pfam Description: Ubiquitin family
MSGAGEDDNNPAEGGAHFYLKVKGQDGNEVFFRIKRSTQLKKLMNAYCDRQSVDLNAIAFLFDGRMLRGEHTPDELEMDDGDEIDAMLHQTGGYVPSA

SEQ ID NO: 13874 - DNA, 615 bp, Panicum virgatum
  misc_feature: Ceres CLONE 1771403
  misc_feature: Encodes the peptide sequence at SEQ ID NO. 13875
attcagctgagtgtgctcgatcatcaccctataaacaaagcctcccaattatcctttcatcagatcatcttccttcttccaagatgtcttgcagctgcggatcccgctgcaactgcggctccaactgcaagtgcggcaagatgtaccctgaccttgaggagaagagcagcggcggcgctcaggccaccatcgtcctcggcgtggccccggagaagaaggccggccagttcgaggcggcggcagagtccggcgaaaccgcccacgcctgcaagtgcggtaacagctgcagctgcgacccctgcaactgctgatttcgatggggaacgtcagattttttctgcatgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtgtctgtatgtgttgatcattgcaaagaaaccatgcaggcatacatctttgcatgtgtctctgtaatgatcggtccagagtgatgaatatataaaactggtttgcttc

SEQ ID NO: 13875 - protein, 75 aa, Panicum virgatum
  misc_feature: Ceres CLONE 1771403
  misc_feature (1)..(75): Pfam Name: Metallothio_2 Pfam Description: Metallothionein
MSCSCGSRCNCGSNCKCGKMYPDLEEKSSGGAQATIVLGVAPEKKAGQFEAAAESGETAHACKCGNSCSCDPCNC

SEQ ID NO: 13876 - DNA, 1430 bp, Panicum virgatum
  misc_feature: Ceres CLONE 1771406
  misc_feature: Encodes the peptide sequence at SEQ ID NO. 13877
attaatttcctccgcttccgctccctttctccactaaataaacccccgaagagcaggagaggcgagcccgcggaggaggaagcctagggttaggttcaccgctcccccgtcgcctgggcgagtggcgagatggccgcccctggccccgctggcgccgccgcctcaccgtcgccgcagccgccacagctgccgtcgccgttcgcggagctcgtcaagagcccctccggcctcgagaaggtcgtgctccgcggctctcgcaactgctgcgtcgaggtctatctttatggaggtcaagtaacatcatggaagaatgacaacggggaagagttgctttttctcagcagcaaggctattttcaaacctccaaaagccattcgtggtggtatacccatctgctttccccaagtatggtaacctttatctgtaatggcttcattcatgttcagaaattgactggccctcaccaaaattcaccttgtaatgcagtttggaactcatggaaatcttgagcaacatgggtttgcaaggaaccggttttggaccattgacaacgacccacctcctttaccagcaaaccctgctattaaagcttatgttgatctgattctgaggccttctgaagaagatttaaagatctggcctcatagttttgagtttcgcttgagagttgctcttggaccttctggagatttgagtctcacatctcgaatcaggaataccaacactgatggaagacctttctcttacacattcgcataccacacatacttctctgtttctgacataagtgaggtgcgtgttgaagggctggaaacaatggactaccttgacaacttgaaggcaaaggagcgtttcacagagcaaggagatgctattgtttttgaatcggagattgataaagtttatcttgccgcaccctcaaaaattgcaataattgatcatgagaagaaaaaaacatttgttgtgacaaaagaagggcttccagatgctgttgtttggaacccttgggacaaaaaggctaaagctatgcaagattttggggatggagaatacaagaacatgttgtgtgtggaacctgcttctgttgagaagcctattactctgaagcctggtgaagagtggaaaggaagacttgccctctcagctgtcccttccagttactgtagtggacaattggatccattgaaggtgcttcagggctgagaaacctcattttctgcgtcttgtacaggagaacttcattgcccttcttatttgatgctgggctggcgtcaacgccgcttcgtcctttcgccattttcatcccccatatttctgtccttttttgtatctagaatttgagtggtaggttacttctgagtaacagactatgccagctgctttgagcttataatgggatctcacctcgtcggtgagtgatatcggtggac

SEQ ID NO: 13877 - protein, 240 aa, Panicum virgatum
  misc_feature: Ceres CLONE 1771406
  misc_feature (1)..(221): Pfam Name: Aldose_epim Pfam Description: Aldose 1-epimerase
MQFGTHGNLEQHGFARNRFWTIDNDPPPLPANPAIKAYVDLILRPSEEDLKIWPHSFEFRLRVALGPSGDLSLTSRIRNTNTDGRPFSYTFAYHTYFSVSDISEVRVEGLETMDYLDNLKAKERFTEQGDAIVFESEIDKVYLAAPSKIAIIDHEKKKTFVVTKEGLPDAVVWNPWDKKAKAMQDFGDGEYKNMLCVEPASVEKPITLKPGEEWKGRLALSAVPSSYCSGQLDPLKVLQG

SEQ ID NO: 13878 - DNA, 580 bp, Panicum virgatum
  misc_feature: Ceres CLONE 1771411
  misc_feature: Encodes the peptide sequence at SEQ ID NO. 13879
ctctccctctctctactctttcatatccagcgagagaggcaggtcggcagcttatcgttagcgcgtgcctccccatggcttgcaccttgatgggcgtccgccacctcgcgcttcatgcgggcctccggcttgccctgggggggcatctgccgcgaccttttcgagacgatgcccggcgggcctcagggcacgatgctcctggggctggcccaggagaagaccgccgggccggtcgaggcggcggcggagggcgaggacaccgcccacgcctgcccgtgcggcaacaactgcccctgcaacccctgcaactgctgatttcaatgggaaaccccgaaaaggacctgcttgtgtgctaactacatcgtcctactctgcttgtgtgatactgactcattgaaccactacccggaggagccggagctcatcatgtctcatcgtatccggttgtctcccgactcatcacgcatgcatgcatattctgcacctctgtgtaccttgcatcctggctggctggatgtgttgatcattgcacaacaaccatggaggcatacctctctctctgtgtttctgatgtgatcgc

SEQ ID NO: 13879 - protein, 66 aa, Panicum virgatum
  misc_feature: Ceres CLONE 1771411
  misc_feature (11)..(66): Pfam Name: Metallothio_2 Pfam Description: Metallothionein
MRASGLPWGGICRDLFETMPGGPQGTMLLGLAQEKTAGPVEAAAEGEDTAHACPCGNNCPCNPCNC

SEQ ID NO: 13880 - DNA, 534 bp, Panicum virgatum
  misc_feature: Ceres CLONE 1771430
  misc_feature: Encodes the peptide sequence at SEQ ID NO. 13881
acccccgcttcgactcgctcccctctgatccgctcggccgcgtcgcagggcgcagcgttgatggcaacggcaccggcgccggcggacccgaaggcggaggcggccaagatggacctcctggaggacgacgacgagttcgaggagttcgagatcgaccaagaatgggacgacaaggaagaaggcaatgaagctgtccagcagtgggaggacgactgggatgatgatgacgttaatgatgatttctcgcagcagctgaggaaagaactggagggagcccagaagagctgaagtgttttcttccgtagtataaatgttactcttgtatggccgttactttctgaaccgctgtgtgcttcagacagttatgggtgcgcgtctgggagcaccacctaatttgcggaatatttctacagggaagtttatggtcgtgctgtagtttccatattatcagtgaatttctatatgaacggcatgagtatgataccagaaagtttataaatatgcggcaatttgcccctcaatcaagttgaagcc

SEQ ID NO: 13881 - protein, 75 aa, Panicum virgatum; identical to SEQ ID NO: 13071
  misc_feature: Ceres CLONE 1771430
  misc_feature (10)..(72): Pfam Name: DSS1_SEM1 Pfam Description: DSS1/SEM1 family

SEQ ID NO: 13882 - DNA, 421 bp, Panicum virgatum
  misc_feature: Ceres CLONE 1771432
  misc_feature: Encodes the peptide sequence at SEQ ID NO. 13883
gtcttgttcgatggatgactctcgcgccctcgccgctactggcgcctgttccgtcttccccggcgccgcagccatgccgggccgcgacaccgtccggatcgcgacgaagatggccaaaaagcgtcgccggaacccccccatcccctactggatccgaatgcgcaccaccaacaccagcaggcacaacacgaaccgcatgcactggcgccgcaccaagctccgattcggagcgggggaagagatgacgggcaccgatgcttggggaaaatggaatttacgagccggcctcgcgacgcttccttgtttccgcatgcgagcggacctcttgtttagatcttgcttgtgtccatttgatgtcatcagttgctcctgtatcctaccgacaataccatgctatgcggatggttgaagaacacccttt

SEQ ID NO: 13883 - protein, 111 aa, Panicum virgatum
  misc_feature: Ceres CLONE 1771432
  misc_feature (9)..(51): Pfam Name: Ribosomal_L39 Pfam Description: Ribosomal L39 protein
MPGRDTVRIATKMAKKRRRNPPIPYWIRMRTTNTSRHNTNRMHWRRTKLRFGAGEEMTGTDAWGKWNLRAGLATLPCFRMRADLLFRSCLCPFDVISCSCILPTIPCYADG

SEQ ID NO: 13884 - DNA, 636 bp, Panicum virgatum
  misc_feature: Ceres CLONE 1771436
  misc_feature: Encodes the peptide sequence at SEQ ID NO. 13885
attgcactacaacacctatgcgttcttcatcgatttggcacagccatcatctagctaggagctcacaattaagttcaaccccgggcagctatatggcggcgatcaccggtggaagggcggcgctcgcggtggccgcgctcctctgcgccatggcggcgatggccgctgcgcagcaggcctccaacgtgcgcgcgacgtaccacctgtacaacccggcgcagaacggctgggacctcaaccgcgtcagcgcctactgcgccacgtgggacgccaacaagccgctgtcgtggcggcagaagtacggctggaccgccttctgcgggccctcgggccctaggggccaggcctcctgcggcaagtgcatcaaggtgacgaaccgtgcgacgggcgcatcgaccgtggcgaggatcgtggaccagtgcagcaatggcggcctggacctggacttcgagacggtgttcaagaagattgacaccaacgggcaaggctaccagatgggccacctcaacgtcgactaccagttcgtctcctgctgagtgagctttgcgcacgcacgatcgaccgggcaggaacctggaggatgtaataataattaagcatttaagcgcctcgcctagatgtgtggtgtgatggaat

SEQ ID NO: 13885 - protein, 147 aa, Panicum virgatum
  misc_feature: Ceres CLONE 1771436
  misc_feature (28)..(147): Pfam Name: Barwin Pfam Description: Barwin family
MAAITGGRAALAVAALLCAMAAMAAAQQASNVRATYHLYNPAQNGWDLNRVSAYCATWDANKPLSWRQKYGWTAFCGPSGPRGQASCGKCIKVTNRATGASTVARIVDQCSNGGLDLDFETVFKKIDTNGQGYQMGHLNVDYQFVSC

SEQ ID NO: 13886 - DNA, 507 bp, Panicum virgatum
  misc_feature: Ceres CLONE 1771441
  misc_feature: Encodes the peptide sequence at SEQ ID NO. 13887
gccgccgacatcctcaaggactgctccaaggcagccgccaggatcatcggcaagccggaatcctacgtcatggtgtcgataaacgggtcggtgcccatgtcgttcgcgacgagcgaggaaccggcggcgtacggtgagctcgtctccattggcgggatcggccccggcgtcaacgggaagctgagcgcggccgtggccgagatccttttttctaagctctcggccagcaggtccagattctacatcaaattcgatgacgtgcattttttcttccccccccccaacggatcgacattctaaagaaaaccccaggagagaatggtgatcgcttcgtcccaagcaaccacctcaacctgcccacacataccaccatcagttcttcgtcaataaacggggatggtcaagtgcttcatttgtatctcctacacctccaatggatattctgctcatgtgtgagacagcactaaattatatgctttatttcaactgaagaatgcagcccagcat

SEQ ID NO: 13887 - protein, 99 aa, Panicum virgatum
  misc_feature: Ceres CLONE 1771441
  misc_feature (1)..(99): Pfam Name: MIF Pfam Description: Macrophage migration inhibitory factor (MIF)
  misc_feature: SWISSPROT Homolog: EC 5.3.2.1 Phenylpyruvate tautomerase
AADILKDCSKAAARIIGKPESYVMVSINGSVPMSFATSEEPAAYGELVSIGGIGPGVNGKLSAAVAEILFSKLSASRSRFYIKFDDVHFFFPPPNGSTF

SEQ ID NO: 13888 - DNA, 632 bp, Panicum virgatum
  misc_feature: Ceres CLONE 1771442
  misc_feature: Encodes the peptide sequence at SEQ ID NO. 13889
aatagatctagcaataatggccaccggcctcaggagacgccgagacgccagccagcagcttctccggcgtccgcgctgccccggaacccgaggcgcccgccatcgtcgccatgcccgccgccaagcaccaggtagcccgcggcgccaggctgcgcgcccagccgacctacaacgtgaagctcgtaacgcccgacggcgaggtggagctgcaggtgcccgacgacgtgtacatccaggaccaagcagaggaggaggggatcgaccttccctactcgtgccgcgacgggtcctgctcctcctgcgccggcaaggtcgtctccggctccatataccagacagaccagaccttcctcgacgacgaccagttcgccagcggctgggtgctcacctgccacgcctaccccacctccgacgatcgtcatcgagacacacaaggaagaggagctcaccgcttaatatacaattaattaacctcgctccatcgtgcgacgatatatatcatcatcatctattatatctcaatctgcctgccttgcaagagatgttgtaaccgatcgagtagacgaatccggccgccggagaagattcttcctagctataatttgtatcatccatcatgcatgtcgatcaag

SEQ ID NO: 13889 - protein, 118 aa, Panicum virgatum
  misc_feature: Ceres CLONE 1771442
  misc_feature (25)..(100): Pfam Name: Fer2 Pfam Description: 2Fe-2S iron-sulfur cluster binding domain
  misc_feature: SWISSPROT Homolog: EC 1.14.13.7 Phenol 2-monooxygenase
MPAAKHQVARGARLRAQPTYNVKLVTPDGEVELQVPDDVYIQDQAEEEGIDLPYSCRDGSCSSCAGKVVSGSIYQTDQTFLDDDQFASGWVLTCHAYPTSDDRHRDTQGRGAHRLIYN

SEQ ID NO: 13890 - DNA, 674 bp, Panicum virgatum
  misc_feature: Ceres CLONE 1771461
  misc_feature: Encodes the peptide sequence at SEQ ID NO. 13891
aattccactccgtccatccatccgccatggtgacggccacgctgctgagctcctccttcgccatgcccgccgccgccgcccggagggcctcctcctcttcctccacctccctgggcttcgccacgtcgcagctcgccggcctttccctctccgccgccgcgcccacttcaaccgccgcggcccccctccacaagaggccgctccagcccatcgtcgcgcgccgggtgtgccccttcactgacaagaagacgaaccgggcgaacaaagtgtccttctccaaccacaagacgaagaagcagcagttcgtgaacctgcagtacaagaagctgtggtgggaggccggcaagcgctacgtcaaactgcgcctctccaccaaggccctcaagaccatcgagaagcacggcctcgacgccgtcgcgcgcaaggccggcatcgacctcaacaagaagtgagccgagcttgagtagtcactagagtctcgtctgtctcaatgtctgctgctcattcagtcatacagtattttttcctttcctccctaatttgatttgcatcctaccaatgtaggcagatcgaggttgcgtatatttttattctatggaaagagttgaggtttcttcgtcttgatcaatcttgtctccatttcgtaattgtgatcgattgggagaaagttaact

SEQ ID NO: 13891 - protein, 141 aa, Panicum virgatum
  misc_feature: Ceres CLONE 1771461
  misc_feature (66)..(126): Pfam Name: Ribosomal_L28 Pfam Description: Ribosomal L28 family
MVTATLLSSSFAMPAAAARRASSSSSTSLGFATSQLAGLSLSAAAPTSTAAAPLHKRPLQPIVARRVCPFTDKKTNRANKVSFSNHKTKKQQFVNLQYKKLWWEAGKRYVKLRLSTKALKTIEKHGLDAVARKAGIDLNKK

SEQ ID NO: 13892 - DNA, 465 bp, Panicum virgatum
  misc_feature: Ceres CLONE 1771472
  misc_feature: Encodes the peptide sequence at SEQ ID NO. 13893
actgccgctccaactgcaagaggggcaagatcaccccgaccgtgaagagaagagcaacggcggcccacaagccaccatcctcctctgcgtgcccccggacaacaaggccggccatttcgaggcggtagcccagtccggcaagaccgcccacccctgcaagtgcgggaacagctgcatctgcgacccctgcaactgctgatttcgatggggaacgtcagaactctcctgcatgcatgctacctactacctactactctgcttgtgtgtgactggatgattgaacaagaataaagatgagcctgatccatcatgtctcatgcatccgtttggctccggcctcatcaagcatgcatgcctccaccgcccctctgagtgctttgcgtccgtcctgtctgtatgtgttgatcattgcaaagaaaccatgcaggcatacacctctgcctcgtgtctcttgtcctgatccgg

SEQ ID NO: 13893 - protein, 65 aa, Panicum virgatum
  misc_feature: Ceres CLONE 1771472
  misc_feature (7)..(65): Pfam Name: Metallothio_2 Pfam Description: Metallothionein
LPLQLQEGQDHPDREEKSNGGPQATILLCVPPDNKAGHFEAVAQSGKTAHPCKCGNSCICDPCNC

SEQ ID NO: 13894 - DNA, 813 bp, Panicum virgatum
  misc_feature: Ceres CLONE 1771495
  misc_feature: Encodes the peptide sequence at SEQ ID NO. 13895
gcatctcgcttcgatttcgatctcctgccttgcattattgatctcctagctgcttgctcgtttcgctcctctttaattatttgctcgatcgaacgacggcaatggcgtccggtggcgcgtcgctggccttggccgcgctgctcctcgtgggctgcgtcgcggcggcggcggcgaccaagtacaccgtcggcgacgcctccggctggacgaccaccggcgattactccacctgggccagcggcaagaaattcaaagtcggcgacactctccagttcacgtacgccggcggcgcgcacacggtggacgaggtgagcgcggcggactacacctcctgctcctccagcaacgcgctcagcagcgacagcgccggctccaccaccgtgaccctcaagacggccggcaagcactacttcatctgcggcgtcgcgggccactgcagcagcggcatgaagctcgtggtggacgtcgccgcggccaagacgtcgcccgcccccgttccggcgccggcgccggccgcggccccggacgccgcggacaccacccctgacgccactcccgacacgaccacgacccccaagtcgccctcgagctccggcggcgccacggccaagaccccggtcacggtcctctcgccgccggccaagaagtccacctccggcgccgccgtgctcagcgccgccgcgtggsscggcgtgggsctggccgggctcgtggccgtgcccctcggcgcgttctagggcccacggccagggcggaggcactgcttgcttgttttattctcgttttattttcatattaaataggatgcacgcc

SEQ ID NO: 13895 - protein, 211 aa, Panicum virgatum
  misc_feature: Ceres CLONE 1771495
  misc_feature (35)..(116): Pfam Name: Cu_bind_like Pfam Description: Plastocyanin-like domain
  misc_feature (196)..(196): Xaa is any aa, unknown, or other
MASGGASLALAALLLVGCVAAAAATKYTVGDASGWTTTGDYSTWASGKKFKVGDTLQFTYAGGAHTVDEVSAADYTSCSSSNALSSDSAGSTTVTLKTAGKHYFICGVAGHCSSGMKLVVDVAAAKTSPAPVPAPAPAAAPDAADTTPDATPDTTTTPKSPSSSGGATAKTPVTVLSPPAKKSTSGAAVLSAAAWXGVGLAGLVAVPLGAF

SEQ ID NO: 13896 - DNA, 567 bp, Panicum virgatum
  misc_feature: Ceres CLONE 1771501
  misc_feature: Encodes the peptide sequence at SEQ ID NO. 13897
aagaaaggccttgcaaaacctggccatattggtatatatggttggagctatggcgggtttctgtccgcaatgtgcctcgcaaggtttccagatacattctgttgtgcggtgtctggtgctccagtgacggcatgggatggttacgataccttttacactgagaagttcatgggtctcccctccgagcatcccgatgcttatgagtatgggtcgatcatgcatcacacaaagaacctgaaagggaaactgctcctcatccacgggatgattgatgagaacgtgcattttaggcacacagcgaggcttatcaactcgctgatggcggagggcaaggcttatgagatcctcctcttccctgacgagaggcacatgccacgccggctcggtgaccggatctacatggaggagaggatctgggattttgtagagaggagcctttgaaagaacgcttgtataaattcaattgcccattgtgggctgggattgggatgtttttggcacatgcattcagttcttttttcattcccacctgtaatttatctacaagcgaagttattttgattcttt

SEQ ID NO: 13897 - protein, 146 aa, Panicum virgatum
  misc_feature: Ceres CLONE 1771501
  misc_feature (2)..(145): Pfam Name: Peptidase_S9 Pfam Description: Prolyl oligopeptidase family
  misc_feature: SWISSPROT Homolog: EC 3.4.14.5 Dipeptidyl-peptidase IV
  misc_feature: Useful for making plants with modulated salt sensitivity
KKGLAKPGHIGIYGWSYGGFLSAMCLARFPDTFCCAVSGAPVTAWDGYDTFYTEKFMGLPSEHPDAYEYGSIMHHTKNLKGKLLLIHGMIDENVHFRHTARLINSLMAEGKAYEILLFPDERHMPRRLGDRIYMEERIWDFVERSL

SEQ ID NO: 13898 - DNA, 664 bp, Panicum virgatum
  misc_feature: Ceres CLONE 1771503
  misc_feature: Encodes the peptide sequence at SEQ ID NO. 13899
gctaatcacagaggaagaccgtgtgaaaaccgaagcggcagcagcagcaatggcggcatccatgatcacgtcgtcagctctggtggcgccggccagggcccagggcctgccgtccctcggccgccgcgcctcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggaaccaccggacttctgatctgggccgtcaccctcgccgggctccttggcggcggcgccctccttgtttacaacaccagcgccctcgccagctaagaacactattcatgcatagtccatgcaagcgcttgtggttcatgtaagatcagctcgggtgtctgtcgtctgtaatctagcctgcagctttgatgcgcaatataatgcttggttcatgtaacaatgctactacggctctccatacttttgggacagttattatattaattacttgatgctatatatttagataaatatataactagtaactttatttct

SEQ ID NO: 13899 - protein, 131 aa, Panicum virgatum
  misc_feature: Ceres CLONE 1771503
  misc_feature (35)..(131): Pfam Name: PsbR Pfam Description: Photosystem II 10 kDa polypeptide PsbR
MAASMITSSALVAPARAQGLPSLGRRASSFAVVCGTGKKIKTDKPFGIGGGLTVDHDASGRKVKGKGVYQFVDKYGANVDGYSPIYKEEDWSPTGDVYVGGTTGLLIWAVTLAGLLGGGALLVYNTSALAS

SEQ ID NO: 13900 - DNA, 721 bp, Panicum virgatum
  misc_feature: Ceres CLONE 1771521
  misc_feature: Encodes the peptide sequence at SEQ ID NO. 13901
aacctcccctccaagacaagagcgccgctacaacaccaggaccgggccttgcccctcgtctcctcccctcgtccccgatagccgcctctcccggtctcccccaactcgtgccctctcctcggatctctccgtcggccacaaccaaaagatccccatggcggcgctggggtcgaagctggcgcagctgcaatccaaggcgtgcgaggcgacgaggttcgtggcaaagcacggctgcgcgtaccacaagacgctcatggagaagaacaagcaccacgtcgtcgacccgcccaccatccagaagtgccaggagctctccaagcagctcttctacacccgcctcgcgagccttcctggtcgttacgaggcattctggaaggagcttgatagcgcaaagctcttgtggaaaaacagaaacaacctgaaggttaaggatgttggcgtcgcagcattgtttggcatcgagttgtatgcttggtcctgcctcggtgagatcgttgggagaggatttactcttacgggctaccatgtctgaagccttacctctagcatgaacaatcacattagtccacatttgccgacaaatactgtgtcggtggtcagttttactctgacatgaatcctgtgatgcaaagttttggtattctcaaatactcttgaaccttgatgccgtagaactacattgatctcggtggaaagagaaataatgagctaataatttgct

SEQ ID NO: 13901 - protein, 125 aa, Panicum virgatum
  misc_feature: Ceres CLONE 1771521
  misc_feature (11)..(125): Pfam Name: ATP-synt_G Pfam Description: Mitochondrial ATP synthase g subunit
MAALGSKLAQLQSKACEATRFVAKHGCAYHKTLMEKNKHHVVDPPTIQKCQELSKQLFYTRLASLPGRYEAFWKELDSAKLLWKNRNNLKVKDVGVAALFGIELYAWSCLGEIVGRGFTLTGYHV

SEQ ID NO: 13902 - DNA, 778 bp, Panicum virgatum
  misc_feature: Ceres CLONE 1771576
  misc_feature: Encodes the peptide sequence at SEQ ID NO. 13903
agcctgctccctctccctctccctctctctctctagtctagtccaccaccaaccattatggcctccctctcctctgccgccgtcaccgccccttccttcgcggcttcccggcccgcccgcgccgctgccaggcgctctgctgccttcaccgtgcgcgcctcgctcggcaaggccgccggcaccgccgccgtggccgtggccgccagcgccctgctcgccggcggcgccatggcccaggaagtgctgctcggcgccaacggaggcgtcctcgtcttcgagcccagcgagttcaccgtcaaggccggcgaggccatcaccttcaagaacaacgccgggtaccctcacaacgtggtcttcgacgaggacgaggtgcccagcggcgtcgacgccgccaagatctcgcaggaggagtacctcaacgcgccgggcgagacctactccgtcacgctcaccgtgccgggaacctacggattctactgcgagccgcaccaaggagccgggatggtcggcaaggtcaccgtcaactgatgcgatgccatgccatgccatgatcgagtatatatattcaagcgtatctgcgtatgtacgtaccaggctataggctagctagctagagagcttagcttgccactcagatcagtcatcatctccatcttgtaccaagtggcatgcatgcatgcatgcatgctattacttcatcatatttatatcatcggcattgccttgcttcttttactcttttcactattctactattattatagaatacacattacac

SEQ ID NO: 13903 - protein, 156 aa, Panicum virgatum
  misc_feature: Ceres CLONE 1771576
  misc_feature (60)..(156): Pfam Name: Copper-bind Pfam Description: Copper binding proteins, plastocyanin/azurin family
  misc_feature: Useful for making plants with modulated nitrogen use efficiency
MASLSSAAVTAPSFAASRPARAAARRSAAFTVRASLGKAAGTAAVAVAASALLAGGAMAQEVLLGANGGVLVFEPSEFTVKAGEAITFKNNAGYPHNVVFDEDEVPSGVDAAKISQEEYLNAPGETYSVTLTVPGTYGFYCEPHQGAGMVGKVTVN

SEQ ID NO: 13904 - DNA, 556 bp, Panicum virgatum
  misc_feature: Ceres CLONE 1771589
  misc_feature: Encodes the peptide sequence at SEQ ID NO. 13905
gttgcagcgccgccgccgccgccgccgcctccatctagggcgcattccccactcctcgtcgccgccgagcttgagcgagccctgcaagatggtgctccagaacgacatcgacctgctcaaccccccggcggagctcgagaagctcaagcacaagaagaagcgcctcgtccagtcccccaactctttcttcatggacgtcaagtgccagggatgcttcagcataaccactgttttcagccactcccagactgttgtggtgtgcccgggctgccaaactgtcctctgccagcccactggaggaaaggctaggctcacggagggctgctccttccgccggaagggagactagaatgtagtctggaaaatcatgtttgtgctgagccaagtttttcacttgagtatgtagccgtcaaattttgtgctatgtgaaatgttagggccctgaactactgcttactataaggctttcaatattcctatgttatgtactggatactactactcaatgttctgtttggcacctgctttatctaattagctggggttgttttggatt

SEQ ID NO: 13905 - protein, 86 aa, Panicum virgatum; identical to SEQ ID NO: 9875
  misc_feature: Ceres CLONE 1771589
  misc_feature (30)..(84): Pfam Name: Ribosomal_S27e Pfam Description: Ribosomal protein S27

SEQ ID NO: 13906 - DNA, 481 bp, Panicum virgatum
  misc_feature: Ceres CLONE 1771625
  misc_feature: Encodes the peptide sequence at SEQ ID NO. 13907
ttcttcaagggctcctactccaactggcccatcggcgtcaaccgctacgaatacgaccagctcagggcgccggttgggagggtttacttcaccggtgagcacaccagcgagtactacaacggctatgtccacggagcataccttgcaggtgtcgactctgcggacatcctgatcaaccgcatcttcaagaacgaggagtacgaggtccgtggcaagtacgacaaccaagctgcagaggctaaatgaatgaccatgatgagctgacgtgccctgctacaccacaccagctcgatcatcaagggaataatgataagctactcgtcgagatgaaatcatgatgccttttttttcagtaaaacttttttttcaggctttaattcgcttcccagtcggtggttcatacgtttctgtcttgtgttctcggatgtattttctgccgtcgtaataaaagcgcaggcactctgctcctgtttactggttt

SEQ ID NO: 13907 - protein, 81 aa, Panicum virgatum
  misc_feature: Ceres CLONE 1771625
  misc_feature: SWISSPROT Homolog: EC 1.5.3.11 Polyamine oxidase
FFKGSYSNWPIGVNRYEYDQLRAPVGRVYFTGEHTSEYYNGYVHGAYLAGVDSADILINRIFKNEEYEVRGKYDNQAAEAK

SEQ ID NO: 13908 - DNA, 526 bp, Panicum virgatum
  misc_feature: Ceres CLONE 1771635
  misc_feature: Encodes the peptide sequence at SEQ ID NO. 13909
ctcctcacaccacgccgtgccacgaatccctttgatcctcctgcgcgccctggccaccgcgtctctgtccgccgtcgcgtcgccgctgtccgtcgccgggctctctaagccgctcggcgccgcggcgtcgtcgttccagcccctgcagccgagggcgaggccggccgccaggatggccgtgcgggcgtcggcggcgtccatgaaggagaaggcggcggccgggctgaccgcggcggccgtggcggcggctctcgtgctgcctgacgtcgctgaggccgcgcagtccgggctgacgccgtcgctcaagaacttcctgctcagcatcgtgtccgttttggtcgtcctcgtggccatcgtcggcgccgtcgtcgccgtctccaactttgattttttttcgcccgcctgagggatcattcgttcgttaggaggcacgtctccccctgtatcatgtatccagcggtaaaccgttctgtgttattttggaggatgttcgaacttatttatgatacggagttcgagttaaacc

SEQ ID NO: 13909 - protein, 134 aa, Panicum virgatum
  misc_feature: Ceres CLONE 1771635
  misc_feature: Useful for making plants with modulated nitrogen use efficiency
SSHHAVPRIPLILLRALATASLSAVASPLSVAGLSKPLGAAASSFQPLQPRARPAARMAVRASAASMKEKAAAGLTAAAVAAALVLPDVAEAAQSGLTPSLKNFLLSIVSVLVVLVAIVGAVVAVSNFDFFSPA

SEQ ID NO: 13910 - DNA, 819 bp, Panicum virgatum
  misc_feature: Ceres CLONE 1771660
  misc_feature: Encodes the peptide sequence at SEQ ID NO. 13911
acagagagcccacggtccgtgtccgcgcgaaccaacgcgaggaagaagagtctctcgaggagagaggacgggagggagagaaggaaaggaagcgagcagtaagcaggggtctaccgagcggcggcgaggatgaggggtggcggcggcgggatgatggacgacgaagaccgggtgacccacgcgcagatcccgaccagcttcggccccgagctgcgggcctgcctccgatgccgcctcgtcaagacctacgaccagttcaggcagaacggctgcgagaactgcccgttcctggagatggacaaggagcacgacaatgtggtcaactgcactacgccgaacttcactggaataatctctctgatggaccccagtaggagttgggctgctcgttggttgagaattggtaggttcattccagggtgctacacactggcagtctcagaggagcttccggaagagtaccaggggatttgccaggacaacaacgtgcagtacgtgccgcccaagcgtgtctaaggttcagcatctttaaaagacgaaagctgaccctggaatcaggcccaaatcgcacgtccgttgggccacgtcatccgaatttgtacatcgtccgatcacagcttactatttctccatcgttgatctcatacttcgtcgcacgtgtttccagactgttcgtgacttcgcgcgacctgctgtcacagactcctctaccagcagcgcctcccacgtcatccgcttccagcgaccgaaaggcccgactggccgtacttgtacccgctaaagctgctaatgggcccaaactaaggggcgattagttcc

SEQ ID NO: 13911 - protein, 128 aa, Panicum virgatum
  misc_feature: Ceres CLONE 1771660
  misc_feature (26)..(128): Pfam Name: Spt4 Pfam Description: Transcription elongation protein Spt4
MRGGGGGMMDDEDRVTHAQIPTSFGPELRACLRCRLVKTYDQFRQNGCENCPFLEMDKEHDNVVNCTTPNFTGIISLMDPSRSWAARWLRIGRFIPGCYTLAVSEELPEEYQGICQDNNVQYVPPKRV

SEQ ID NO: 13912 - DNA, 703 bp, Panicum virgatum
  misc_feature: Ceres CLONE 1771662
  misc_feature: Encodes the peptide sequence at SEQ ID NO. 13913
ggcggagcagcaggcggcggacgaggcgccggtcgtcgaggacgtcaaggaggacgatgacgatgacgatgaagacgacgacgacgaagctgatgatggtgatctcggtgcaggggcaaccgagggctccaagcagagccggagcgagaagaagagccgcaaggccatgatgaagctcggaatgaaacccgtcaccggcgtcagcaggataaccatcaaaagagccaagaacatactgttcgtggtgtccaagcctgacgtgttcaagagcccgacgtcggagacgtacgtgatattcggcgaggccaagatcgaggacctgagctcgcagctgcaggcccaggccgcgcagcagttcaggatgcaggacctcagcaaggcgacggccaagcaggacgcggcggccgcggcgccggccgacgaggaggagggggaggtggacgagaccgggatcgagccccgcgacatcgacctcgtcatgacgcaggccagcgtgtcgcgggccaaggccgtcaaggctctcaaagcgcacgacggcgacatcgtcagcgccatcatggagctcacggcctagaccgagaccgacccttggtcgctgcttgcccgcagccttgcttgctacttcgtcgtcggagaacacccgatggaaatggaatcagatgttttcatttaattttggggattttgcataagaatgttttct

SEQ ID NO: 13913 - protein, 190 aa, Panicum virgatum
  misc_feature: Ceres CLONE 1771662
  misc_feature (47)..(106): Pfam Name: NAC Pfam Description: NAC domain
  misc_feature (151)..(188): Pfam Name: UBA Pfam Description: UBA/TS-N domain
AEQQAADEAPVVEDVKEDDDDDDEDDDDEADDGDLGAGATEGSKQSRSEKKSRKAMMKLGMKPVTGVSRITIKRAKNILFVVSKPDVFKSPTSETYVIFGEAKIEDLSSQLQAQAAQQFRMQDLSKATAKQDAAAAAPADEEEGEVDETGIEPRDIDLVMTQASVSRAKAVKALKAHDGDIVSAIMELTA

SEQ ID NO: 13914 - DNA, 504 bp, Panicum virgatum
  misc_feature: Ceres CLONE 1771686
  misc_feature: Encodes the peptide sequence at SEQ ID NO. 13915
  misc_feature (261)..(261): n is a, c, t, g, unknown, or other
ggcgctgcacgccgcccccgccggcggcaaggacaggccccccgaaggcagcagctacgcgccggccaagcgggccgccgccgcgccgcagcccgccggccgcgccgccacgcggcggccgcggcacgccagccagcccaagaacgccggcgacgaagggcggggggcggacgagaagaacagggacgggacggcgacggcgcgcgagacgccggcgccggcggagcgcagggcgccgcggcgcgggccgcgccggacgancgcgcttttgatcgacgagctggccaaggactacgccggccagatcaagtgctgcaaggtgtttttttaccacccccccaacgtggcctccacctacggcatccgcagcatccccaccgtgctcatcttcaagggcggcgagaagaaggagagcgtcatcggcgccgtgcccaagaccacgctcaccaccatcgtcgacaagtacatcggcagctcgggagccagacaactataaatacaaac

SEQ ID NO: 13915 - protein, 164 aa, Panicum virgatum
  misc_feature: Ceres CLONE 1771686
  misc_feature (69)..(155): Pfam Name: Thioredoxin Pfam Description: Thioredoxin
  misc_feature: SWISSPROT Homolog: EC 1.8.1.8 Protein-disulfide reductase
  misc_feature (87)..(87): Xaa is any aa, unknown, or other
ALHAAPAGGKDRPPEGSSYAPAKRAAAAPQPAGRAATRRPRHASQPKNAGDEGRGADEKNRDGTATARETPAPAERRAPRRGPRRTXALLIDELAKDYAGQIKCCKVFFYHPPNVASTYGIRSIPTVLIFKGGEKKESVIGAVPKTTLTTIVDKYIGSSGARQL

SEQ ID NO: 13916 - DNA, 692 bp, Panicum virgatum
  misc_feature: Ceres CLONE 1771693
  misc_feature: Encodes the peptide sequence at SEQ ID NO. 13917
cttcccgggctcccggcccgcgcgctgttcacattaatatttctgccaagaaaggaaaacctcatctcatctcatctcatctcatctatctagagttgaacctgagcaagcaagcagccagcagcctctcctcgatctggtgttcatatggctcagaaggtggtgctccgagtcccggccatgaccgacgacaagacgaagcagaaagccatggaagccgtagcagaaatctacggcatcgactcgatcgcagcagacctcaaggacaacaagatgacagtgatcggcgacatggacacggtggccatcgccaagaagctcaagaagctggggaagatcgacatcgtctcggtgggccccgccaaggaggagaagaagccggagaagaaggacgagaagaaagaggagaagaaggatgagaatagtaagaagccgacgaagggggagaagcagaaggacaagaagtgaagaagggagggagaaaaactctcgatcggtctaaatataatgaaggaagccaaggggatcacgtatgcaagagcaccgtatccggcgaaaatatatcttttttattttacaaaaatttatcttgactagtttgtttcagctgagacgtactcctactcctacctgagagtgagagctgatctctgtgtgtccccgttattattgttgccgatcgaaacgctttg

SEQ ID NO: 13917 - protein, 106 aa, Panicum virgatum
  misc_feature: Ceres CLONE 1771693
  misc_feature (6)..(73): Pfam Name: HMA Pfam Description: Heavy-metal-associated domain
MAQKVVLRVPAMTDDKTKQKAMEAVAEIYGIDSIAADLKDNKMTVIGDMDTVAIAKKLKKLGKIDIVSVGPAKEEKKPEKKDEKKEEKKDENSKKPTKGEKQKDKK

SEQ ID NO: 13918 - DNA, 526 bp, Panicum virgatum
  misc_feature: Ceres CLONE 1771725
  misc_feature: Encodes the peptide sequence at SEQ ID NO. 13919
aaaccctagccgccgccggaccactcgtcgccctcctctcctccgcgagcgctcgcttcgttgtgctggtcgaaggaagcaagggattcgagatggccaagtcgaagaaccacacggcgcacaaccagtcgtacaaggcgcacaagaacggcatcaagaagcccaagcgccaccgccagacctccaccaaggggatggaccccaagttcctgaggaacctgaggtactcaagaaagaacaacaagaagagcggtgaggctgaagcggaggagtaagatggaagtttatgctcttacaaaagcaaagatgtgtttacccttcctagctcagtttttacctttaggatctggattttctttactctaaggatggaatttgaatggtgttatgtatgatgggaaggaccctcttttgctgctgaagtgttactatgatattatgtgttaagctcatgctaccctttgaatagttccttctgagttaattagttttccccccgtgggaactgaaatatgatttctggatc

SEQ ID NO: 13919 - protein, 60 aa, Panicum virgatum
  misc_feature: Ceres CLONE 1771725
  misc_feature (3)..(42): Pfam Name: Ribosomal_L29e Pfam Description: Ribosomal L29e protein family
MAKSKNHTAHNQSYKAHKNGIKKPKRHRQTSTKGMDPKFLRNLRYSRKNNKKSGEAEAEE

SEQ ID NO: 13920 - DNA, 665 bp, Panicum virgatum
  misc_feature: Ceres CLONE 1771748
  misc_feature: Encodes the peptide sequence at SEQ ID NO. 13921
ataaaacaggcctatgaaagtttaactgatggatttggaaggactgcctctgctttgatcgccaatcctattaaagtttataaccgggctggtcctggatcttccctggctactgcaatttgtggagcaccagctgctgcagtagctccagtatcggcatctgcgcgtgctgtccattgtgcacttgttgggcttaggaacagtcttgatcctgagcacaagaaagaatccatgtacaaatacaatggaccttcgcaattgtagacttcattcagaagaagaggtgccccttcattcttttgcacgccttacgtcatctctatcttgtattaactggttggggagcacctgtgctgcagtctcgtccagtggtgagaggcaatttttttttttccccccagatcgttggacagattagatgtgccgtcaaacccttccacaccttgtaatttaaacacaggagggtcgtaattacctctcgccgtttcaattgcctaggctggtggaagttttgtaacaccccttttcggtagctggggaaggacctggggccggcatgactggccccactactgtacatatatggttgccctgtgagttgagtgcatgtaaatatctcttttgcttcggttgttacttttgagtgtgcctggtaggttgccaaa

SEQ ID NO: 13921 - protein, 87 aa, Panicum virgatum
  misc_feature: Ceres CLONE 1771748
  misc_feature (1)..(82): Pfam Name: ATG_C Pfam Description: ATG C terminal domain
IKQAYESLTDGFGRTASALIANPIKVYNRAGPGSSLATAICGAPAAAVAPVSASARAVHCALVGLRNSLDPEHKKESMYKYNGPSQL

SEQ ID NO: 13922 - DNA, 304 bp, Panicum virgatum
  misc_feature: Ceres CLONE 1771751
  misc_feature: Encodes the peptide sequence at SEQ ID NO. 13923
ccttcaaggcgaccgaagatctccgagcgaagcaaccgagagatgataagacgaagatgtgtccgatgatcaagaccccgatgagcgccgccgagtcgagcccgccgtgcagctgggcgtcgacctcaacctcgtcgccggagcaggggcgccaccagacggtgtggacccccccccccaagaagccggcggggcggaccaagttccgggagacgcggcaccccgtgttccgcggcgtccgtcgccgcggcaacgccgggcggtgggtgtgcgaggtgcgcgtgccgggccgccgcggctgttt

SEQ ID NO: 13923 - protein, 82 aa, Panicum virgatum
  misc_feature: Ceres CLONE 1771751
  misc_feature: The sequence is a functional homolog of SEQ ID NO 1248 in the 10/374,780 US patent application
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 2 in US patent 7138277
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 752 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: The sequence is a functional homolog of SEQ ID NO 1222 in the 10/374,780 US patent application
  misc_feature: The sequence is a functional homolog of SEQ ID NO 1411 in the 10/412,699 US patent application
  misc_feature: The sequence is a functional homolog of SEQ ID NO 712 in the 11/435,388 US patent application
  misc_feature: The sequence is a functional homolog of SEQ ID NO 780 in the 11/435,388 US patent application
  misc_feature: The sequence is a functional homolog of SEQ ID NO 692 in the 11/435,388 US patent application
  misc_feature: Useful for making plants with altered terpenoid content
  misc_feature: Useful for making plants with modulated flowering time
  misc_feature: The sequence is a functional homolog of SEQ ID NO 1243 in the 10/374,780 US patent application
  misc_feature: The sequence is a functional homolog of SEQ ID NO 768 in the 11/435,388 US patent application
  misc_feature: The sequence is a functional homolog of SEQ ID NO 1238 in the 10/374,780 US patent application
  misc_feature: The sequence is a functional homolog of SEQ ID NO 770 in the 11/435,388 US patent application
  misc_feature: The sequence is a functional homolog of SEQ ID NO 1241 in the 10/374,780 US patent application
  misc_feature: The sequence is a functional homolog of SEQ ID NO 762 in the 11/435,388 US patent application
MCPMIKTPMSAAESSPPCSWASTSTSSPEQGRHQTVWTPPPKKPAGRTKFRETRHPVFRGVRRRGNAGRWVCEVRVPGRRGC

SEQ ID NO: 13924 - DNA, 397 bp, Panicum virgatum
  misc_feature: Ceres CLONE 1771752
  misc_feature: Encodes the peptide sequence at SEQ ID NO. 13925
attcagctgagcgtgctcgatcatcaccctatcaacaaagcctcccaattatgctttcatcagatcatcttccttcttccaagatgtcttgcagctgcggatcctgctgcaactgcggctccaactgcaagtgcggcaagatgtaccctgaccttgaggagaagagcagcggcggcgctcaggccaccatcgtcctccccctgcccccggagaagaaggccggccagttcgaggcggcggcagagtccggcgagaccgcccacgcctgcaagtgcggtaacagctgcagctgcgacccctgcaactgctgatttcgatggggaacgtcttttttttcctgcatgcatgcatgctagctactacctactactctgcttgtgtgtttttttttttcccc

SEQ ID NO: 13925 - protein, 75 aa, Panicum virgatum
  misc_feature: Ceres CLONE 1771752
  misc_feature (1)..(75): Pfam Name: Metallothio_2 Pfam Description: Metallothionein
MSCSCGSCCNCGSNCKCGKMYPDLEEKSSGGAQATIVLPLPPEKKAGQFEAAAESGETAHACKCGNSCSCDPCNC

SEQ ID NO: 13926 - DNA, 853 bp, Panicum virgatum
  misc_feature: Ceres CLONE 1771769
  misc_feature: Encodes the peptide sequence at SEQ ID NO. 13927
gcaacacctcatcagccagtagtagtgaaccaacccaagcagcaacaacccaagcgcaaccgatcgacatggctgactactacagcggcaggaccatgtactccaagaccgacgagtgctacgacaccggcaggcacggcggcagccagagggtgtactcccacaccgacgagtgctacgacgacgtggaccgcaggaggccgggggcctacgccgacgactgctacaacggcgccggctacggcggcgccaggcaggccgccgtctactccgacgagtactcccgcagcggctatggcagcgagcaggagcacttcaagagggaggagagggaacacaagcataaggaacgcctcggcgagataggcgccctcgccggcggcgccttcgcactgtacgaggggcaccgtgcgaagaaggacccggagcacgcgcagaggcacaagatcgaggcgggcgtggcgacggcggcggcgctgggcgccggcggctacgcgtaccacgagcaccgcgagcagaaggaggcccgctacgagggcaaggaccacagggtgccgcacggctactactgcaactaattactgagcgatcgatcgagtcatgctgatgcatcgagctagatggaatgkatcgcakgcatgccggcggsgmcacgacgggcgtgcaagkactctagtaaataagagcagatgtgasgactccttgtgtgctgctcactacactacatattgtccgttacaagtaggcatacaaaaacggttgcaataataatgtaaatcactactccgcaagcttcggcaggcaggtaccgtgtctataaccatgcatcattattaatataatgcaattaagt

SEQ ID NO: 13927 - protein, 169 aa, Panicum virgatum
  misc_feature: Ceres CLONE 1771769
  misc_feature (81)..(160): Pfam Name: ABA_WDS Pfam Description: ABA/WDS induced protein
MADYYSGRTMYSKTDECYDTGRHGGSQRVYSHTDECYDDVDRRRPGAYADDCYNGAGYGGARQAAVYSDEYSRSGYGSEQEHFKREEREHKHKERLGEIGALAGGAFALYEGHRAKKDPEHAQRHKIEAGVATAAALGAGGYAYHEHREQKEARYEGKDHRVPHGYYCN

SEQ ID NO: 13928 - DNA, 855 bp, Panicum virgatum
  misc_feature: Ceres CLONE 1771786
  misc_feature: Encodes the peptide sequence at SEQ ID NO. 13929
aagagatgaagctcttcgtccccttgtgttcctactttcttctcagtggcatccatgctccaaaagccctgtcagatagccctcctctgcaggatgtatgccccatggcagctcagggtgagaggaacgtgttcatgaatggtctcctctgcaaggatcccagcactatcttggcctccgacttcaagaccctgctgctgaaccatgctggagacctgaacaacatgttccggtcatcggtgaacatggtcaccgccactgagttccctgggctaaacaccctgggtctggccatggcacgcaccgacatcgcccccagtggggttgtgctcccccactctcacccacgggcatcggagatgatgtttgtccatggtggtagcgtggtggttggcttctttgacaccaatggtaggcagttccagaagaccctgggggacggggaggtgttcatctttccccgtggtctggttcactacatcatcaactatggttttggtccttcgacgacattttcagtgctcaacagtcagaaccctggtgttgtcggcatcacccatgggatgttcacgacagattcagatgtgcttgaggggctgatggcaagaatgttgaagtttggagagatgggactgagtgacaacggtactgctggtttgccatggacattcgataatgtataactcaacttagtgatacaatttgatgaaaattattgacgatttggagatcatttcatataaatggattctgctttgtgatgtagctgcttaatttatgtaacagttctgggctcctggcctttaatctgaattgtcagggcaccacataaattaagaacagagacttctctgc

SEQ ID NO: 13929 - protein, 225 aa, Panicum virgatum
  misc_feature: Ceres CLONE 1771786
  misc_feature (63)..(196): Pfam Name: Cupin_1 Pfam Description: Cupin
  misc_feature: SWISSPROT Homolog: EC 1.15.1.1 Superoxide dismutase
MKLFVPLCSYFLLSGIHAPKALSDSPPLQDVCPMAAQGERNVFMNGLLCKDPSTILASDFKTLLLNHAGDLNNMFRSSVNMVTATEFPGLNTLGLAMARTDIAPSGVVLPHSHPRASEMMFVHGGSVVVGFFDTNGRQFQKTLGDGEVFIFPRGLVHYIINYGFGPSTTFSVLNSQNPGVVGITHGMFTTDSDVLEGLMARMLKFGEMGLSDNGTAGLPWTFDNV

SEQ ID NO: 13930 - DNA, 1028 bp, Panicum virgatum
  misc_feature: Ceres CLONE 1771805
  misc_feature: Encodes the peptide sequence at SEQ ID NO. 13931
aaaaatccctcccgtgcccggctgcccgcaaaccctaccccccgccgccacctcgcgagcagccatggccgtcgggaagaacaagcgcatctccaaggggaggaagggcggcaagaagaagatcgtcgaccccttcgccaagaaggactggtatgacatcaaggccccgtcggtgttcagcgtgcggaacgtcggcaagactttggtgtccaggacccagggtaccaagattgcctctgaaggactgaagcacagagtgttcgaggtctccttggctgatcttcagagcgatgaggatcaggcgtacaggaaaatcagacttcgtgcagaagatgtgcaaggaaggaacgtgctcacaaacttttggggcatggattttacaaccgacaagctgaggtcattggttaagaagtggcagaccctcattgaggctcatgtggatgtcaagacaactgacaactacatgctcaggctgttctgtattggcttcaccaaaagacgtcccaatcaagtgaagcgcacctgctatgcgcaggcgagccagatccgtcagatccggcgtaagatggtggacatcatgtcaaaccaagcctcaacatgtgacttgaaagagcttgtgtccaagtttataccagaggtgattggcaaggagattgagaaagcaacatcaagcattttcccactccagaatgtcttcatacggaaggtgaaaatcctcaaggcacccaagtttgacttgggaaagctcatggaggtccacggtgactacaaagaagatgttgggaccaagctggagaggcctgctgacaccgatgaagccatggctggacaggaggtcgctgctgccgagtgatgatgctttcttttgggttacttctgtcgtttgtgtttctaggagaacctatcttgtaaggtggtgatatgaacttcgagtcaatgtttgataccagctttgcgccacacttttgtcagaagctgttctgtggctgcatgtttaagtaaactgaagaatatttgcatcgagtttt

SEQ ID NO: 13931 - protein, 262 aa, Panicum virgatum
  misc_feature: Ceres CLONE 1771805
  misc_feature (11)..(222): Pfam Name: Ribosomal_S3Ae Pfam Description: Ribosomal S3Ae family
MAVGKNKRISKGRKGGKKKIVDPFAKKDWYDIKAPSVFSVRNVGKTLVSRTQGTKIASEGLKHRVFEVSLADLQSDEDQAYRKIRLRAEDVQGRNVLTNFWGMDFTTDKLRSLVKKWQTLIEAHVDVKTTDNYMLRLFCIGFTKRRPNQVKRTCYAQASQIRQIRRKMVDIMSNQASTCDLKELVSKFIPEVIGKEIEKATSSIFPLQNVFIRKVKILKAPKFDLGKLMEVHGDYKEDVGTKLERPADTDEAMAGQEVAAAE

SEQ ID NO: 13932 - DNA, 721 bp, Panicum virgatum
  misc_feature: Ceres CLONE 1771815
  misc_feature: Encodes the peptide sequence at SEQ ID NO. 13933
aacccgctccggccgccaccaccgatcgatcgcccggagatcgccggaccccgccgcgagtctaacccctgctgcgttcgtagccttcgacgacgatgtcgggagccggagaggaggacaagaagccggcggagggcggcgcccacatcaatctcaaggtcaagggacaggatggcaatgaggtgttcttccgtattaagaggtccacccagctgaagaagctgatgaatgcctattgcgaccgccagtctgtggacatgaatgccattgcattcctttttgatggccgcaggcttcgcggtgagcagaccccagatgagctggagatggaggatggtgatgagattgatgccatgcttcaccagaccggtggctacgtgcctagtgcttagaaagcccttgtcgcagcctcgttttgctgcgctgtgcgctctaccttctgtagtaaaccaaagaagtcatggaggaacttgtgaggctctggccctatgtgtgccattgctgaaggacatcggtagtcttgtttagtaagatttggtacttcggcgtgtcatgactcgtttatctatcccctaatatatcctcccctgtgtgtactcccaatgatcgcccatgatttgtttatcctgctcgaagtgcgccttgctttgctgacctaccgttgtgcgtggtgccgggggtatggttagttttgtgttgctgaggtgcaggaaatcgtgag

SEQ ID NO: 13933 - protein, 98 aa, Panicum virgatum
  misc_feature: Ceres CLONE 1771815
  misc_feature (21)..(91): Pfam Name: ubiquitin Pfam Description: Ubiquitin family
MSGAGEEDKKPAEGGAHINLKVKGQDGNEVFFRIKRSTQLKKLMNAYCDRQSVDMNAIAFLFDGRRLRGEQTPDELEMEDGDEIDAMLHQTGGYVPSA

SEQ ID NO: 13934 - DNA, 710 bp, Panicum virgatum
  misc_feature: Ceres CLONE 1771843
  misc_feature: Encodes the peptide sequence at SEQ ID NO. 13935
acaacaacctgtgacgtcgcagcctcctctctcccccaccgaaccgaatcccagccgcagaaaccacccgagcagcagccgcatcgatggcccccaaggcggagaagaagccggcggcgaagaagcccgcggaggaggagcccgcgacggagaaggcggagaaggccccggcggggaagaagcccaaggccgagaagcggccccccgcgggcaagtccgccggcaaggagggcggcgagggcaagaaggggaggaagaaggggaagaagtcggtggagacctacaagatctacatctttaaggtgctgaagcaggtgcaccccgacatcggcatctcctccaaggccatgtccatcatgaactccttcatcaacgacatcttcgagaagctcgccggcgaggccgccaagctggcgcgctacaacaagaagcccaccatcacctcccgcgagatccagacctcggtgcgcctcgtcctccctggcgagctcgccaagcacgccgtctccgagggcaccaaggccgtcaccaagttcacctcgtcttagatgctaggcttccccctctgctcctggtagtgatgccagtttgttggatgtggctagtacgggtggtgtagttacgtgctgtggttcctgactatgctctttctgtatgaagtggaacggttatctgatggaacattggtggtgcttgtttaactcttgttc

SEQ ID NO: 13935 - protein, 153 aa, Panicum virgatum
  misc_feature: Ceres CLONE 1771843
  misc_feature (60)..(130): Pfam Name: Histone Pfam Description: Core histone H2A/H2B/H3/H4
  misc_feature: Useful for biocontainment applications
  misc_feature: Useful for making plants with modulated flowering time
MAPKAEKKPAAKKPAEEEPATEKAEKAPAGKKPKAEKRPPAGKSAGKEGGEGKKGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 13936 - DNA, 420 bp, Panicum virgatum
  misc_feature: Ceres CLONE 1771897
  misc_feature: Encodes the peptide sequence at SEQ ID NO. 13937
gacttctccgataggttttcctcgcgccgccgccgctactgccgtcgcttccgtcttccccgccgccgcagccatgccgtcccacaagaccttccggatcaagaagaagctggccaagaagcagcgccagaaccgccccatcccctactggatccgcatgcgcaccgacaacaccatcaggtacaacgcgaagcgcaggcactggcgccgcaccaagctcggattctgagcgggggaagagatgccgggcaccgatgcttggggaaactgggatttacgagccggcctcgggacgcttccatgtttccgcatgctaggggagctcttgtttagattttgcttgtgttaatttgatgttatcagttgttcctgtagcgtactgagaataccatgctttgctgatgattgaacaccctttat

SEQ ID NO: 13937 - protein, 51 aa, Panicum virgatum; identical to SEQ ID NO: 9830
  misc_feature: Ceres CLONE 1771897
  misc_feature (9)..(51): Pfam Name: Ribosomal_L39 Pfam Description: Ribosomal L39 protein

SEQ ID NO: 13938 - DNA, 892 bp, Panicum virgatum
  misc_feature: Ceres CLONE 1771985
  misc_feature: Encodes the peptide sequence at SEQ ID NO. 13939
aaacaaaacaaggccctggcagtctgtagctggcactggcagcatcccccagcacagagtagggtcgtcgtcggaggcttggatccatggccttctgggagccctgcttcggcaaagacaacgagtgctgcgactgcgagtgcagctggaccaagttcctcatctggtccgccgtcgtcctcctcgtgggcggcctcgtcgccgtgctcgtcatcgccttcgccgtcgtgttcccgcccaaggccaaggccgacgacgccgtgctgcagcggttcgcgctggcgccgggcaaccccgccgccaactccaccatctcctacaacctcacggccacggtgtcgctgcggaaccccaacatctaccggaccatcgcctacgggcccctcgccgtggccttctccttcaacggctcccgcttcgacgagtccgccaccatcccgcccttcgaccacaagccgcgcaagacggccacggtccgcgtcaccgtcggcggcgtggacaagctcgtcaagctcaccgcgcccggggtgaaggagttcgccgcggagaacgacacgagcaagttcgccgtggagatgcagctggacacgacgctgcagtacaaggggcgcagcgccaagtgcccgctcgtcgtcatctgcccgctccagctgcagctcgtcgaccccgacgttgccgccaccgcgttccagaggaccaagtgcaccatcctccgggccaagaagtccgggtgctaactccattgttgattgagtcttgtttctggctagagctctatttcttcaagaattcctttttttccctctcgagattgttgatgcgtctgcttagaagactatgatctgtaggagtgcaaaattcgatttgatttgtataaatctggatgattcct

SEQ ID NO: 13939 - protein, 216 aa, Panicum virgatum
  misc_feature: Ceres CLONE 1771985
  misc_feature (45)..(185): Pfam Name: Hin1 Pfam Description: Harpin-induced protein 1 (Hin1)
MAFWEPCFGKDNECCDCECSWTKFLIWSAVVLLVGGLVAVLVIAFAVVFPPKAKADDAVLQRFALAPGNPAANSTISYNLTATVSLRNPNIYRTIAYGPLAVAFSFNGSRFDESATIPPFDHKPRKTATVRVTVGGVDKLVKLTAPGVKEFAAENDTSKFAVEMQLDTTLQYKGRSAKCPLVVICPLQLQLVDPDVAATAFQRTKCTILRAKKSGC

SEQ ID NO: 13940 - DNA, 168 bp, Panicum virgatum
  misc_feature: Ceres CLONE 1771992
  misc_feature: Encodes the peptide sequence at SEQ ID NO. 13941
agccgcgccgacgcccaggggaccccaaccgcgaacacaaaaggcaagcgccacccccacaaccgccggaagcccgcgaagcccaccgggacagcgagggacaggaagcagcacaagaaggacacccaggccgaagcggggaaaaagaggcggcggaccaccaagaag

SEQ ID NO: 13941 - protein, 55 aa, Panicum virgatum
  misc_feature: Ceres CLONE 1771992
  misc_feature: Useful for making plants with modulated nitrogen use efficiency
SRADAQGTPTANTKGKRHPHNRRKPAKPTGTARDRKQHKKDTQAEAGKKRRRTTK

SEQ ID NO: 13942 - DNA, 439 bp, Panicum virgatum
  misc_feature: Ceres CLONE 1771994
  misc_feature: Encodes the peptide sequence at SEQ ID NO. 13943
  misc_feature (160)..(160): n is a, c, t, g, unknown, or other
cccgccgccaagcagcagggcgccggccgcggcgccaggcagcgcgcgcaggccaccaacaacgcgaagcccaccacgcccgacggcgaggaagagcagcaggagcccgacgacgcgaacaacccggaccaggccgaggaggaagggagcgacccgcccnacgcgagccgttttttgtcctgctcctcctgcgccggcaaggtcgtctccggcagcgtcgaccagtcctatcttagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatat

SEQ ID NO: 13943 - protein, 116 aa, Panicum virgatum
  misc_feature: Ceres CLONE 1771994
  misc_feature (25)..(100): Pfam Name: Fer2 Pfam Description: 2Fe-2S iron-sulfur cluster binding domain
  misc_feature (54)..(54): Xaa is any aa, unknown, or other
PAAKQQGAGRGARQRAQATNNAKPTTPDGEEEQQEPDDANNPDQAEEEGSDPPXASRFLSCSSCAGKVVSGSVDQSYLSFLEDDQVAGGWVLTCAAYPTSDVVIETHKEEELTSSS

SEQ ID NO: 13944 - DNA, 785 bp, Panicum virgatum
  misc_feature: Ceres CLONE 1771999
  misc_feature: Encodes the peptide sequence at SEQ ID NO. 13945
gagtcctccatttagccctcggttctcgagtcttccagactcgcgctcgctgctcgctgctcgctgctcgccttcgcttccgacttctccactcgcgtcgcacgcaggggtcgcctgagatcacatagacaatggtgaaggctgtcgctgtcctcgctggcagtgatgtcaagggtaccattttcttttctcaagagggagatggtccaaccaccgtgaccggaagtatctctgggctcaagccggggctccatgggttccatgtgcatgcgcttggtgacaccaccaatggctgcatgtccactgggccacacttcaatcctgctgctaaggagcatggtgcaccagaagatgagaatcgccataccggtgatcttgggaatgtgacagctggagaagatggtgttgctaatgtcaatattactgactgccagattcccctcactgggccacactcaatcattggccgagctgtagttgtccatgccgatccagatgaccttggcaagggtggacatgagcttagcaagagcacgggaaatgctggtggccgtgttgcttgtggtatcattgggctccagggctagatgctgtggcttcattggtgaacattcacatctgagcacctccggtcttgctgcttcatttcccttatattggatacataattggctactcttaataatcgcctgatcaatagtcagagcgctattcctatcattccgtgtatgaacattgcacaaccatcatttttctttagtgcgatgcgaagtggctgttttggc

SEQ ID NO: 13945 - protein, 151 aa, Panicum virgatum
  misc_feature: Ceres CLONE 1771999
  misc_feature (1)..(151): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLAGSDVKGTIFFSQEGDGPTTVTGSISGLKPGLHGFHVHALGDTTNGCMSTGPHFNPAAKEHGAPEDENRHTGDLGNVTAGEDGVANVNITDCQIPLTGPHSIIGRAVVVHADPDDLGKGGHELSKSTGNAGGRVACGIIGLQG

SEQ ID NO: 13946 - DNA, 581 bp, Panicum virgatum
  misc_feature: Ceres CLONE 1772018
  misc_feature: Encodes the peptide sequence at SEQ ID NO. 13947
gggaatcacctcctcttcgtcctcgaactcggaatccagggctatggcgctcgtcaaggccaaggagatcgtcccctccgcgcccgtcgtcgtcttcagcctctcatactgccccccccgcgtccgtgtgaagcagctgttcgagaagctgggagcaagcttcaaggccattgagatggatgtggaaagtgatggagctgagctccaggatgctctcaaggagtggactggacagaggaccgttccaaatgtcttcatcaatgggaagcatattggtggctgcgatgataccatggcactgaacaatgatgggaagctggtgtctctgcttactgaggctggagcgatcaagggttctacttccaagaaaaccgccactgcttagctctatctgagagttgtcctggttgacatttttatactgttcccatggtatggtatgaaataagggggctatggttcgcaggtcctgaactttgtgctgtcaaagtgtcaagtactatcatgactgtctagtccccctgttgaaccgctcagacatcagtcgagttgcatgcctgcgctaatagtaatgagttcct

SEQ ID NO: 13947 - protein, 113 aa, Panicum virgatum
  misc_feature: Ceres CLONE 1772018
  misc_feature (15)..(77): Pfam Name: Glutaredoxin Pfam Description: Glutaredoxin
  misc_feature: SWISSPROT Homolog: EC 1.11.1.15 Peroxiredoxin
  misc_feature: Useful for biocontainment applications
MALVKAKEIVPSAPVVVFSLSYCPPRVRVKQLFEKLGASFKAIEMDVESDGAELQDALKEWTGQRTVPNVFINGKHIGGCDDTMALNNDGKLVSLLTEAGAIKGSTSKKTATA

SEQ ID NO: 13948 - DNA, 730 bp, Panicum virgatum
  misc_feature: Ceres CLONE 1772029
  misc_feature: Encodes the peptide sequence at SEQ ID NO. 13949
aagtccaactctcccaggcgaatcagcattcacagcaaaaaccacaccaccttggcaacaagcaagggcaggcgcgagcgaatatcgcagcaacaagcaagggtatggcgaggcagcagctgaaggtgtcggcggcggcggacacggcgtcgtggtgcttggcgctgtcgctggtagcgctgctgctggtgtgctcgctcggcgccggcggggcgggggcaagggaggaggccatgctgccgcaggtgcgtggcgcggcgctgtcggcgcggccgtgcgaggagatctacgtggtggcggagggcgagacgctgcacagcatcagcgacaggtgcggcgacccctacatcctggagcagaacccgcacgtccacgaccccgacgacgtcttccccggcctcgtcctcaagatcacgccatccaagcccaggtagaagtagaaccatcgatcgacaaccatctatgattgagggcaagcacaacacataggtgctctgttctgttggagcaaatcaaggatgcatcagtgcagtgtagcaatgcagaggaggtggcagctcgatgtgagtgaagcgtggtttggctgactgcctgcctgcctgtgtacacgggacatcacttgtgaatagacaagttcatgagatgaacagagtatgttctctgatgctgctgctagctgctcgtcgtcttctttcctttgtctgcaatgcaagaaaattctctattgttc

SEQ ID NO: 13949 - protein, 109 aa, Panicum virgatum
  misc_feature: Ceres CLONE 1772029
  misc_feature (62)..(104): Pfam Name: LysM Pfam Description: LysM domain
MARQQLKVSAAADTASWCLALSLVALLLVCSLGAGGAGAREEAMLPQVRGAALSARPCEEIYVVAEGETLHSISDRCGDPYILEQNPHVHDPDDVFPGLVLKITPSKPR

SEQ ID NO: 13950 - DNA, 810 bp, Panicum virgatum
  misc_feature: Ceres CLONE 1772030
  misc_feature: Encodes the peptide sequence at SEQ ID NO. 13951
atcatccatttttccatacactgataaagtatcagtatagccagcttcccttctcccccaactccggcggcggcgcggaaggcttccgttcggtctccgcctctcttttggcgccaaatccatccgcccctccgattccgggccttccaggtgccaacagttgagaatggtactgaagtgcctgaggagatgctgctgttgcagtgcaaagcacacagatggcaaggacaagattgatttcggaggtagcaatgttcatgtcattactagcaaagaaaactgggaccaaaaaattgaagaggcaaacaaggatgggaaaattgtggtagcaaatttcagtgcttcctggtgtgggccatgccgggtcatctcgactgtttatgctgagatgtcgcagacgtacccacagctcatgttcttggcagtcgatgtcgacgagttaatggagttcagctcgtcgtgggacatccgggcgaccccgacgttcttcttcctgaagaacgggcagcaggtggacaagctggtcggcgccaacaagcccgaactggagaagaaggttgccgcggtcgccagcgtcgccggcgacggcgacggcaacggcggcgcggtgcctgacgccaagtgacaggatgacggtgtgggcggatatcatgtcgcttcttttccgccccgttgcgtagccgcattgatctgtgcgataccttccccgatgtgcagactgtacagctccttcttggtgatgactgatgacgtaagcatgtaagtattggtttctgtggtagcaactggttgcaagtgcacacacgagtt

SEQ ID NO: 13951 - protein, 152 aa, Panicum virgatum
  misc_feature: Ceres CLONE 1772030
  misc_feature (30)..(134): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MVLKCLRRCCCCSAKHTDGKDKIDFGGSNVHVITSKENWDQKIEEANKDGKIVVANFSASWCGPCRVISTVYAEMSQTYPQLMFLAVDVDELMEFSSSWDIRATPTFFFLKNGQQVDKLVGANKPELEKKVAAVASVAGDGDGNGGAVPDAK

SEQ ID NO: 13952 - DNA, 785 bp, Panicum virgatum
  misc_feature: Ceres CLONE 1772050
  misc_feature: Encodes the peptide sequence at SEQ ID NO. 13953
ccttcaaagccctagccgaccacaccactccaccccgccgccggaggcgagaagcaacctcaggtaagggcggccgccgccgggaagggcgggcggggcaagatgcagatcttcgtgaagaccctgacggggaagacgatcacgctggaggtggagtcctcggacaccatcgacaacgtgaaggccaagatccaggacaaggagggcatcccgccggaccagcagcggctcatcttcgccgggaagcagctcgaggacgggcgcaccctcgccgactacaacatccagaaggagtcgacgctgcacctggtgctccgcctccgcgggggggccaagaagcgcaagaagaagacgtacaccaagcccaagaagatcaagcacaagcacaagaaggtgaagctcgccgtgctccagttctacaaggtggacgacgccaccggcaaggtcacccgcctccgcaaagagtgccccaacgccgactgcggcgccgggaccttcatggccaaccacttcgaccgccactactgcggtaagtgcggcctcacctacgtctacaaccagcaggcgtagggggaagaagaaaaatggaaagtcttgctagattataaatcttcttttttttgtcgcttgtgaaagtagtttgttagaacagaacacccgcatctcttatcttatggggatgtgtactttttgttttgatgatatgatgtcgttatggatcctaccaagcactgttgaattcaacctatgtttgtgttaatcttatactgtgcgtgcccagtgtt

SEQ ID NO: 13953 - protein, 155 aa, Panicum virgatum
  misc_feature: Ceres CLONE 1772050
  misc_feature (6)..(74): Pfam Name: ubiquitin Pfam Description: Ubiquitin family
  misc_feature (101)..(148): Pfam Name: Ribosomal_S27 Pfam Description: Ribosomal protein S27a
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNADCGAGTFMANHFDRHYCGKCGLTYVYNQQA

SEQ ID NO: 13954 - DNA, 755 bp, Panicum virgatum
  misc_feature: Ceres CLONE 1772088
  misc_feature: Encodes the peptide sequence at SEQ ID NO. 13955
gcgcctcacgaaacaaagctaagcgtttggtattacggccagcaccagcagcttagctcagctcagctccccgtccgacaccaccatggcctccgtctcgcgcctcctcgccgtggcgctcgtcgtcatggccgccgcgctcctcggcggcggcgccggcacgtgccacgccgcccgcctcctcgccgccctgccggtgcccgaggtgcctggcgtgccgttgccgacgttgcccgaggtgccgggcatcccgacgctgccggtgcctgaagtgccgatgccggaagtgccgaagctgccggtgcctgaagtgcccaagctgccggtgcccgaagtgcccaagctgccggtgcctgaagtgccgggcgtgcccgtgcctgaggtgcccggcgtgcccgccgtgccttaggtgccgcgcgctcgtccgcggatgctgccggctcccggcgtggacgaaagcctctcccgcgccgcgctgcgtgcccatcggcctcgacgacgtcggtccgtgcgcaagtgccggcgcgggggtgtggtggtggtactcttctgtgtttatatgtgtgtgtgcgcgcgagactacgtacgcgtcgcgtgtctctcgtttcgtcgtgatgtctgctacgtcgttgtagggtatggacgtgcacgcgatacggtgcgcgtgtaacaccacatatatactgctctatcgatgaatgttactagcttcgtcggtgtgagtagtaataattttacatcgttgccagggctgc

SEQ ID NO: 13955 - protein, 107 aa, Panicum virgatum
  misc_feature: Ceres CLONE 1772088
  misc_feature: Useful for making plants with modulated heat sensitivity
MASVSRLLAVALVVMAAALLGGGAGTCHAARLLAALPVPEVPGVPLPTLPEVPGIPTLPVPEVPMPEVPKLPVPEVPKLPVPEVPKLPVPEVPGVPVPEVPGVPAVP

SEQ ID NO: 13956 - DNA, 641 bp, Panicum virgatum
  misc_feature: Ceres CLONE 1772089
  misc_feature: Encodes the peptide sequence at SEQ ID NO. 13957
cgcacgcccggccgcgaaccccccccacccagcagccaccaagcgagcgagccttctttcagcagcagctgctgcagctctagctagcaataattaagcagcaatggccaccgccctcagcagcctccgcgcgccggccagcagcttctcctccggcgtgcgcgccgccccggcgcccggcgtcgtcgccatgcccgccgccaagcaggttgttgcccgcggcgccaggctgcgcgcgcaggccacctacaacgtgaagctgatcacgcccgacggcgaggtttttctgcaggtgcccgacgacgtgtacatcctggaccaggccgaggaggaggggatcgacctgcccttctcctgccgcgcggggtcctgctcctcctgcgccggcaaggtcgtctccggctccgtcgaccagtccgaccagagcttcctcgacgacgaccaggtcgccagcggctgggtgctcacctgccacgcctaccccacctccgacgtcgtcatcgagacgcacaaggaggaggagctcaccgcttaagctccatcatcacatcatcatcatatcccatgcataaaattaaagctgctagctgccttgcaagagatctatcgatcgatgtaatcgagttgacgagaatccgatc

SEQ ID NO: 13957 - protein, 143 aa, Panicum virgatum
  misc_feature: Ceres CLONE 1772089
  misc_feature (54)..(129): Pfam Name: Fer2 Pfam Description: 2Fe-2S iron-sulfur cluster binding domain
  misc_feature: SWISSPROT Homolog: EC 1.14.13.7 Phenol 2-monooxygenase
MATALSSLRAPASSFSSGVRAAPAPGVVAMPAAKQVVARGARLRAQATYNVKLITPDGEVFLQVPDDVYILDQAEEEGIDLPFSCRAGSCSSCAGKVVSGSVDQSDQSFLDDDQVASGWVLTCHAYPTSDVVIETHKEEELTA

SEQ ID NO: 13958 - DNA, 462 bp, Panicum virgatum
  misc_feature: Ceres CLONE 1772096
  misc_feature: Encodes the peptide sequence at SEQ ID NO. 13959
ggcgaaggattccgccgcgtgctagtgtcaagatggcggggcgcaaggagactgcactcgacctggcgaagttcgtcgacaagggcgtccaggtgaagctcaccggcggccggcaagtgacaggaactttaaaaggatacgaccagctactcaacttagtgctagatgaagcagtggagtacgaaagagagcaagatgacccattgaagctatctggtttttttagacagcttggcctcattgtgtgcaggggcacggctgtgatgctggtctcaccatctgatggaaccgatgagatcgcgaaccctttcctcgccgatggggcataagcttgcactggttgattatttagaaccgtgctctcaagcaccctcagaaccatctgttccagtggaaaagaactccaatctcatgtattatttacccgttgctgatgaagttgtatttttcattgtgcaactt

SEQ ID NO: 13959 - protein, 98 aa, Panicum virgatum
  misc_feature: Ceres CLONE 1772096
  misc_feature (9)..(82): Pfam Name: LSM Pfam Description: LSM domain
  misc_feature: Useful for making plants with modulated biomass
  misc_feature: Useful for making plants with modulated flowering time
  misc_feature: Useful for making plants with modulated time to senescence
MAGRKETALDLAKFVDKGVQVKLTGGRQVTGTLKGYDQLLNLVLDEAVEYEREQDDPLKLSGFFRQLGLIVCRGTAVMLVSPSDGTDEIANPFLADGA

SEQ ID NO: 13960 - DNA, 456 bp, Panicum virgatum
  misc_feature: Ceres CLONE 1772099
  misc_feature: Encodes the peptide sequence at SEQ ID NO. 13961
agggtaagacggtggacctctatgtccccaggaagtgctccgccactaacaggatcattactgccaaggatcacgcctctgtccagatcaacattggtcacttggatgcgaatggcatgtatgatggtcactttaccacattcgctctctctgggtttgtctgcgctcagggtgacgctgacagctcgttggacaggctgtggcagaagaggaaggctgattttttttagtagatctcgttcataatttcactaagaatcgactcttgagggatgctgccttatctatgttttgatttcatgtctccacaccgttgggatacaatgctgtgatttcagttggtatcttaaatctaaggacttaatatcgtttgttggattccttctgagttttgatgtgtcctggtcacgttgtcaaatgaaagtagcttaactcccttctgcagcgacattgcgc

SEQ ID NO: 13961 - protein, 75 aa, Panicum virgatum
  misc_feature: Ceres CLONE 1772099
  misc_feature (1)..(73): Pfam Name: Ribosomal_S21e Pfam Description: Ribosomal protein S21e
GKTVDLYVPRKCSATNRIITAKDHASVQINIGHLDANGMYDGHFTTFALSGFVCAQGDADSSLDRLWQKRKADFF

SEQ ID NO: 13962 - DNA, 481 bp, Panicum virgatum
  misc_feature: Ceres CLONE 1772121
  misc_feature: Encodes the peptide sequence at SEQ ID NO. 13963
caacaaaggcagcccgcaaggcagccccgaccacaggaggagcgaagaagccccaccgccaccgcccagggaccggcgcccaccgagagacccgcaaggaccagaagagcaccgagcggacgagcaggaagccgcccaaccagaggccgggaagggaaacggcacaggacaacaagttttttttgcgccaccagagccaagccgagcctgccccccaggaggcggccgaggcgtatcttgttggtctgtttgaggacaccaacctgtgcgccatccatgctaagcgtgtgaccatcatgcccaaggacattcagctggccaggaggatccgtggcgagagggcttaatcatgatcatgacaatcaaaatctcgtgtcgtagtcgtggtttaatgtggtgccatgttcggacatcagtagggcttgttttgtggatcataagtttctcttctgcagcactataatgttgcgactaccgttgg

SEQ ID NO: 13963 - protein, 114 aa, Panicum virgatum
  misc_feature: Ceres CLONE 1772121
  misc_feature (36)..(110): Pfam Name: Histone Pfam Description: Core histone H2A/H2B/H3/H4
TKAARKAAPTTGGAKKPHRHRPGTGAHRETRKDQKSTERTSRKPPNQRPGRETAQDNKFFLRHQSQAEPAPQEAAEAYLVGLFEDTNLCAIHAKRVTIMPKDIQLARRIRGERA

SEQ ID NO: 13964 - DNA, 524 bp, Panicum virgatum
  misc_feature: Ceres CLONE 1772167
  misc_feature: Encodes the peptide sequence at SEQ ID NO. 13965
ttgagagcagaaatttttggccccttccttcctatcgtgacggtcgagaagatcgaagacagcattgacgtggtgaactccaagacgaagccgcttgcggcctacctcttcaccaagaacaagaagctgcagcaggcctttgtggcgaacgtccccgcgggagggatgctcgtgaacgacgtcgcgctgcatctcacgaacccgtacctgcccttcggcggcgtgttttacagcgggacgggcagctaccacggcaagttcagcttcgactgcttcagccacaagaaggcggtcctggtccgcggcttcggcggcgaggcggcggcgaggtacccgccctacacgatggagaagcagaagatcctgaggggcctcatcaacggcagcttcatcgcgctcatcctggcgctcctgggcttcccgagggagaggcgctaggctggacgatcgatcccccgttccagtacagacttctgttcgtgttcgtccggtgcagattactagtagcatactccctccgtccc

SEQ ID NO: 13965 - protein, 145 aa, Panicum virgatum
  misc_feature: Ceres CLONE 1772167
  misc_feature: SWISSPROT Homolog: EC 1.2.1.3 Aldehyde dehydrogenase (NAD(+))
LRAEIFGPFLPIVTVEKIEDSIDVVNSKTKPLAAYLFTKNKKLQQAFVANVPAGGMLVNDVALHLTNPYLPFGGVFYSGTGSYHGKFSFDCFSHKKAVLVRGFGGEAAARYPPYTMEKQKILRGLINGSFIALILALLGFPRERR

SEQ ID NO: 13966 - DNA, 761 bp, Panicum virgatum
  misc_feature: Ceres CLONE 1772189
  misc_feature: Encodes the peptide sequence at SEQ ID NO. 13967
ataagaaatcacagcgtcagttctctctcaagaacaaacacagaaggccatggcggagccggagctcgcccaggaccgctgaacctagagagagacgaaaaatctcattattcctttcctgcaagagccagtgagaccagcagggagtgaaggggaggggaagagtcagccaagaaagttcgatctcgcggctatggtggagaggagagtatgcatatactatgaggctaacgatggctggcaacgtttatagctttggagtcattttactggagctgttgacaggaaaaccatctgtcagtgatggcgttgaattagccaagtgggctctaggtctttcagcaaggcctgatcaaagggaccagattcttgacgccaggatatcaggagcttcaattgctgttcacagccagatgttgtcaatcctgaacattgctctctcctgcgttgccttctctccagatgctcggccaaagatgcgcaacgttttgaggatgctcttcaatgcaaagtgaatcagaagcagtatcatagatacttttttgtggagttttatcatcgcttagtttatggatgccagtaatcagtatacaggctgttcttgtatagttccatataagatagaaccgtcaaccgtagctcatggtagatcatcatatgtttgatgaattgggtaattagatgtctgtttggatcgtgtcaccatattgcatctatgctgtaatattgcatagatgattataggcaaagtttaaaagggc

SEQ ID NO: 13967 - protein, 93 aa, Panicum virgatum
  misc_feature: Ceres CLONE 1772189
  misc_feature: SWISSPROT Homolog: EC 2.7.11.1 Non-specific serine/threonine protein kinase
MAGNVYSFGVILLELLTGKPSVSDGVELAKWALGLSARPDQRDQILDARISGASIAVHSQMLSILNIALSCVAFSPDARPKMRNVLRMLFNAK

SEQ ID NO: 13968 - DNA, 859 bp, Panicum virgatum
  misc_feature: Ceres CLONE 1772229
  misc_feature: Encodes the peptide sequence at SEQ ID NO. 13969
aagccgccgctactcctcacagactcccaaaccctaccctcacacccgccgccgccgccacccgcgccccagcaagcagccgccatgccgcccaagttggacccctcacaggtggtggaggtgttcgtccgcgtgacgggcggggaggtcggcgcggcgtcgtcgctggcccccaagatcggcccgctcgggctctccccgaagaagatcggagaggacatcgccaaggagaccgccaaggactggaagggcctccgcgtcaccgtcaagctcaccgtccagaaccgccaggccaaggtctccgtcgtgccctccgccgcggcgctcgtcatcaaggccctgaaggagcccgagagggacaggaagaaggtcaagaacatcaagcacagcggcaacatcagcctcgacgacgtcatcgagatcgccaggaccatgaggcccaggtccatggccaaggagatggccgggactgtcaaggagatcctcgggacctgcgtcagcgtcggctgcaccgtcgacggcaaggaccccaaggatctgcagcaggagatcgacgaaggggacgtcgaaatcccctccgcgtaaaggctagacatctaaggagattatcatcagatgctactgaagtgttctgttccatctgctgtttatgtaccttaccaaactatgtggctgcgcctatttttgtcttgctttagtagttatgctgtgagagacctcaatgttgcaactgcatcaatttggagtctggaatggagttttaggcacttgctcatcttaatctctataccgcctggcaggtggaagttccatataactttttgttaccttgatttgagtggttatgttaccagctttc

SEQ ID NO: 13969 - protein, 166 aa, Panicum virgatum
  misc_feature: Ceres CLONE 1772229
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVIEIARTMRPRSMAKEMAGTVKEILGTCVSVGCTVDGKDPKDLQQEIDEGDVEIPSA

SEQ ID NO: 13970 - DNA, 584 bp, Panicum virgatum
  misc_feature: Ceres CLONE 1772237
  misc_feature: Encodes the peptide sequence at SEQ ID NO. 13971
atagasgkcagcgccgcctaccccgagcaactcgagcgaggaascgaagtcamtgccmccccaccccagcgtcaagagcamcatggcggcggcgggwggwtacggtgttctcaaggggaagctcggcgtcgaggacgcccacgagctgcagctcaaccgcatccgaatcaccctgtcctcgaagaacggcaagaacttggagaaagtttgtgcggattaggagaagggagccaaggacaagcagctgcgggttaagggacccgtcccgatccctacgaaggggctccacatcaccacccgcaagcccccttggggggaaggaacaaacacatgggatcgctttgaattccgcagccacaagagggtgaccgacctgatcagctccgctgatgtgatgaagcagatcacctgcatcaccagcgagcctggggtcgaggtcgaggtgaccatcgcagacgtgtaatggcatgcaggtcacctctgtcatcgtatatcttgcgttgctatagtctcgtgccccctttgtgtgcttgtatgagacatctgagtgattatcaccatccgagactgtgtctgcgccggct

SEQ ID NO: 13971 - protein, 45 aa, Panicum virgatum
  misc_feature: Ceres CLONE 1772237
  misc_feature: Useful for making plants with modulated biomass
  misc_feature: Useful for making plants with modulated flowering time
  misc_feature: Useful for making plants with modulated phosphate use efficiency
MAAAGGYGVLKGKLGVEDAHELQLNRIRITLSSKNGKNLEKVCAD

SEQ ID NO: 13972 - DNA, 1020 bp, Panicum virgatum
  misc_feature: Ceres CLONE 1772245
  misc_feature: Encodes the peptide sequence at SEQ ID NO. 13973
gagaaatccgcttgcataacgagcacagtgagacagagtagtagagcgatctttgtcttccatggcgaccgcgtctgaggaagttgcacccgccgtcgccgttgacgaggcgccggcgccggagaaggtggctgaggtgacggaggcggccgctgtggagacgccggagaaggtggaggaggcgccgaaacctgcagaggacgaggcgaagaaggcagaggaaggggaggagaagaaggcagaggaggggaagaagaaggcgaggaagccgcggagcaggaagcccaggtccgccgggccgcaccacccgccctacttcgagatgatcaaggaggcgatcctgtcgcaggacagcaaggcgggggcgagcccgtacgcgatcgccaagcacatgggggagaagcaccgggacgtgctcccggccaactaccgcaaggtgctggccgtgcagctgcgcaacttcgccgccaagggccgcctcgtcaaggtcaaggcctccttcgggctcgccgcggccgaggagaagaaggccgcctccgtcgcgaaggcgaaggcgccggtgccggcggcagcggctcccaagcgcaagagggcggctgcctccgccgcgcccgccaagaagaagaagccggcggcccccgcggaggcgaagaaggcgcgcgcgaagcgggcgaggaaggcggccccggcgcagccgaagccgaagcagcggcagcagaccaggcccgtccgcgccgccgtcgccaagaaggccgccgccaacaaggccagcgcctgatgaaccgccgccgccagctctttgtttcgttttggtcccgtacgcgcgcccccgtgtacgcgcgtgatcgcgtgttgtattgtaaataccgaaacccagcggggtgtgatgccaataagcgcgcgcttggagyttcyccyggtggtgcttgggagaagaagatgccgggctgtagtgatgtgctagttatgkggactgatgatcatcgtgcttagttcaaatcgckgctaccgccttttctc

SEQ ID NO: 13973 - protein, 238 aa, Panicum virgatum
  misc_feature: Ceres CLONE 1772245
  misc_feature (81)..(151): Pfam Name: Linker_histone Pfam Description: linker histone H1 and H5 family
MATASEEVAPAVAVDEAPAPEKVAEVTEAAAVETPEKVEEAPKPAEDEAKKAEEGEEKKAEEGKKKARKPRSRKPRSAGPHHPPYFEMIKEAILSQDSKAGASPYAIAKHMGEKHRDVLPANYRKVLAVQLRNFAAKGRLVKVKASFGLAAAEEKKAASVAKAKAPVPAAAAPKRKRAAASAAPAKKKKPAAPAEAKKARAKRARKAAPAQPKPKQRQQTRPVRAAVAKKAAANKASA

SEQ ID NO: 13974 - DNA, 933 bp, Panicum virgatum
  misc_feature: Ceres CLONE 1772247
  misc_feature: Encodes the peptide sequence at SEQ ID NO. 13975
agaagcgtcaggagagccggacgctgtcagctatggcggagaagctggcccccgagaagcgtcacgccttcgtgcacaacgggcagaaggtgttcgaatgggaccagacgctggaggaggtgaacatgtacatcgagctccccaagggcgtgcccaccaagctcttccgctgcaccatccaggcgggccacgtcgaggtcggcatccgcggcaacccgccatacctcaaccacgacctgacgcaccccgtgaagacggactcttcgttctggacgatagaggatggtgagatgcatatcacactgcaaaaaagagagaagggcaagacatggtcatctcccatacaagggcaaggtatcttggatccatatgcagcagatcaagagcaaaaacggcttatgctgcaaaggtttcaagaagagaaccccgggttcgacttttcgcaggctcagttcagtggaacctgccctgacccaaggaccttcatgggagggatacgctcggagtgaaggttccttgctgaaccacattttctccctatgctcctggcgccactccgagcatctttgttagatgcataccagttcattatgtaaattggttggtgtttacccttcaaataatgatggtgtgactgtgtaaccccmtttcatgactcctgtaagttcwtcasctgactgtaawgtccctgawtsgggctcccggggwaaatggtaactatatatagttgtgatcttcccgggggctcatttgtttttcctgttgtgtgtgtgtgtgggggggggggggggaggggtcaggtcactgaaaacatggaagtcttgtaagggcaagagcaatgtatcttgggtaataagtagcaggtctagacagtaggcctttgtgaggccggtcacatgataaataaaaaaaatactttcttttcttcccttc

SEQ ID NO: 13975 - protein, 158 aa, Panicum virgatum
  misc_feature: Ceres CLONE 1772247
  misc_feature (19)..(93): Pfam Name: CS Pfam Description: CS domain
MAEKLAPEKRHAFVHNGQKVFEWDQTLEEVNMYIELPKGVPTKLFRCTIQAGHVEVGIRGNPPYLNHDLTHPVKTDSSFWTIEDGEMHITLQKREKGKTWSSPIQGQGILDPYAADQEQKRLMLQRFQEENPGFDFSQAQFSGTCPDPRTFMGGIRSE

SEQ ID NO: 13976 - DNA, 740 bp, Panicum virgatum
  misc_feature: Ceres CLONE 1772257
  misc_feature: Encodes the peptide sequence at SEQ ID NO. 13977
cgctgccgccgccgccgccctcgaactcgaagcccgccgcctgcgcctcaccccctccgcgtcgcgtacccttgccgccggtctcctacctccgccaccatggggaagacacgaggtatgggagctgggcgcaagctcaagacccaccgcaggaaccagaggtgggctgacaaggcatacaagaagagccacttgggtaatgaatggaagaaaccgtttgctggatcatctcatgccaagggcatcgttctggagaagattggtattgaggccaagcaaccgaactctgccatccgtaagtgtgctcgtgttcagctggtgaagaacgggaagaagattgctgcctttgtgccgaatgatggttgccttaactacattgaggagaatgatgaggtgctgattgctggattcggtcgtaagggacatgccgtgggagatattcccggtgtcaggttcaaggttgtgaaggtttctggtgtgtccctgctcgccctcttcaaggagaagaaggagaagccaaggtcatagattgcttttggataggcaagagttgggtagactgtcaaggctctattatcaaacttaattgtgctagcaagagagctgtatcttttgttaacattgccattgagagttttgtttccattttgaagatattaatgttgcattgctgcttcaagctggggtttccacccaggtggttgtgacttgccttcagtttgagaaatctcttgtttgtt

SEQ ID NO: 13977 - protein, 142 aa, Panicum virgatum; identical to SEQ ID NO: 12276
  misc_feature: Ceres CLONE 1772257
  misc_feature (8)..(141): Pfam Name: Ribosomal_S12 Pfam Description: Ribosomal protein S12

SEQ ID NO: 13978 - DNA, 924 bp, Panicum virgatum
  misc_feature: Ceres CLONE 1772272
  misc_feature: Encodes the peptide sequence at SEQ ID NO. 13979
ggcatagcccccgcgacgagataccgatgtcactcgtctctccccgctgcggcccgccgctagcgctcggcggccgccaccgccgccgcccgcatcgggcccgagccgtcgcgcccaaatgcgagacctccccctcccatcctcccgtcctgacccggagggccgtgtccgccgccgcgctgctcctccccctccccgcctcgtggccgcaactccccgtcgcctccgcgtccgaagcggcggcggcggcggcggaagcacaaggagaaagtggagttccagaggggctagaactggagcggtacaccgaccaggagcaaggcttcaccctcctcaagccggcctcctggcccaaggtggacaaggcgggcgcgacggcgctgtttcagcaggaggggaaagggaggaacaacattggggttgtcgtcaaccctgtccggctcaattcgctgacggagtttgggacgccgcagtttgttgccgacaagcttctgcaggcagagaagaagaaggaaagcacgaagtctgctgaggtgatttcagctggagagagaacaggtcatggtggcctgacagtgtatgaaattgagtacgcactggatagcaccaggggagggatgaagcggatcttctcagctgcatttgttgcttcaaggaagctctatcttctcaatattgcctattcagatgcccaggagaagcccttggacagccagactagaactgttctggaacaagttctccattcttttgattctgtatagtggtctttaacaattgaggtatgacacttttctctctttttttccagaatttccttccgcttgaaaatacagtcccaaatatttgtttcttgctttgtaaaaagagttgtaatcaaatggttgctgtgttctgttgtccaaattccattatacctttatc

SEQ ID NO: 13979 - protein, 245 aa, Panicum virgatum
  misc_feature: Ceres CLONE 1772272
  misc_feature (57)..(245): Pfam Name: PsbP Pfam Description: PsbP
MSLVSPRCGPPLALGGRHRRRPHRARAVAPKCETSPSHPPVLTRRAVSAAALLLPLPASWPQLPVASASEAAAAAAEAQGESGVPEGLELERYTDQEQGFTLLKPASWPKVDKAGATALFQQEGKGRNNIGVVVNPVRLNSLTEFGTPQFVADKLLQAEKKKESTKSAEVISAGERTGHGGLTVYEIEYALDSTRGGMKRIFSAAFVASRKLYLLNIAYSDAQEKPLDSQTRTVLEQVLHSFDSV

SEQ ID NO: 13980 - DNA, 600 bp, Panicum virgatum
  misc_feature: Ceres CLONE 1772302
  misc_feature: Encodes the peptide sequence at SEQ ID NO. 13981
agtgctccatcaccaaacaaagcaacatcgatcggtcacccaatcattccttatcatatcatcttcttccaagatgtcttgcatctgcggattgagctgctcctgctgctcctgctgctactgccggaagatgtaccctgacctcgacgacaagatgggcggcggtactcacgccacccccgtcctccgcgtggccccggagaagaacgtcaaccacttcgacgcggtggaggaggcgagggagaccatccacgccagccagcgctgcaacagctgcacctgctacccctgcgactgctgatttggatggccgaacgtacaccacctgcctgcaagctacctaccccccactgtgcctacgtatgacttgagtcaaccccaatctggaagatcctcaaccccttcgcccaatgtgtcgcctcggctccagcctcacccacgcgccctgcgacggcagcccttatgtgtgcctcgacccctccttcttaccttgcgcttggcctcagtcatgtatcagtcctcctccgcaactattaatcattgcgaacaaaccatgcgcggcttgtgtctcgctgcatgcgtgctctgtaaatgatgtgt

SEQ ID NO: 13981 - protein, 75 aa, Panicum virgatum
  misc_feature: Ceres CLONE 1772302
  misc_feature (1)..(75): Pfam Name: Metallothio_2 Pfam Description: Metallothionein
MSCICGLSCSCCSCCYCRKMYPDLDDKMGGGTHATPVLRVAPEKNVNHFDAVEEARETIHASQRCNSCTCYPCDC

SEQ ID NO: 13982 - DNA, 624 bp, Panicum virgatum
  misc_feature: Ceres CLONE 1772306
  misc_feature: Encodes the peptide sequence at SEQ ID NO. 13983
acccgagactgctcgaccggagaagcacacacaagccagccaaggcctccccgagcggagatggcacaagccatggcgtccatgaccggcctctcgcagggcgtgctgcccagcaggcgcgccgccagcagggccaggacggccgtcgtcagggcgtcggccgagggcgaggccgcggcacaggctggccgccgcgccgtgctcgggctggtggccaccggcatcgtcggcagcgtcttcacccaggcggtgcgcgccgatgaggccgtcaagaccatcaagatcggccccccgccgccgccctctgggggacttcccgggaccttgaactcggaccaggccagggacttcaacctcgccttgaaggagcggttctacctgcagccgctgccaccagcgcaggcggcggcgagggccaagtcgtcagcgcaggacatcctcaacctcaagccgctcatcgacaagaaggcttggccgtacgtcatgaacgacctccgcctccgggcttcctacctgcgctacgacctcaacaccgtcatcgcctcaaagcccaaggaggagaagaagagcctcaaggagctcaccggcaagctcttcagcaccatcgacgatcttgaccatgcg

SEQ ID NO: 13983 - protein, 187 aa, Panicum virgatum
  misc_feature: Ceres CLONE 1772306
  misc_feature (12)..(187): Pfam Name: PsbQ Pfam Description: Oxygen evolving enhancer protein 3 (PsbQ)
MAQAMASMTGLSQGVLPSRRAASRARTAVVRASAEGEAAAQAGRRAVLGLVATGIVGSVFTQAVRADEAVKTIKIGPPPPPSGGLPGTLNSDQARDFNLALKERFYLQPLPPAQAAARAKSSAQDILNLKPLIDKKAWPYVMNDLRLRASYLRYDLNTVIASKPKEEKKSLKELTGKLFSTIDDLDH

SEQ ID NO: 13984 - DNA, 560 bp, Panicum virgatum
  misc_feature: Ceres CLONE 1772315
  misc_feature: Encodes the peptide sequence at SEQ ID NO. 13985
atatctgttctatagcatgccaaaggatgaagctcagctatatgctgcccatgaactatatagtcgaggatggtttttccataaagaatcaaggttatggttcacaaaaattccaaacgtggaacctctagtcaaaactcatatctatgaacgtgggtcttatggtttctttgacccacagatttgggagacagtccgtaaggacaactttgttctccattacgagctggtagagaaaaggccagccctgccttctgtagcacaaaatgttagatgaaaaaaaatattggtatctccttagtcctaactcaaattctgtccctgctggatgggacagctcatattcacattatggcatcattacctaactcttaaggacggggagaaactcagacactaaggttacactgatctgctgtgaggaaggctgcagaacagaattggggatgtccagttgacagcccttgtaattatactaaaccagtgtagagaatgttgcattttcgtggggagtgcgtactccctgtaaagctaactaatgttcaggattagttgtcttc

SEQ ID NO: 13985 - protein, 91 aa, Panicum virgatum
  misc_feature: Ceres CLONE 1772315
  misc_feature (1)..(78): Pfam Name: NOT2_3_5 Pfam Description: NOT2 / NOT3 / NOT5 family
YLFYSMPKDEAQLYAAHELYSRGWFFHKESRLWFTKIPNVEPLVKTHIYERGSYGFFDPQIWETVRKDNFVLHYELVEKRPALPSVAQNVR

SEQ ID NO: 13986 - DNA, 899 bp, Panicum virgatum
  misc_feature: Ceres CLONE 1772320
  misc_feature: Encodes the peptide sequence at SEQ ID NO. 13987
tctcgcacgcacaccacaagcgagggacccggggcggggcaggaggaaaaaacaagagagagaaggcgtctctctctctcctctctcgccgtccccagcctctcgtcttcgctgcctgcgaaaggagttcgtcatggcatcgaagcgtatcctgaaggagctgaaggacctgcagaaagatccccccacatcatgcagtgcaggccctgctggtgaggacatgtttcattggcaagcaacaattatgggaccgcctgacagtccctatgctggtggtgtgttcttagtgaacattcatttcccgccagactaccccttcaaaccaccaaaggtgtctttcaagacaaaggtcttccatccaaatatcaacagcaatgggagtatatgccttgacattcttaaagagcagtggagccctgctttgacaatttctaaggtcttgctctccatctgctccctgctgactgaccccaacccggatgaccctcttgtccccgagattgcccacatgtacaagacggaccggtcgaagtatgagtcgacagcccgcagctggacacagaagtacgcgatgggctgacaaagcacctctgcagctcaatcggcgacggctctcgtgccgtctcaagaaattgtccgtgggccattatttccttcggtttgtcgctggttgtgtgtatccccgatccatctaggatcgtattgtagtcgatgtccacctaccacccttgccatccatagtgagatggttggacatgctttggctatgcacctatgcttgctgggaaaccttccttcgggtcggtgctattcggtaaatgttaatcgaagacatttatttcattgcctctggctctgtcaggcatgtccattttaaccattttgaatgttggctgttc

SEQ ID NO: 13987 - protein, 148 aa, Panicum virgatum; identical to SEQ ID NO: 12470
  misc_feature: Ceres CLONE 1772320
  misc_feature (5)..(142): Pfam Name: UQ_con Pfam Description: Ubiquitin-conjugating enzyme
  misc_feature: SWISSPROT Homolog: EC 6.3.2.19 Ubiquitin--protein ligase
  misc_feature: Useful for biocontainment applications

SEQ ID NO: 13988 - DNA, 831 bp, Panicum virgatum
  misc_feature: Ceres CLONE 1772346
  misc_feature: Encodes the peptide sequence at SEQ ID NO. 13989
aacgaactccggcctcatctagcttgccgtctctctgcctcgtctccaacggggagggaaaaaaaatcagcggggattcagatgaggctctatctccggcaagcggcggccgcggccacggccaccagctcccccctggcggccaccatccgcaagagttctccaagctccctcacccatggccggctcggcttcagccacgcccacacgtcgctgcagacgacgccgacgccgacgccgaaccaccgcggaaaccgaccagggtgggcggtgcgcgtgcttcccctgacggaggagaacgtggagagggtgctggacgaggtgcggccgagcctgatggcggacggcggcaacgtggcgctgcacgagatcgacggcctcgtcgtcgtgctcaagctgcagggcgcctgcggctcctgccccagctccaccatgacgctcaagatgggcatcgagacgcgcctccgcgacaagatccccgacatcctcgaggtcgagcagatcgtcgacaccgaaaccggcctcgagctcaccactgacaacgtcgagaaggtacttgatgagatcaggccatacctctccggcaccggaggtggaagcctcgagctggtccagatcgatggatatgtcgtcaagattcgaatcggtggacctgcagctggtgtaatgacagttcgtgtagctgtgacacaaaaactgagggaaaagataccttcaatcatggctgttcagctcatagagtagaaagcataagttcatctgtgcatcaatcaacagaacgaaatgtggttttctgctgaatgttggatgtcggtcttatacttttgagtc

SEQ ID NO: 13989 - protein, 220 aa, Panicum virgatum
  misc_feature: Ceres CLONE 1772346
  misc_feature (74)..(141): Pfam Name: NifU Pfam Description: NifU-like domain
  misc_feature (155)..(219): Pfam Name: NifU Pfam Description: NifU-like domain
MRLYLRQAAAAATATSSPLAATIRKSSPSSLTHGRLGFSHAHTSLQTTPTPTPNHRGNRPGWAVRVLPLTEENVERVLDEVRPSLMADGGNVALHEIDGLVVVLKLQGACGSCPSSTMTLKMGIETRLRDKIPDILEVEQIVDTETGLELTTDNVEKVLDEIRPYLSGTGGGSLELVQIDGYVVKIRIGGPAAGVMTVRVAVTQKLREKIPSIMAVQLIE

SEQ ID NO: 13990 - DNA, 854 bp, Panicum virgatum
  misc_feature: Ceres CLONE 1772365
  misc_feature: Encodes the peptide sequence at SEQ ID NO. 13991
agctctccaagcccctctgctctgctctgctctgctctgggccattcactctgcagctcctcctcgctcggtcgctccgctccgctcccatccgcccaaccaccgcgaccgccagcgcctcctctagatcagcgggcgggcactgcccggcgatgacatccgccgtcgccaccaccgtagggtgcgggggccttcccttccgcccgtcctctacggcgcccacacgacgaccccgcggcagatgggttgtccgagctcaagccgcaggagcggacgcctccgacgacaagtcggtggagatcatgcgcaagttctccgagcagtatgcccgccgctccaacacctacttctgcgcggacaaaaccgtcactgccgttgtcatcaagggacttgctgatcacaaggatacattcggagctcctctgtgcccttgtaggcattatgatgacaaagctgctgaggtagcacaaggattttggaactgcccatgcgttcccatgcgtgagaggaaggaatgccactgtatgctttttcttactcccgacaatgattttgctggaaaggaccaggctatctccttggaggagatcaaagaggcgacatcaaagttctaaccccgtgtatttatcgccaaatgtttacttgacagctagttttcttttatatgtatatgtacttatgtagaagcatctataagatatgccaccggagaaattttttcataagatgtgcagtaaacagcacttccgagggctgtcgacgtgtcgatcctatgtggccataagagctcctttgttgtatctgtgctccatttcttgaattaagcgtatggaatacgtctgttcttgactgtc

SEQ ID NO: 13991 - protein, 153 aa, Panicum virgatum
  misc_feature: Ceres CLONE 1772365
  misc_feature (46)..(150): Pfam Name: FeThRed_B Pfam Description: Ferredoxin thioredoxin reductase catalytic beta chain
  misc_feature: Useful for making plants with high aluminum sensitivity
  misc_feature: Useful for making plants with modulated high pH sensitivity
  misc_feature: Useful for making plants with modulated low iron sensitivity
  misc_feature: Useful for making plants with modulated phosphate use efficiency
MTSAVATTVGCGGLPFRPSSTAPTRRPRGRWVVRAQAAGADASDDKSVEIMRKFSEQYARRSNTYFCADKTVTAVVIKGLADHKDTFGAPLCPCRHYDDKAAEVAQGFWNCPCVPMRERKECHCMLFLTPDNDFAGKDQAISLEEIKEATSKF

SEQ ID NO: 13992 - DNA, 662 bp, Panicum virgatum
  misc_feature: Ceres CLONE 1772380
  misc_feature: Encodes the peptide sequence at SEQ ID NO. 13993
gtccccacccggcccagccccccctccctttccttcccctcccctcgtcgctccgctcgctcgtctgcacagcggaatcccccctcctccgccgccgctcctctccgctaccaacctctgccgagatggcaaacgcaagatcaggagtcgcggtgaatgatgactgcatgctgaagttcggcgagctgcagtcgaagaggctgcaccgtttcatagtttacaagatggacgacaagttcaaggagattattgtggataaggttggggatcgtgagaccagctatgaggatttcaccaacagcctacctgaaaatgactgccgatatgctatctatgattttgactttattactgcagaggatgtccaaaagagcaggatcttctatatcctatggtccccatccaccgccaaggtgaagagcaagatgctttacgcgagttcaaaccaaaaattcaagagtgggctcaatggcatccaggtggaactgcaggctactgatgctagtgaaatcagccttgatgagatcaaggatcgagcgcgctaggtgtcatcgcgtgtctcatgatcatgcatcgtggacttgcccactgctgtggatttgtatgccattatagactttatgctatgaaagaccgcttggtgatttatgggtttgttgctg

SEQ ID NO: 13993 - protein, 139 aa, Panicum virgatum
  misc_feature: Ceres CLONE 1772380
  misc_feature (12)..(139): Pfam Name: Cofilin_ADF Pfam Description: Cofilin/tropomyosin-type actin-binding protein
  misc_feature: Useful for making plants with modulated time to senescence
MANARSGVAVNDDCMLKFGELQSKRLHRFIVYKMDDKFKEIIVDKVGDRETSYEDFTNSLPENDCRYAIYDFDFITAEDVQKSRIFYILWSPSTAKVKSKMLYASSNQKFKSGLNGIQVELQATDASEISLDEIKDRAR

SEQ ID NO: 13994 - DNA, 790 bp, Panicum virgatum
  misc_feature: Ceres CLONE 1772397
  misc_feature: Encodes the peptide sequence at SEQ ID NO. 13995
cagtgaaatgcttgcccacgaacacagacagcaagaacaggcgaggccgatctgaatcaagcgagtcgcccccgtttcatcacccccagaaaaaggcgagaaatccccaacggaaggagcagcagcagcagcagcgcaaattctttcctcctcatcttcaccgcgcttgcccacccggatcgaaacccctagggtttcgcatccgcctcccaccgcctactacttcctctccccgtctccctccgccgcgcgcgcgcgcggggagctaccaaaccctaggacggcaaatccggtgcgatcgcccacggtggaggcctcgtcggcggccgagaggagccgatcagggctcgggtcagggttccggtacctcgccggcgccgcctccgggtggttggaccggtggatggtcatgggagccagcggctccaagctcgagaaggccctcggcgaccagttcccggaaggcgagcgctacttcggcctcgagaacttcggcaacacctgctactgcaacagtgtcctccaggcactttatttttgcattccattcagagagcagttactggaatattatgcaaataacaaaaatccaggagacgcagaggaaaatcttttgacttgtttggctgacctttttatgcagataagccaagcaaagaaaaaaactggtgttattgctccaaaacgttttgttcaaagagtgaagaaacagaatgagttgtttcgtagctacatgcaccaggacgcacacgagttcttaaatttcctattgaatgaacttgttgatatt

SEQ ID NO: 13995 - protein, 128 aa, Panicum virgatum
  misc_feature: Ceres CLONE 1772397
  misc_feature (22)..(128): Pfam Name: UCH Pfam Description: Ubiquitin carboxyl-terminal hydrolase
  misc_feature: SWISSPROT Homolog: EC 3.1.2.15 Ubiquitin thiolesterase
MVMGASGSKLEKALGDQFPEGERYFGLENFGNTCYCNSVLQALYFCIPFREQLLEYYANNKNPGDAEENLLTCLADLFMQISQAKKKTGVIAPKRFVQRVKKQNELFRSYMHQDAHEFLNFLLNELVD

SEQ ID NO: 13996 - DNA, 474 bp, Panicum virgatum
  misc_feature: Ceres CLONE 1772407
  misc_feature: Encodes the peptide sequence at SEQ ID NO. 13997
cccccccccggccccgcccgggccaccgacaacgcgcccccccagcaggcccgcgccgccgacggggacgcccccgaccccaaggacaacaccgaccgggagacggggaggccccgcggggacggccacgccacccacacccccgagcaggcgaggcaggacgccaccgaagccaagaacggcaaggagcgcgacggccgcaacaacaccgccaaccattttttgccccgcggcggcggcggcggcggcggccacggcggcggacgacagggcggtttttgcggcggcggcggcggctacggaggcggtggtggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagcc

SEQ ID NO: 13997 - protein, 148 aa, Panicum virgatum
  misc_feature: Ceres CLONE 1772407
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
PPPGPARATDNAPPQQARAADGDAPDPKDNTDRETGRPRGDGHATHTPEQARQDATEAKNGKERDGRNNTANHFLPRGGGGGGGHGGGRQGGFCGGGGGYGGGGGGGGYGGGRREGGYGGGGGGGRREGGYGGGGYGSRGDSGGNWRN

SEQ ID NO: 13998 - DNA, 445 bp, Panicum virgatum
  misc_feature: Ceres CLONE 1772428
  misc_feature: Encodes the peptide sequence at SEQ ID NO. 13999
cggggcggcgccgccgccggcgagggccggcaggaagcgggcgcagggcaaccggagcgaccacaccggcccggccaccaaccagagcacgggggagacgacgacgccgaggccgggggcggggcggggcgggccggcgccgccggcgaaccggaaggcgacggcggggcagaagcccgagacccgcgacgccggcccgcagactttttaccccgccggggtcacgctcgccgacacgctggcctgcggcgccgtcggccacatcatcggcgtcggcatcgtgctcgggctcaagaacaccggcgcgctcgaccagatcatcggctaggtccagtgtctgcctttgccgctctcggcgccggcccggtgcccatgtaacctgcgtgtgtacatcgactctgcgctcatgcatctcgttccaatggacatagcttgtttgttgctc

SEQ ID NO: 13999 - protein, 108 aa, Panicum virgatum
  misc_feature: Ceres CLONE 1772428
  misc_feature (23)..(103): Pfam Name: PSI_PSAK Pfam Description: Photosystem I psaG / psaK
GAAPPPARAGRKRAQGNRSDHTGPATNQSTGETTTPRPGAGRGGPAPPANRKATAGQKPETRDAGPQTFYPAGVTLADTLACGAVGHIIGVGIVLGLKNTGALDQIIG

SEQ ID NO: 14000 - DNA, 831 bp, Panicum virgatum
  misc_feature: Ceres CLONE 1772440
  misc_feature: Encodes the peptide sequence at SEQ ID NO. 14001
atcacaccactcgaattatcgcgcccagattccccatttttcgctcctccaaaactctcccgaagccgtttcaaaaaaaaaaaaaaactctcccgaagcgctgcagcagcgaccatggacgccagcggagccaccgggaaggtgaagaagggggcggccgggcgcaaggccggcggtcccaggaagaaggcggtgtcgcggtccgtgaaggccgggctccagttccccgtcagccgcatcgggcgctacctcaagaagggccgttacgcgcagcgcgtcggcaccggcgcccccatctacctcgccgccgtcctcgagtacctcgccgccgaggtgctggagctcgccgggaacgcggcgagggacaacaagaagacgcgcatcatcccgcgccacgtgctcctggcgatccggaacgacgaggagctcgggaagctgctggccggtgtcactatcacccacggcggcgtcctccccaacatcaacccggtgctgctgcccaagaaggtggcggagaaggcggccagcggcggcgccaaggaggccaagtcgcccaagaagggcgccaagtcccccaagaaagcctagacagtagagactccattagcaccgtgctgtaataacatgttcgtgtttagatttgtggttgggttgtgcccgttcgtcagttgttactatgttctgtttcttgttcacatttgcaatttgggtttgcggttcagttcagagtagtacggaatgagcagtgactacaactctgcgtcagaagagacttatgaagatgtaatcacagttgtatcctgaaatcactgtcccggcatctggttcagc

SEQ ID NO: 14001 - protein, 157 aa, Panicum virgatum
  misc_feature: Ceres CLONE 1772440
  misc_feature (29)..(102): Pfam Name: Histone Pfam Description: Core histone H2A/H2B/H3/H4
MDASGATGKVKKGAAGRKAGGPRKKAVSRSVKAGLQFPVSRIGRYLKKGRYAQRVGTGAPIYLAAVLEYLAAEVLELAGNAARDNKKTRIIPRHVLLAIRNDEELGKLLAGVTITHGGVLPNINPVLLPKKVAEKAASGGAKEAKSPKKGAKSPKKA

SEQ ID NO: 14002 - DNA, 609 bp, Panicum virgatum
  misc_feature: Ceres CLONE 1772463
  misc_feature: Encodes the peptide sequence at SEQ ID NO. 14003
cagacaagctagctatggcggcgacgccgacctgcaggagtgcctgcgccggtgggccgccgacggccgcctcgcgcgcgtcacggggaccgcctgcgacgtcgcggcgcgcgccgaccgggagcggctcgtggccgctgcgcgggaggagctgggcggccggctggacatcctcgtcaacaacgcagggcagaccatgttccggcccgccacggagaccacggcggaggactacgcgcgcctcatggccaccaacctcgagtcctgcttccacctcgcgcagctcgcgcatccactcctcgtcgtggcggcgtcgtcaggcggcggcgactccagcagcgtcgtcaacgtctcctccatcggcgggattgtctcctacccggcgctgtccgtgtactcggcgaccaagggcgccatgaaccagctcacccgcagcctcgccgtcgagtgggcgaaggacaacgtgcgcgtcaactgcgtcgcgccgggtggcgtccggaccgacatcgccagcagcagcggcctcaagctggacccggaggtggcgcggaagatgggcgaggcggaggtggcgcgggttcccctgcgccgcatcggcgagccggagga

SEQ ID NO: 14003 - protein, 202 aa, Panicum virgatum
  misc_feature: Ceres CLONE 1772463
  misc_feature (1)..(151): Pfam Name: adh_short Pfam Description: short chain dehydrogenase
  misc_feature: SWISSPROT Homolog: EC 1.1.1.206 Tropine dehydrogenase
RQASYGGDADLQECLRRWAADGRLARVTGTACDVAARADRERLVAAAREELGGRLDILVNNAGQTMFRPATETTAEDYARLMATNLESCFHLAQLAHPLLVVAASSGGGDSSSVVNVSSIGGIVSYPALSVYSATKGAMNQLTRSLAVEWAKDNVRVNCVAPGGVRTDIASSSGLKLDPEVARKMGEAEVARVPLRRIGEPE

SEQ ID NO: 14004 - DNA, 584 bp, Panicum virgatum
  misc_feature: Ceres CLONE 1772492
  misc_feature: Encodes the peptide sequence at SEQ ID NO. 14005
tgctctctcagaggtgggttggcttctcctccccctccagttcggttcggttcgggttcgtgaggttcttggggttccgttcgggggtgagaggaagagatggaggcgtcggatgttgagtaccgctgcttcgtcggcggccttgcctgggccaccgacgacaactcgctccacaacgccttcagcacctacggcgaggtcctcgagtccaagatcatcctcgatcgggagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgctcctcagggtgctctagcaagtggggggaaaaaatctccgccgttctttcgttaaatttggagctcttgttttcttttttttggtgtgcttggatgggctctgaagaggagtcgtagtagtggaggagtgtgttgtgttgggttgatttagtagcgtggatttgcggaagcgattgattc

SEQ ID NO: 14005 - protein, 119 aa, Panicum virgatum
  misc_feature: Ceres CLONE 1772492
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with altered alkaloid content
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSTYGEVLESKIILDRETQRSRGFGFVTFSSEQAMRDAIEGMNGKELDGRSITVNEAQSRGGPRSGGGGGYGRRAPQGALASGGKKSPPFFR

SEQ ID NO: 14006 - DNA, 863 bp, Panicum virgatum
  misc_feature: Ceres CLONE 1772494
  misc_feature: Encodes the peptide sequence at SEQ ID NO. 14007
tttcgtgacacagcaagagccgatccctgcagcagcagagtacaatcagccagactgcctactagttgctgggagtgcgcgcaatggcgtccgctgcgaggttcctggccgtggtcatggcgtgcgcgctcctgggcagcaattcgtgccacgcggcgcgccacctggccgacacgaccgcggcagccgcggctcccgctgccgccgtcccaggcctcccggccgtgctcaccttgccgacggtgccccagatgcccgcggccaccgtgccgccggtgacgctgccatccatgccggcggttccggcggtcaccgtgccccaggtggcgctgccgcccatgcccgccgttccgtccgttcccaaggtggcgctgccgcccatgcccgccgtaccgttcgtgcccaaggtggcgctcccgccgatccccgccgtcccgtccgtgccaaaggtggcgctgccgccgatgccctcgatcccgaacgccaacatccccatgccgtccctggcgccgcccccgtcggcgtagggaggagcgctcgccgcgggcgcgcgcggcgtgcgatgccgatgccatggccgtgcccatcgtccggcggccggtttggttgcgtggtgggttcgcgtgatcactggctgctagctcttttgtttgcgtgtctggagcacgcgagtatttttgtttctgttgaagacttgaagtgccgtgccattgttcgtatggacacattttttttaggggtgttcgtatgtacatatgtactaccatttctttcgtgtatgtcttattttctggttctcagtttcgacctgtgggcctacacttctattttgaaaccgaaagatttgtcgtctgtttctctcc

SEQ ID NO: 14007 - protein, 147 aa, Panicum virgatum
  misc_feature: Ceres CLONE 1772494
  misc_feature: SWISSPROT Homolog: EC 2.7.11.1 Non-specific serine/threonine protein kinase
MASAARFLAVVMACALLGSNSCHAARHLADTTAAAAAPAAAVPGLPAVLTLPTVPQMPAATVPPVTLPSMPAVPAVTVPQVALPPMPAVPSVPKVALPPMPAVPFVPKVALPPIPAVPSVPKVALPPMPSIPNANIPMPSLAPPPSA

SEQ ID NO: 14008 - DNA, 915 bp, Panicum virgatum
  misc_feature: Ceres CLONE 1772502
  misc_feature: Encodes the peptide sequence at SEQ ID NO. 14009
gagattggcctctccatttcctaccgcatcctgcttccctccctccctcgcgacatccaggcgacggcggcctctccttgcggcgtctaggcttcccctcccggtgcgcggcgaagccccgcggggggcctttctggcgcgcgtccacgaccctcgggagccccttctaacctaggcgaagtacaccatagcttgttcttggaggaggggtttcctgaggaagcggcagccagttagccatgtcgtcctccttgctgagggctgcggctgacagggccatccggaggcaggccctcacgctgacggatgccgcggcgtccaggatccggcagctcctcagcctcaggcagcggccgtacctgcggcttggcgtcaaagcccgaggctgcaacggcctctcatatacgctcaactatgccgatgagaaggggaagtttgatgagcttgtcgaggagaaaggggttaaagtgcttatcgaccccaaggcattaatgcatgttattggaaccaagatggactatgttgatgatccactgaagtccgagtttgtgttcataaacccaaattccaaagggaagtgtggctgcggtgaatcctttatgactacaagcagcaaagggtccacatcatgatgcgttttgcgttgtaaatggataagcaaagtatcggaggcctcagctactgattttgttgggtctgttgtgttgcaaccctgcaggacatgccacaagagtggttacctagtggatgcacctaacttacatgtacttctttgttcaccctagcattttatatacatggagtgatttatccatgttctgtatactttgatggctcacgatataagacctcaaaagttttataaaatttttagcgccatgcttgttcaatggaactctttgaagttcatggtgc

SEQ ID NO: 14009 - protein, 130 aa, Panicum virgatum
  misc_feature: Ceres CLONE 1772502
  misc_feature (19)..(108): Pfam Name: Fe-S_biosyn Pfam Description: Iron-sulphur cluster biosynthesis
MSSSLLRAAADRAIRRQALTLTDAAASRIRQLLSLRQRPYLRLGVKARGCNGLSYTLNYADEKGKFDELVEEKGVKVLIDPKALMHVIGTKMDYVDDPLKSEFVFINPNSKGKCGCGESFMTTSSKGSTS

SEQ ID NO: 14010 - DNA, 547 bp, Panicum virgatum
  misc_feature: Ceres CLONE 1772505
  misc_feature: Encodes the peptide sequence at SEQ ID NO. 14011
gacggaccatgtactccaagaccgacgagtgctacgacgccggcaggcacggcagccggagggtgtactcccacaccgacgagtgctacgacgacgtggaccgcaggaggccgggggcctacgccgacgactgctacaacggcgccagctacggcggcgccaggcaggccgccgtctactccgacgagtactcccgcggcggctacggctacggcggcgagttttatttcttcaagagggaggagagggagcacaagcacaaagagcgcctcggcgagataggcgccctcgccggcggcgccttcgcactgtacgagggtcaccgtgcgaagaaggacccggagcacgcgcagaggcacaagatggaggcgggcgtggcgacggcggcggcgctgggtgccggcggctacgcgtaccacgagcaccgcgagcagaaggaggcccgctacgagggcaaggaccacagcagggtgccgcacggctactactgcaactagctcatcattatattactagctacttggatcgatcgagtcatgcatgcatc

SEQ ID NO: 14011 - protein, 162 aa, Panicum virgatum
  misc_feature: Ceres CLONE 1772505
  misc_feature (73)..(152): Pfam Name: ABA_WDS Pfam Description: ABA/WDS induced protein
MYSKTDECYDAGRHGSRRVYSHTDECYDDVDRRRPGAYADDCYNGASYGGARQAAVYSDEYSRGGYGYGGEFYFFKREEREHKHKERLGEIGALAGGAFALYEGHRAKKDPEHAQRHKMEAGVATAAALGAGGYAYHEHREQKEARYEGKDHSRVPHGYYCN

SEQ ID NO: 14012 - DNA, 981 bp, Panicum virgatum
  misc_feature: Ceres CLONE 1772518
  misc_feature: Encodes the peptide sequence at SEQ ID NO. 14013
tctctctcatcatcgtcgccacctccatccccttcggcctccgatccctccacgagtcgagcagaggatccgcggcggcggtggtggcggcgggcggtggtcggccggcgatggcgcaccgggtggacaacgagtacgactacctcttcaagatcgtgctcatcggcgactccggcgtcggcaagtccaacatcctctcccggttcacccgcaacgagttctgcctcgagtccaagtccaccatcggcgtcgagttcgccacccgcaccctccagatagaaggaaagaccatcaaagctcagatatgggatactgctgggcaagagaggtaccgtgcaatcactagtgcttactacagaggagctgtgggtgcacttttagtctacgacatcacaaagaagctgacatttgaaaatatccagaggtggcttcgtgagctccgggatcatgcggactccaacattgtgatcatgatggttggtaacaaatcggatctgaaccacctgagatcagttccagaggaagatggccaggcattagcggagaaggaaggcttatccttcctggagacatcagctcttgaagccctgaatgttgagaaggcatttcagactatcctcgctgatattcatcaaatcataagcaagaaggcgcttgctgcccaggaggcagcaggcaccgggccaccaggtcaaggaaccaccatcaatgttgctgactcatctgccaacacaaagaaaggatgctgttcttcctaggggcaaacaaagatgtgatggtgatgcaaaaggaaaatataatggatcttacaacactgtaggtgttatgtaggttgcctcgactccttttggcctgtaactctggtgaggttgtaatcacaattcatacttctgcaaagaaattctcctctctggtagatattttggtaaagaccagtgtttggcagacttgcttcgagagtgtgttttctttcagtgctct

SEQ ID NO: 14013 - protein, 215 aa, Panicum virgatum
  misc_feature: Ceres CLONE 1772518
  misc_feature (14)..(175): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
  misc_feature: Useful for making plants with altered lignin content
  misc_feature: Useful for making plants with altered alkaloid content
  misc_feature: Useful for making plants with altered terpenoid content
MAHRVDNEYDYLFKIVLIGDSGVGKSNILSRFTRNEFCLESKSTIGVEFATRTLQIEGKTIKAQIWDTAGQERYRAITSAYYRGAVGALLVYDITKKLTFENIQRWLRELRDHADSNIVIMMVGNKSDLNHLRSVPEEDGQALAEKEGLSFLETSALEALNVEKAFQTILADIHQIISKKALAAQEAAGTGPPGQGTTINVADSSANTKKGCCSS

SEQ ID NO: 14014 - DNA, 880 bp, Panicum virgatum
  misc_feature: Ceres CLONE 1772536
  misc_feature: Encodes the peptide sequence at SEQ ID NO. 14015
agattcgacgaggaaacccaaagcgggagcgcgcgcgcatcaaggagttcttctatctacccagcatggagaccgagttccaggatggcaagcaggaggttattgaagcatggtacatggatgacagtcaagaagaccagagacttcctcatcaccgtgaacccaaagaattcattcctctggagaagctttcagaactaggaatcgtcagctggcgcctaaaccctgataactgggagaatgatgagaacctcaagaaaattcgtgaagccagaggttactcttacatggacatttgtgatgtatgcccggagaaactgccaaattatgagactaagattaagaatttctttgaagagcacctgcatactgatgaagaaatacgctattgccttgaagggagtggatactttgatgtgagggatgaaaatgatcagtggatccgtgtagcagtgaagaagggaggcatgattgttctgcctgcagggatgtatcaccgcttcacattggacactgacaactacatcaaggcaatgcggctcttcgttggtaatcctgtttggacgccgtacaaccgtccccatgatcatctgccagagaggaaggagtatctggacaagcttatcaaggcagaaggtggagatcaagctattgaagctcgctgaggccactttgaacctacctgttgggctgttccgatgcgtactatgtacaatctgaataagatgttgcatgtccttacttatgtagtgtgttctggtcagttttaagtgaatctgtgaacatggttcctgtcaactgtgtgtatcggttcaactggcctgacccctacattatattgctgtccatatcttgaataaatagaaacgggtgccgctac

SEQ ID NO: 14015 - protein, 199 aa, Panicum virgatum
  misc_feature: Ceres CLONE 1772536
  misc_feature (14)..(168): Pfam Name: ARD Pfam Description: ARD/ARD' family
METEFQDGKQEVIEAWYMDDSQEDQRLPHHREPKEFIPLEKLSELGIVSWRLNPDNWENDENLKKIREARGYSYMDICDVCPEKLPNYETKIKNFFEEHLHTDEEIRYCLEGSGYFDVRDENDQWIRVAVKKGGMIVLPAGMYHRFTLDTDNYIKAMRLFVGNPVWTPYNRPHDHLPERKEYLDKLIKAEGGDQAIEAR

SEQ ID NO: 14016 - DNA, 403 bp, Panicum virgatum
  misc_feature: Ceres CLONE 1772551
  misc_feature: Encodes the peptide sequence at SEQ ID NO. 14017
  misc_feature (152)..(152): n is a, c, t, g, unknown, or other
  misc_feature (153)..(153): n is a, c, t, g, unknown, or other
  misc_feature (156)..(156): n is a, c, t, g, unknown, or other
aagaccaagagccaggacaaggaaggaaccccgccggaccagcagcgcccgagccgcgccgggaagcagcgggaggacggccgcacgcgggcggaccacaacaaccaaaaggagcccacgccccaccgcgggcccaggcgccggggggggannagngagcccgcgcggcaggcgcccgcacgcaagtattttttggacaagatgatctgccgcaaatgctacgcacgcctgcaccccagggccgtcaactgccgcaagaagaagtgtggccacagcaaccagctgaggcccaagaagaagatcaagaactgaggtgtgttgctgctaatcagtttcatcgaccgtttaaatcatctgttgtagtggtgtaccgtatgctgtgttgtgttgttgtcgggatgtt

SEQ ID NO: 14017 - protein, 103 aa, Panicum virgatum
  misc_feature: Ceres CLONE 1772551
  misc_feature (51)..(102): Pfam Name: Ribosomal_L40e Pfam Description: Ribosomal L40e family
  misc_feature (51)..(51): Xaa is any aa, unknown, or other
  misc_feature (52)..(52): Xaa is any aa, unknown, or other
KTKSQDKEGTPPDQQRPSRAGKQREDGRTRADHNNQKEPTPHRGPRRRGGXXEPARQAPARKYFLDKMICRKCYARLHPRAVNCRKKKCGHSNQLRPKKKIKN

SEQ ID NO: 14018 - DNA, 438 bp, Panicum virgatum
  misc_feature: Ceres CLONE 1772571
  misc_feature: Encodes the peptide sequence at SEQ ID NO. 14019
caccacaagagggacgaggaggagcagcccgccggcggggacggcggcgaggccgccaccgccgagaacacggagaccaccgagacggagggggagcccaccggcgaggacgagcacgagaaggacaagaaggaggagaaggagcacaagcacaagcagcaccacggcgagacaggcgccagcgccgccggcgccagcgcgccgttttttttgcacgaggcgaagaaggaccccgagcacgcgcaccggcacaagatcgaggattatatcgcggcggcggcggccgtgggctccggcgactacgccttccacgagcaccacgagaagaagaaggaccacaaggacgccgaggaggccggcggcgagaagaagcaccaccacctcttcggctgatgtgtccagtcgacgactcagtacatacgtgtgcggcggccccac

SEQ ID NO: 14019 - protein, 130 aa, Panicum virgatum
  misc_feature: Ceres CLONE 1772571
  misc_feature (40)..(119): Pfam Name: ABA_WDS Pfam Description: ABA/WDS induced protein
HHKRDEEEQPAGGDGGEAATAENTETTETEGEPTGEDEHEKDKKEEKEHKHKQHHGETGASAAGASAPFFLHEAKKDPEHAHRHKIEDYIAAAAAVGSGDYAFHEHHEKKKDHKDAEEAGGEKKHHHLFG

SEQ ID NO: 14020 - DNA, 668 bp, Panicum virgatum
  misc_feature: Ceres CLONE 1772593
  misc_feature: Encodes the peptide sequence at SEQ ID NO. 14021
gattatgctactgctgtaaaactctactctatggcagcagatcagtgccctgatgactcaaccttgtactcaaataggtgcctttgctggcttaagatgggtgaaggggaccaagcgttgagtgattctggaatttgcaggatgcagcgccctggctgggcaaaggcttgctacctgcaaggagctgctcagatgttacttaaggactatgaaaaggcatgcgatgcatttcttgatggtctcaaactggacccagcaaatgttgagattgagaaagcgttatgggaggccatcaactgcttgaagacatctcacacaaccaagtaatttgtcagatctctcttttgccaaggggttactccagaagttccatgactttcgctagttcctcatcaacgtgtaaagggttattgagtttacaacccctccggtcttgttaatatgagttctttgattcgtcctgctaactctcgattaggtcatgaagaattatcaagtctcttctttctgcgtgtgctaggtcgtactaggtagtatttgcttggaaatgctggccttgtaggtctcgtaatgtcataacaccatgacccttattttttatcagctctcaacccaactctgcgctactatgtgctgataaaaagtacactatatagagttgttggatc

SEQ ID NO: 14021 - protein, 108 aa, Panicum virgatum
  misc_feature: Ceres CLONE 1772593
  misc_feature (54)..(87): Pfam Name: TPR_2 Pfam Description: Tetratricopeptide repeat
  misc_feature: SWISSPROT Homolog: EC 3.1.3.16 Phosphoprotein phosphatase
  misc_feature: The sequence is a functional homolog of SEQ ID NO 1843 in the 10/374,780 US patent application
  misc_feature: The sequence is a functional homolog of SEQ ID NO 1842 in the 10/374,780 US patent application
  misc_feature: The sequence is a functional homolog of SEQ ID NO 1845 in the 10/374,780 US patent application
DYATAVKLYSMAADQCPDDSTLYSNRCLCWLKMGEGDQALSDSGICRMQRPGWAKACYLQGAAQMLLKDYEKACDAFLDGLKLDPANVEIEKALWEAINCLKTSHTTK

SEQ ID NO: 14022 - DNA, 187 bp, Panicum virgatum
  misc_feature: Ceres CLONE 1772598
  misc_feature: Encodes the peptide sequence at SEQ ID NO. 14023
gcgtcttcatggcgcagcgagaggcgcctgtgggcaaggctccatgccgcgggcaaggaggcgggacgaggcccgctgggcacgtcgtcgacctggagacttggcggggagcgagtggcggggccagaagggcgggcggcgtgggcggccgcggcggccgtggcgggggcggggctggcggggtggt

SEQ ID NO: 14023 - protein, 59 aa, Panicum virgatum
  misc_feature: Ceres CLONE 1772598
  misc_feature: The sequence is a functional homolog of SEQ ID NO 468 in the 11/479,226 US patent application
MAQREAPVGKAPCRGQGGGTRPAGHVVDLETWRGASGGARRAGGVGGRGGRGGGGAGGV

SEQ ID NO: 14024 - DNA, 843 bp, Panicum virgatum
  misc_feature: Ceres CLONE 1772693
  misc_feature: Encodes the peptide sequence at SEQ ID NO. 14025
gcagcctcttctcccatcgccggtctccccgaagtcttcgaaaccctaatcccccaaatccccgacgccaagcgacacgccgcgcaccggagttctcgaggaggaagcatgagtcgccatccgaccactaagtgggcgcagaggtccgacagggtgttcttgacgattgagttgcccgatgccaaggatgtgaagctgaacttgaagcctgagggcaatttcaacttctcggcaaaaggctctgatgacttgccctatgagtttgacctcgagctgtttgatgctgttaatgtggaggagagcaaagcagctgttgccccaaggactatatgctacctgatcaagaaagctgagagcaagtggtggccaaggctgctgaaaaaggagggcaagccacctgttttcttgaaggttgactgggacaaatggcaggatgaggatgatgaggatatcggatttaatgattttgatggtatggacttctcgaaacttgacatgggtggtgctgatgatgaggatattgaggacgatgaagatgatgtggttgaaagtgctaacaaagatgaaggtgctaaggagagcaaggaggaggaagcagctccagcagcagctggtgcagaggaagctaaaccatgaagaagcaattgagtttgctcgacaacatcagtgaccacgcatgatatccagctagactagatgttcccttagatttttggtgtaaaatctggaggatggatcgatcactcactagtcacagcatatgaagtatggaaaaccagtcttgctgttggtagtttttggctgaaccttgtgaagtgctggtataatatttggtcacaacgt

SEQ ID NO: 14025 - protein, 175 aa, Panicum virgatum
  misc_feature: Ceres CLONE 1772693
  misc_feature (5)..(80): Pfam Name: CS Pfam Description: CS domain
  misc_feature: SWISSPROT Homolog: EC 5.3.99.3 Prostaglandin-E synthase
MSRHPTTKWAQRSDRVFLTIELPDAKDVKLNLKPEGNFNFSAKGSDDLPYEFDLELFDAVNVEESKAAVAPRTICYLIKKAESKWWPRLLKKEGKPPVFLKVDWDKWQDEDDEDIGFNDFDGMDFSKLDMGGADDEDIEDDEDDVVESANKDEGAKESKEEEAAPAAAGAEEAKP

SEQ ID NO: 14026 - DNA, 771 bp, Panicum virgatum
  misc_feature: Ceres CLONE 1772700
  misc_feature: Encodes the peptide sequence at SEQ ID NO. 14027
ctagtcagccggatcgctgcgtcgctccgcctcctcctcggcctcccaccctcgcgcggcgccttcctcggttcttcggtccagcttgggagatgtcggactccgaggagcaccatttcgagtcgaaggccgacgccggagcgtccaagacttacccgcagcaggccggcaccatccgcaagaacggctacatcgtcatcaagggccgcccgtgcaaggtggttgaggtctccacttccaagacagggaagcacggtcacgcgaaatgccacttcgtggccattgatattttcaacggaaagaagcttgaggatattgtaccctcttcccataactgtgacgtgccccatgtcaaccgtactgactaccagctgattgacatatctgaagatggatttgtcagccttttgactgaaaatggaggcaccaaggatgatctgaggctccctactgatgaaactctgctttcccagattaaagctggattcgatgatgggaaggacctgattgttagtgtgatgtctgccatgggtgaggagcagatctgcggtctgaaggatatcggcaagaactagagcttcattgccactggtggttatttatctggccgtctatctgggaggtggtgtgttgatgatataagcgtgtttggttatgagtaacatgcttgtggactgccgttttgtcttgccgtttatgcagagtgatttggatgtacctttgctatctgtaatgttcttttgaaccaagtagcttggctacacctcatcg

SEQ ID NO: 14027 - protein, 160 aa, Panicum virgatum; identical to SEQ ID NO: 10137
  misc_feature: Ceres CLONE 1772700
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif

SEQ ID NO: 14028 - DNA, 726 bp, Panicum virgatum
  misc_feature: Ceres CLONE 1772711
  misc_feature: Encodes the peptide sequence at SEQ ID NO. 14029
agaacagagacggcagtcgaagcgaccgtccgtccggagctgcgcgcgaggcaaggccatccgccatgacgctctccctctccaccgccttcctccccacccccgtcgccgcgagggccacggcccgcaccctccgctccgtcgtcccgtcacagggaatgcgctgctcgatgcgcaagaaggggctgcacccgcagatctacgaggacgcgaaggtgtactgcaacggcgagctggtgctggtgacggggggcaccaagccggagtacacggtggacgtgtggtccgggaaccacccctactacgtcggcgacacctcggcgctggtggtgatggacagccaaatcgagaagttccgcaagaagtggggccacatcaaggagtactggcccgaggaccagtggagggagatgcaccccgacggcgacccggagttcgagcccgagggggacaactgatcgacggcggctcctcattcatcatcgtcttcctcctcctcttcttcccgccctcgcccggtgcgtggtcacggctcctgtttaccatgctctcttggttggaatttgagacttggcccgttcgcaatgctctccaggtgttcgattaatgttcgcaatgtaatcgtaccagtatgtgacggtgtcttgcttgtgcagtgcactctaatcttagtattcatatatgatcctgccgattgccatgagatctgagcagcattgttacttc

SEQ ID NO: 14029 - protein, 130 aa, Panicum virgatum
  misc_feature: Ceres CLONE 1772711
  misc_feature (36)..(104): Pfam Name: Ribosomal_L31 Pfam Description: Ribosomal protein L31
MTLSLSTAFLPTPVAARATARTLRSVVPSQGMRCSMRKKGLHPQIYEDAKVYCNGELVLVTGGTKPEYTVDVWSGNHPYYVGDTSALVVMDSQIEKFRKKWGHIKEYWPEDQWREMHPDGDPEFEPEGDN

SEQ ID NO: 14030 - DNA, 882 bp, Panicum virgatum
  misc_feature: Ceres CLONE 1772732
  misc_feature: Encodes the peptide sequence at SEQ ID NO. 14031
tccacggctcccgtcgcgtcgcgcctctcctttccccaaccgattcccgaccgccacgccagccaccgccgctctctcctcgaccgcatccctccgccttcgcctactccgtcgccggcaggcacaccgacccctaggccctcgccgccgctccaaccatggccaatacgctgcggttgtacctcacttgcatccgaaacactctggaggcggcgatgtgcctccagaattttccttgccaagaagttgagaggcacaacaagccagaggtggagctcaagacgagccctgaacttctactgaacccggtactcatctgccgcaatgaagcagaaaaatgtttaataaagacttcaataaactctatacgtataagcatgaaggttaagcaagcagatgaactggaaaacattcttgcaaagaaatttcttaggtttttatcaatgagggccgaggcattccaagtgttgaggagaaaaccagttcagggttatgatatcagttttctgataacaaactaccattgcgaggacatgcataagcacaagctcatagatttcattgtgcaatttatggaggacattgacaaggagatcagcgagttaaagctgtcagtaaacacccgcggccggcttgtggcgactgaatttttgaagcagttcatatgatgactcagccataggtgctgtagtccagtgctgataaacgtcatgatcatggcctgtgactacgcctctgttgctcagcttaggttttgtttcttcactctgatttctgtaaatgccttgtggaggacacattcttggttccagagcacctgattaacagctgacaattgacttataaggcgatttgcgcttattacaattggttgtgttgtac

SEQ ID NO: 14031 - protein, 169 aa, Panicum virgatum
  misc_feature: Ceres CLONE 1772732
  misc_feature (1)..(168): Pfam Name: ARPC4 Pfam Description: ARP2/3 complex 20 kDa subunit (ARPC4)
MANTLRLYLTCIRNTLEAAMCLQNFPCQEVERHNKPEVELKTSPELLLNPVLICRNEAEKCLIKTSINSIRISMKVKQADELENILAKKFLRFLSMRAEAFQVLRRKPVQGYDISFLITNYHCEDMHKHKLIDFIVQFMEDIDKEISELKLSVNTRGRLVATEFLKQFI

SEQ ID NO: 14032 - DNA, 664 bp, Panicum virgatum
  misc_feature: Ceres CLONE 1772736
  misc_feature: Encodes the peptide sequence at SEQ ID NO. 14033
gagagaaaaaaaatcgatggcggcgggcggcggcggcggcgacggcgagttctacctgcggtactacgtggggcacaagggcaagttcgggcacgagttcctcgagttcgagttccgccccgacggcaagctccgctacgccaacaactccaactacaagaacgacaccatgatccgcaaggaggtcttcgtctccccctccgtgctccgcgaggccaggaggatcatccaggagtccgatattatgaaggaggacgacagcaactggccggagcccgaccgcatcggccggcaggagctcgagatcgtcatgggcaacgagcacatctccttcaccacctccaagatcggctccctcgtcgatgtccagtccagcaaggacccggagggcctccggatcttctactacctcgtccaggatctgaagtgttttgtgttttcgctcatcaacctccacttcaagatcaaaccaattcagtcctgagctccattccatgctgtttcttaactgtgttacgaaactgcgagtgtttaatttgtgacgatgtacccatgtaccatgtaagttcctatttagtttgtgatgatgtgctcgggttgtggagcactgggtgtgggtggaagtggagcatagagtttgcctgggattgctatttgggttgtg

SEQ ID NO: 14033 - protein, 155 aa, Panicum virgatum
  misc_feature: Ceres CLONE 1772736
  misc_feature (11)..(153): Pfam Name: Mago_nashi Pfam Description: Mago nashi protein
MAAGGGGGDGEFYLRYYVGHKGKFGHEFLEFEFRPDGKLRYANNSNYKNDTMIRKEVFVSPSVLREARRIIQESDIMKEDDSNWPEPDRIGRQELEIVMGNEHISFTTSKIGSLVDVQSSKDPEGLRIFYYLVQDLKCFVFSLINLHFKIKPIQS

SEQ ID NO: 14034 - DNA, 904 bp, Panicum virgatum
  misc_feature: Ceres CLONE 1772749
  misc_feature: Encodes the peptide sequence at SEQ ID NO. 14035
aactcccgaccaacagaccgctaactggctccctccaattcaatccgccattccccacaagaacaggacaccgccggcgaccacgagggagcgcaccagctctcttgtttcctcgtgtccccaccagaacaagaaccaccaagagcaggctcagagagatccatcgatccggccgtcggcgaggccatttttagttgctccggcttaactaattagatgcgagccggcgcccttctgatccatcatctccgccacgtcgccatggccagccaaagccagtacaccggtcccaagcccacaacagctttcggcgccgcgagggggcagaacacggcgttcccggcttcggtggcgatgaagcgccgcggccgcggcggcggcatcgggggtagctacttgggcgcggaggcggcggcgctgctggcctgtttcacggcgacactgctggtgctgccgctgctgctgccccctctgcccccgccgccgccaatgttcctgttcgtgcccgtcggcatcttcgccgtcctgctcctgctcgtgttcgtccccttcgacgccaggggcgccgtcactgtcgggcccccatcctcctgctcctcccctagtccccctacggtcctacttgtagttgtactagcttaattagtcgactaggtcaggtgatcgacctcgtcgtcgccggcatgtaatgtaattaaacgcgcgcggatgagatgtgctcgctcctcgtcttctcttctggagattaattacttagggcaacgcaggaatttcacagaattatcataggagtttcaaaaaattagtttagtttcgcagaaattttacaggattcagaaaaaaaaatcctccaatccgatggatgagacggtaatatgaaacgatcagtgctgatttcgtttct

SEQ ID NO: 14035 - protein, 126 aa, Panicum virgatum
  misc_feature: Ceres CLONE 1772749
  misc_feature: Useful for making plants with modulated biomass
  misc_feature: The sequence is a functional homolog of SEQ ID NO 2 in US patent 7151206
MASQSQYTGPKPTTAFGAARGQNTAFPASVAMKRRGRGGGIGGSYLGAEAAALLACFTATLLVLPLLLPPLPPPPPMFLFVPVGIFAVLLLLVFVPFDARGAVTVGPPSSCSSPSPPTVLLVVVLA

SEQ ID NO: 14036 - DNA, 730 bp, Panicum virgatum
  misc_feature: Ceres CLONE 1772755
  misc_feature: Encodes the peptide sequence at SEQ ID NO. 14037
atccaccctctccgcccccgttggtcgtcgtgtcgtggacagaaaggaatcaacaatcaaggaagcaaccaccaaatcgaatcccaatcccagaagaggggatggtgggcaagggcgaggccccggctccgcgtgagcccgaggaggaggaggacaccggaggcgtcgtcaagctcatcagcgccgagggcttcgagttcgtcgtcgataagaaggcagccatggtctccaacaccctgcggaacatgctcacgtcgccagggggcttctccgagacgcgccagggcgaggtccgcttcccggagatctctacccacatcctcgagaagatctgccagtacttctactggtcgctccattactccagtgggaaggagacggcggagtttccaattgagcccgagataaccctggacctgatgatggccgcaaactacctggacacttgaggttgaggaagttgagggagcaactgttgtgctgcaacataggtgcatcatgaatggatgaaacaagtgaatcatcccaacctcgtcgtgtttacatccaacatcctccagatgggattttttcttctttttttccatggatccaatccaatttgatctaatccggtgttatgtaatggagtgtaagcatggaatgggacatgtaaaatgtgtgctagtagttttctaatccacctgcagtgtgtaacagcctgcgactgctgatactaagacatagtacc

SEQ ID NO: 14037 - protein, 115 aa, Panicum virgatum
  misc_feature: Ceres CLONE 1772755
  misc_feature (21)..(83): Pfam Name: Skp1_POZ Pfam Description: Skp1 family, tetramerisation domain
MVGKGEAPAPREPEEEEDTGGVVKLISAEGFEFVVDKKAAMVSNTLRNMLTSPGGFSETRQGEVRFPEISTHILEKICQYFYWSLHYSSGKETAEFPIEPEITLDLMMAANYLDT

SEQ ID NO: 14038 - DNA, 264 bp, Panicum virgatum
  misc_feature: Ceres CLONE 1772762
  misc_feature: Encodes the peptide sequence at SEQ ID NO. 14039
agggaaagaagatttttttcagctacagcaagatcctaaaagatctcaagaaagagttctgctgcaatggtacagtggttcaggacccagagcttggacaggtcattcaactccagggtgatcagaggaagaacgtctcaaatttccttgtcccggccggcattgtgaagaaggaacatatcaagattcatggtttctgagccaccgtcgggtctatagcaagccctgcctgccaagcagctatatatccggggtggagcatat

SEQ ID NO: 14039 - protein, 65 aa, Panicum virgatum
  misc_feature: Ceres CLONE 1772762
  misc_feature (2)..(58): Pfam Name: SUI1 Pfam Description: Translation initiation factor SUI1
  misc_feature: Useful for making plants with modulated biomass
  misc_feature: Useful for making plants with modulated flowering time
GKKIFFSYSKILKDLKKEFCCNGTVVQDPELGQVIQLQGDQRKNVSNFLVPAGIVKKEHIKIHGF

SEQ ID NO: 14040 - DNA, 707 bp, Panicum virgatum
  misc_feature: Ceres CLONE 1772786
  misc_feature: Encodes the peptide sequence at SEQ ID NO. 14041
actccaattccccaattcccaaatcctcccgcgacctcgcgccctccactccagcaaatccctagcctcccccaccctcctctccagtccccgatggcccgcacgaagcagacggcgaggaagtccaccggcggcaaggcgccccgcaagcagctggcgaccaaggcggcgcgcaagtccgccccggcgaccggcggggtgaagaagccccaccgcttccgccccggcaccgtcgcgctccgcgagatccgcaagtaccagaagagcacggagctgctgatccgcaagctccccttccagcgcctggtgcgggagatcgcgcaggacttcaagaccgacctccgcttccagagctccgccgtcgccgcgctgcaggaggccgccgaggcctacctcgtcgggctcttcgaggacaccaacctctgcgccatccacgccaagcgcgtcaccatcatgcccaaggacatccagctcgcgcgccgcatccgtggcgagagggcctagagggtgtgggctcgtcctcagcgtattgcatgcctgatctggggaaatgtagagatgtgttccgtagtcgcttgacctctgttatgtcgtgggagatggtgtgtttgtttccttgttcgtggtgtggctgtagtgttctggtgtgatgtagtttctgatgttaccatctcattatcatcagcaatggaaaagttagttacgtc

SEQ ID NO: 14041 - protein, 136 aa, Panicum virgatum; identical to SEQ ID NO: 10238
  misc_feature: Ceres CLONE 1772786
  misc_feature (58)..(132): Pfam Name: Histone Pfam Description: Core histone H2A/H2B/H3/H4

SEQ ID NO: 14042 - DNA, 635 bp, Panicum virgatum
  misc_feature: Ceres CLONE 1772829
  misc_feature: Encodes the peptide sequence at SEQ ID NO. 14043
gtcctctcccattcctccccgaggctccaaaacctagctctcctcttcctcgggcggcggcggcggcggcggcggcgacggccatggacaagagcatgctcggcgacctggatggcctccccgaggaggacaagatgcgcatggctgccatgatcgagcagctccagatccgtgacagtctgagaatgtacaataacctggtggagagatgcttcacagactgcgtggacacgttccgccgcaagaccctggacaagcaagaggagtcatgcgtccgccgctgcgctgaaaagtttctgaagcactccatgagggttggcatgagatttgctgagcttaaccagggtgtggccacacctgactaaacatgctggttttgttgcccttgccaagttcctaactgtggcgattttgtcagcatctatttgtaatcctaaaaagcttttagcactccttgagaaatgcaactcagtaaggttgcctattgaaccaactgccaggtatgacaatgcataaaattacctagaatcattgtatccaatggtacattcttcatatcgtggttaacgctgtatccattgatacctgatagctgctgagaagagtttggattctcgtttcgtacttgaatcagc

SEQ ID NO: 14043 - protein, 93 aa, Panicum virgatum
  misc_feature: Ceres CLONE 1772829
  misc_feature (20)..(85): Pfam Name: zf-Tim10_DDP Pfam Description: Tim10/DDP family zinc finger
MDKSMLGDLDGLPEEDKMRMAAMIEQLQIRDSLRMYNNLVERCFTDCVDTFRRKTLDKQEESCVRRCAEKFLKHSMRVGMRFAELNQGVATPD

SEQ ID NO: 14044 - DNA, 660 bp, Panicum virgatum
  misc_feature: Ceres CLONE 1772831
  misc_feature: Encodes the peptide sequence at SEQ ID NO. 14045
ctctctccgcctcccccattcctctccctttgcgatccggggccgcacccgcagggaggagaagcgatcacctgatcaccagggcgacgcctcgcgatctctcccaggagcggagatggggctcacgttcacgaaactgttcagccgcctctttgccaagaaggagatgaggatcctcatggttggtctcgacgcggctggtaagaccaccatcctctacaagctcaagctcggcgagatcgtcaccaccatccccaccataggatttaacgttgaaactgttgagtacaagaacattagcttcactgtttgggatgtcggtggtctttttttaatcagacccctgtggaggcactacttccagaacacccagggcctcatttttgttgtggacagcaacgacagagagcgtgttgttgaggccagagatgagctccatcgtatgctgaacgaggacgagctccgtgatgctgtgcttctggtatttgcaaacaaacaagatcttcctaatgccatgaatgctgctgaaatcaccgacaagcttggcctgcactccctgcgccagcggcactggtacatccagagcacatgtgctacctctggtgagggtttgtatgaggggcttgactggctttcgaacacattggccaacaggcttga

SEQ ID NO: 14045 - protein, 181 aa, Panicum virgatum
  misc_feature: Ceres CLONE 1772831
  misc_feature (5)..(177): Pfam Name: Arf Pfam Description: ADP-ribosylation factor family
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with altered terpenoid content
MGLTFTKLFSRLFAKKEMRILMVGLDAAGKTTILYKLKLGEIVTTIPTIGFNVETVEYKNISFTVWDVGGLFLIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNTLANRL

SEQ ID NO: 14046 - DNA, 380 bp, Panicum virgatum
  misc_feature: Ceres CLONE 1772840
  misc_feature: Encodes the peptide sequence at SEQ ID NO. 14047
cgacggaacgcaatcttgcaatccagcccttgaaagtaaccttaaatcgcccccagggtctcgatcgcaccgaggaaggaggaggaatggcggccgaggtgtctccaagccacccccccgaggagttcaagacccagatggacaaggccaaggaggccggcaagctggagatcattgacttcactgcctcctggtgtggtccttgccgcatcatcgcccctgtgtttgctgaattagccaagaagttcactgatgctttcttcctgaaggttgatgttgacgagctgaaggacattgccgcggagtacaatgtcgaagcgatgccaatttttttcttcatcaagaatggagaaaagatccacactgttgtcggtgccagt

SEQ ID NO: 14047 - protein, 97 aa, Panicum virgatum
  misc_feature: Ceres CLONE 1772840
  misc_feature (5)..(97): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAAEVSPSHPPEEFKTQMDKAKEAGKLEIIDFTASWCGPCRIIAPVFAELAKKFTDAFFLKVDVDELKDIAAEYNVEAMPIFFFIKNGEKIHTVVGA

SEQ ID NO: 14048 - DNA, 530 bp, Panicum virgatum
  misc_feature: Ceres CLONE 1772857
  misc_feature: Encodes the peptide sequence at SEQ ID NO. 14049
cagcagcagcggtcccagatgcacctgcccctccaactgcaagtgcggcaagatgtaccctgaccttgaggagaagagcagcggcggcgctcaggccaccatcgtcctcggcgtggccccggaaaagaagactggccagttcgaggcggcagcggagtccggcgagaccgcccacgcctgcaagtgcggtaacagctgcagctgcgacccctgcaactgctgatttcgatgggggaatgttttaacacacctgcatgcatgcatgctagctactacctactactctgcttgtgtgtgacttgatgattgaacaagaataaggatgagcctgagccatcatgtctcatgtatcggtttggctccggcctcatcaagcatgcatgcgtcgcctgcccctctgtgtgctttgcgtccgtcctgtgtctgtatgtgttgatcattgcaaagaaaccatgcaggcatacatctctgcatgtgtctctgtaatgatcggtccagagtgatgaatatataaaactggtttgctttag

SEQ ID NO: 14049 - protein, 73 aa, Panicum virgatum
  misc_feature: Ceres CLONE 1772857
  misc_feature (1)..(73): Pfam Name: Metallothio_2 Pfam Description: Metallothionein
SSSGPRCTCPSNCKCGKMYPDLEEKSSGGAQATIVLGVAPEKKTGQFEAAAESGETAHACKCGNSCSCDPCNC

SEQ ID NO: 14050 - DNA, 799 bp, Panicum virgatum
  misc_feature: Ceres CLONE 1772862
  misc_feature: Encodes the peptide sequence at SEQ ID NO. 14051
ctagtcagccggatcgctgcgtcgctccgcctcctcctcggcctcccaccctcgcgcggcgccttcctcggttcttcggtccagcttggaagatgtcggactccgaggagcaccatttcgagtcgaaggccgacgccggagcgtccaagacttacccgcagcaggccggcaccatccgcaagaacggctacatcgtcatcaagggccgcccgtgcaaggtggttgaggtctccacttccaagacagggaagcacggtcacgcgaaatgccacttcgtggccattgatattttcaacggaaagaagcttgaggatattgtaccctcttcccataactgtgacgtgccccatgtcaaccgtactgactaccagctgattgacatatctgaagatggatttgtcagccttttgactgaaaatggaggcaccaaggatgatctgaggctccctactgatgaaactctgctttcccagattaaagctggattcgatgatgggaaggacctgattgttagtgtgatgtctgccatgggtgaggagcagatctgcggtctgaaggatatcggcaagaactagagcttcattgccactggtggttatttatctggccgtctatctgggaggtggtgtgttgatgatataagcgtgtttggttatgagtaacatgcttgtggactgccgttttgtcttgccgtttatgcagagtgatttggatgtacctttgctatctgtaatgttcttttgaaccaagtagcttggctacacctcatcgaaatcatttgcatcaagtttgtgttggc

SEQ ID NO: 14051 - protein, 160 aa, Panicum virgatum; identical to SEQ ID NO: 10137
  misc_feature: Ceres CLONE 1772862
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif

SEQ ID NO: 14052 - DNA, 593 bp, Panicum virgatum
  misc_feature: Ceres CLONE 1772870
  misc_feature: Encodes the peptide sequence at SEQ ID NO. 14053
accaagaactcattcgaaaaacagagcactagcagagcggagcagaggagcaagaggggcagccatggagatgggagacagcttcgagtactactgagagatgcagcgcttattcgaatccgacgagctcaggtacgccctcgccgccgccattgcttcgggacttgacgccggggatgctgtgattgctgattcgaacgccgcaattgcagcgtctacctgaatggcgcgcaggacgacgcgctgtcctgctatgactccagctcgccggacgggtccatgtccaactcgtcctgggcgccggcgccggcggcgaccgcggcggacgacgccaagggacccggcgcggacgcggccacggccgagggcggcgcggcggaggcggcggccaggaacatcatcatggagcgcaaccgccggcgcaagctgaacgagaagctctacgcgctgcgcagcgtcgtgcccaacatcacaaaggtcggtacagtcgctgctgctggtctggtcacgccatcacggcctgcgggcggcggcattgccggcgagcagagcttgttctaacttctgacgacgaagaattaaatcaattaatt

SEQ ID NO: 14053 - protein, 93 aa, Panicum virgatum
  misc_feature: Ceres CLONE 1772870
  misc_feature: The sequence is a functional homolog of SEQ ID NO 1195 in the 11/479,226 US patent application
  misc_feature: The sequence is a functional homolog of SEQ ID NO 538 in the 10/412,699 US patent application
MSNSSWAPAPAATAADDAKGPGADAATAEGGAAEAAARNIIMERNRRRKLNEKLYALRSVVPNITKVGTVAAAGLVTPSRPAGGGIAGEQSLF

SEQ ID NO: 14054 - DNA, 671 bp, Panicum virgatum
  misc_feature: Ceres CLONE 1772920
  misc_feature: Encodes the peptide sequence at SEQ ID NO. 14055
ctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggcggctacggcggcggtcgtcagggcgggtacggtggcggcggctacgacggtggcggtggcggatacggtggcggtcgccgcgagggcggctacggcggtggtggctacggcagccgcggtgactccggtggcaactggaggaactgatagggtagccctcccgtgctggcagccaagttatcctagatatctattagtgttcgtgttaccatttgatcccgagttaccccagagtttagtgtccgtgttaccgtttgattaggtgttggttcccatgttaccccagagtttagtgtccgtgttaccgtttgattaggtgt

SEQ ID NO: 14055 - protein, 140 aa, Panicum virgatum
  misc_feature: Ceres CLONE 1772920
  misc_feature (10)..(81): Pfam Name: RRM_1 Pfam Description: RNA recognition motif. (a.k.a. RRM, RBD, or RNP domain)
  misc_feature (48)..(132): Pfam Name: GRP Pfam Description: Glycine rich protein family
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAAADVEYRCFVGGLAWATDNASLQQAFASYGDVLDSKVITDRETGRSRGFGFVTFSSEQSMLDAIEAMNGKDLDGRNITVNQAQSRGGGGGGYGGGRQGGYGGGGYDGGGGGYGGGRREGGYGGGGYGSRGDSGGNWRN

SEQ ID NO: 14056 - DNA, 809 bp, Panicum virgatum
  misc_feature: Ceres CLONE 1772925
  misc_feature: Encodes the peptide sequence at SEQ ID NO. 14057
cgaaaggtgggagcctttgcttctccgcgtgaaatttttcggtcgaattttttttccggcctccgctctggtcagatcggcgcgggagttcgtcatggcatcgaagcgtatcctgaaggagctgaaggacctgcagaaagatccccccacatcatgcagtgcaggccctgctggtgaggacatgtttcattggcaagcaacaattatgggaccgcctgacagtccctatgctggtggtgtgttcttagtgaacattcatttccctccagactaccccttcaaaccaccaaaggtgtctttcaagacaaaggtcttccatccaaatatcaacagcaatgggagtatatgccttgacattcttaaagagcagtggagccctgctttgacaatttctaaggtcttgctctccatctgctccctgctgactgaccccaacccggatgaccctcttgtccccgagattgcccacatgtacaagacggaccggtcgaagtatgagtcgacagcccgcagctggacacagaagtacgcgatgggctgacaaagcacctctgcagctcaatcggcgacggctctcgtgccgtctcaagaaattgtccgtgggccattatttccttcggtttgtcgctggttgtgtgtatccccgatccatctaggatcgtattgtagtcgatgtccacctaccacccttgccatccatagtgagatagtcggacatgctttggctatgcacctatgcttgctgggaaaccttccttcgggtcggtgctattcggtaaatgttaatcgaagacatttatttcattgcc

SEQ ID NO: 14057 - protein, 148 aa, Panicum virgatum; identical to SEQ ID NO: 12470
  misc_feature: Ceres CLONE 1772925
  misc_feature (5)..(142): Pfam Name: UQ_con Pfam Description: Ubiquitin-conjugating enzyme
  misc_feature: SWISSPROT Homolog: EC 6.3.2.19 Ubiquitin--protein ligase
  misc_feature: Useful for biocontainment applications

SEQ ID NO: 14058 - DNA, 646 bp, Panicum virgatum
  misc_feature: Ceres CLONE 1772929
  misc_feature: Encodes the peptide sequence at SEQ ID NO. 14059
aagcaaggctgaagcagaagagagatgcaagcaagcatcctgatgaccctgattgctgctcttctcctctgctcgcagctgcagcagacagtagttgccaaggagcagtaccatgagttcgtggtccaggaggcggcggtgactcggctgtgccggaagcacagcatcatgacggtgaacgggcagttcccggggccggcgctggaggtgagcgagggcgactcgctcatggtccgggtcatcaaccggggcggctacaacgtgacggtgcactggcacggcgtccggcagatgcggacggggtggtcggacgggcccgagtacgtgacgcagtgccccatccgccctggccagagcttcacctaccgcttcaccgtcgccgggcaggagggcaccctgtggtggcacgcccacagctcctggctccgggccaccgtacacggcgccctcatcatccgcccccgcgccggcgtcccctaccccttcaacgccggcaagccgcccgccagggagatccccatcctgctcggtacctgctactagctaaggacattgattctaaaaaattattgcacgtacaatgcaaataattaatgtatccttttatttcttccgatccccaaattaacaagtaaaaacttggatc

SEQ ID NO: 14059 - protein, 172 aa, Panicum virgatum
  misc_feature: Ceres CLONE 1772929
  misc_feature (33)..(149): Pfam Name: Cu-oxidase_3 Pfam Description: Multicopper oxidase
  misc_feature: SWISSPROT Homolog: EC 1.10.3.2 Laccase
  misc_feature: Useful for making plants with altered carbohydrate content
  misc_feature: Useful for making plants with altered cell wall content and/or composition
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
MQASILMTLIAALLLCSQLQQTVVAKEQYHEFVVQEAAVTRLCRKHSIMTVNGQFPGPALEVSEGDSLMVRVINRGGYNVTVHWHGVRQMRTGWSDGPEYVTQCPIRPGQSFTYRFTVAGQEGTLWWHAHSSWLRATVHGALIIRPRAGVPYPFNAGKPPAREIPILLGTCY

SEQ ID NO: 14060 - DNA, 670 bp, Panicum virgatum
  misc_feature: Ceres CLONE 1772935
  misc_feature: Encodes the peptide sequence at SEQ ID NO. 14061
  misc_feature (127)..(127): n is a, c, t, g, unknown, or other
  misc_feature (325)..(325): n is a, c, t, g, unknown, or other
agcaagcagcagctagcatcacaagcctttcggccacccacaatcatcatccgatcctattgtcactctcgcacttgaaggttaagttccatccatggcgtctggaaaagcaccccccccacccccnccaccacaagagggacgaggaggagcagcccgccggcgggaacggcggcgaggccgccaccgccgagaacacggagaccaccgagacggagggggcgcccaccggcgaggacgagcacgagaagcacaagaaggaggagaaggagcacaagcacaagcagcaccgcggcgaggcaggcgccaccgccaccggcgccgncgcgctttatgagaagcacgaggcgaagaaggaccccgagcacgcgcaccggcacaagatcgatgaggagatcgcggcggcggcggccgtgggctccggcggctacgccttccacgagcaccacgagaagaagaaggaccacaaggacgccgaggaggccggcggcgagaagaagcaccaccacctcttcggctgatgtgtccagtcgtcgactcagtacatacgtgtgcggcggccccaccacatgtatatgatgatctgtctatatacgtatatatgctgcggatcttaattaatttctccgtgtgctactgctacgtacgcgtgtactgaaagagtgagagg

SEQ ID NO: 14061 - protein, 172 aa, Panicum virgatum
  misc_feature: Ceres CLONE 1772935
  misc_feature (82)..(161): Pfam Name: ABA_WDS Pfam Description: ABA/WDS induced protein
  misc_feature (42)..(42): Xaa is any aa, unknown, or other
  misc_feature (108)..(108): Xaa is any aa, unknown, or other
QAAASITSLSATHNHHPILLSLSHLKVKFHPWRLEKHPPHPXHHKRDEEEQPAGGNGGEAATAENTETTETEGAPTGEDEHEKHKKEEKEHKHKQHRGEAGATATGAXALYEKHEAKKDPEHAHRHKIDEEIAAAAAVGSGGYAFHEHHEKKKDHKDAEEAGGEKKHHHLFG

SEQ ID NO: 14062 - DNA, 497 bp, Panicum virgatum
  misc_feature: Ceres CLONE 1772955
  misc_feature: Encodes the peptide sequence at SEQ ID NO. 14063
ccaaaaccggccgcccgcatggcggcggggcgggggtggctggcggcggcgtggtgcgcggtggccgcggtggctgctgcggcgcagtcgtcgtcgccgccggcggcggacccgctgcaggccaagtgctcggcggacttcgggaagctgacggactgcatggactacgcgacggggcacgaggggcagccctcgtcgacgtgctgctccgatgccgccgacttttttaaggcgcggccgcagtgcctctgctacatcatccagcaggtgcacagcggccggaacgaggcgcccccgctgggcctccgcttcgaccgcctcatggcgctccccgccgcctgcaagctcgccaacgccaacgtcacgctctgcatcaccctgctgaacctgaagccgggctcgccggactacgccctcttcgccaacgcctccaagatcatgccgtcgacccggcggcactccggcgagcgacgccaccgcccgcagcggcttcaagc

SEQ ID NO: 14063 - protein, 159 aa, Panicum virgatum
  misc_feature: Ceres CLONE 1772955
  misc_feature (37)..(118): Pfam Name: Tryp_alpha_amyl Pfam Description: Protease inhibitor/seed storage/LTP family
MAAGRGWLAAAWCAVAAVAAAAQSSSPPAADPLQAKCSADFGKLTDCMDYATGHEGQPSSTCCSDAADFFKARPQCLCYIIQQVHSGRNEAPPLGLRFDRLMALPAACKLANANVTLCITLLNLKPGSPDYALFANASKIMPSTRRHSGERRHRPQRLQ

SEQ ID NO: 14064 - DNA, 588 bp, Panicum virgatum
  misc_feature: Ceres CLONE 1772957
  misc_feature: Encodes the peptide sequence at SEQ ID NO. 14065
tccagcccccctcgtctcttggtggctacgccatggccaccgtagtcctgatgagctgcagcctccgcgctccggacagcaccggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgttgcgcggggtcctgctcctcctgcgccggcaaggtcgtctccggcagcgtcgaccatttcgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatataaatacacccctaggcgcgcgggctata

SEQ ID NO: 14065 - protein, 149 aa, Panicum virgatum
  misc_feature: Ceres CLONE 1772957
  misc_feature (58)..(133): Pfam Name: Fer2 Pfam Description: 2Fe-2S iron-sulfur cluster binding domain
  misc_feature: SWISSPROT Homolog: EC 1.14.13.7 Phenol 2-monooxygenase
MATVVLMSCSLRAPDSTGLSGVRAAPAPAIVAMPAAKQQVVGRGARLRAQATYNVKLITPDGEVELQVPDDVYILDQAEEEGIDLPYSCCAGSCSSCAGKVVSGSVDHFDQSFLEDDQVAGGWVLTCAAYPTSDVVIETHKEEELTSSS

SEQ ID NO: 14066 - DNA, 473 bp, Panicum virgatum
  misc_feature: Ceres CLONE 1772960
  misc_feature: Encodes the peptide sequence at SEQ ID NO. 14067
cgacctcgtacagttcatcaagtaaagccttatcagatcccccccaatctagctgcagaaatggcgtcgacggtggcgagcctctctaccccggcggcggcccctgcagccacccacccagtcccgaggaggaagatcgccggccgcgtctggttccccgtggcgcgccgcgtcggcttcgcggtgaggtcgagcgggccggggacgccgccggggatctcggacaaggtgtcagagagcatcaagaaggcggaggagacgtgcgcggacgagaaggtctccgaagagtgcgcggcggcgtgggacgaggtggaggagctcagcgccgttttgagccacgcccgggacaagctcaaggagaacagcgacccgttggagaactactgcaaggagaaccccgagaccgacgagtgccgcatctacgacaactagaccatgcctgtatccagtggcggagccaggggggctggcag

SEQ ID NO: 14067 - protein, 123 aa, Panicum virgatum
  misc_feature: Ceres CLONE 1772960
  misc_feature (53)..(123): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)
MASTVASLSTPAAAPAATHPVPRRKIAGRVWFPVARRVGFAVRSSGPGTPPGISDKVSESIKKAEETCADEKVSEECAAAWDEVEELSAVLSHARDKLKENSDPLENYCKENPETDECRIYDN

SEQ ID NO: 14068 - DNA, 738 bp, Panicum virgatum
  misc_feature: Ceres CLONE 1772992
  misc_feature: Encodes the peptide sequence at SEQ ID NO. 14069
ctcccgctccgagaaagccaacagcgtagctccgccggcttcctccacgcttgagctccgccgccgccgcctccctccgtctccgtccctccgccaggaccggcgagatgaagctcgtcaggttcttgatgaagctgaacaacgagacggtcaccatcgagctcaagaatggcacggtggtccatggcaccatcacgggtgttgacataagcatgaatactcatctgaagacagtgaagcttacattgaaagggaagaatcctgtgacccttgaccacctcagtgtgcgagggaacaacattcgctattatattcttcctgacagcttaaacctggaaactttgctggtggaggaaacccctagagtcaagcctaagaagccaactacaggaaagcctctgggccgtggtcgaggccgtggtcgtggacgtggtcggggccggggtccgcgctgagctccattgtacccttgctggcagctgtctggcatggcaagtttcccatacaatgtgaaagaatgtttgcattgttacccttctgatgaacgcggacctaatatctcaatctcagtagttcttgttgtggaatccctgtctatttgaccaatcgttcatgtctatcttaggtcttgtagttaatttgcaaagctttgacctggcatacatataaggtgccgcagacatcttaatatctaggctgtatgcttgtgttttcacaacatgggaattattgctccgg

SEQ ID NO: 14069 - protein, 115 aa, Panicum virgatum; identical to SEQ ID NO: 11972
  misc_feature: Ceres CLONE 1772992
  misc_feature (5)..(70): Pfam Name: LSM Pfam Description: LSM domain

SEQ ID NO: 14070 - DNA, 948 bp, Panicum virgatum
  misc_feature: Ceres CLONE 1772996
  misc_feature: Encodes the peptide sequence at SEQ ID NO. 14071
aaaaaaaaaacccccgcaatccactctgacggtcggacctcgtcatccatgcctcccctccccgccgcggccatggccaccgcgacgctgcctctccgcctcctcccctccaagactctgaccctctcctccatcccctctgcgcgccgctgcctctccgtcgccgccgtcccgcaccggcgctggcagctccgagccgccgacgaggaggcgcccgaggccgtggaggttgagttcgtggagcccgaggcggaggatgaggaggaggaacccgcggttccggagcccgtcgaggctcagctcgctgccgcgggggccgggaaggatgccgacatcttcgctgttgtcatgattggttcaaggcaatacattgtgatgccgggccgatatatatacacacagagattgaaaggtgccaatgtcaatgatcagatcatactaaacaaggtgctactagtgtcaactagagacaaagcgtacattggaatgccagtggtgaccaatgctgctgtgcacgcagtggtcgaagaacaggggcgggatgataaagttatagtcttcaagtacaagaagaagaagaagtaccagaggaaacttggtcacagacagccaaacacaaggttaagaatcacaggcataagcggatatgaagagtaccctgctgacccaatacttgaccctgctgcagcttaagctaaattgtaagctatgtagttacaaacggctggtagtacagtagcatgcaaattttcttctttgtgtctgtaaggaacattttcagcaaaaaattacattgtctgtgtgttccaaattctgccagtcaaccagtggttcgatcccctgtttattccatcaactcccctgttcaacttgaaattgtgtatgctagccagttgtattactgttacacgatccctccgaaagaagagaatttttttttcttactag

SEQ ID NO: 14071 - protein, 206 aa, Panicum virgatum
  misc_feature: Ceres CLONE 1772996
  misc_feature (88)..(184): Pfam Name: Ribosomal_L21p Pfam Description: Ribosomal prokaryotic L21 protein
MATATLPLRLLPSKTLTLSSIPSARRCLSVAAVPHRRWQLRAADEEAPEAVEVEFVEPEAEDEEEEPAVPEPVEAQLAAAGAGKDADIFAVVMIGSRQYIVMPGRYIYTQRLKGANVNDQIILNKVLLVSTRDKAYIGMPVVTNAAVHAVVEEQGRDDKVIVFKYKKKKKYQRKLGHRQPNTRLRITGISGYEEYPADPILDPAAA

SEQ ID NO: 14072 - DNA, 772 bp, Panicum virgatum
  misc_feature: Ceres CLONE 1773006
  misc_feature: Encodes the peptide sequence at SEQ ID NO. 14073
acgcaacgcaatcttgcaatccagcccccgaaagagacctaaaaaccgccaccaggctttcgatcgcgccgagggaggaggacgagcaatggcggccgaggagggagtcgtgatcgcgtgccacaccaaggaggagttcaagagccagatgacaaaggccaaggatgccggcaagctggtgatcattgacttcactgcctcctggtgtggtccttgccgcatcatcgccccggtgtttgctgaattagccaagaagttcattgacactttcttcctgaaggtcgatgttgacgagctgaaggaagtagcctcagagtacgagatccaggcgatgccgaccttcctcttcatcaagaacggtgagaagatccacactgttgttggtgccaggaaggatgacctccagaccagcatcgagaagcacgcctccgccactgctgcttccgcctccgcctaaggcaatagcgccaccagttatcaataagggccagcccacggcgtggtagcagtgggcgtcgtaattttcagtttggtttgggtgaattgtgagctatgttcaaatatggagtcctgatatgtttggttcctgtgctggaccatagtcacaaagtccttgggtcgaccgggtcgaggaacagtgtcgagggtcgagggtagtcactttataaaattgtggtacgaagggggtatacctctatggaacgataaattactatatggaacacgaccctaattcatccgggtcgatatctttgggtcgacacgtctttat

SEQ ID NO: 14073 - protein, 122 aa, Panicum virgatum
  misc_feature: Ceres CLONE 1773006
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAAEEGVVIACHTKEEFKSQMTKAKDAGKLVIIDFTASWCGPCRIIAPVFAELAKKFIDTFFLKVDVDELKEVASEYEIQAMPTFLFIKNGEKIHTVVGARKDDLQTSIEKHASATAASASA

SEQ ID NO: 14074 - DNA, 502 bp, Panicum virgatum
  misc_feature: Ceres CLONE 1773007
  misc_feature: Encodes the peptide sequence at SEQ ID NO. 14075
gattgccgaaggccggaacgaacccccttccctcgtcctccttctagaagctcccgcgtcccctccccgtagcctctgctctccaatggcgccctcccttctcgacaacgcccccccccccttcctcgtcgccggcagcagttgcagccgccggccgctggtcgccgccgccacccgccgggccgggctgcgcgttgccgcgctcaagtacgaccctgccaaggtggcgccgcagtccgaccgggtgctcgtccgtctccagcagatccctgagaaatctgctggaggtgtattgctacctaagtctgctgttaagtttgagaggttttttatgggtgagattctatcggtcggtgctgatgttagtgaagttgaggctggaaagattgttctattttcagatatcaatgcttatgaggtggaccttggtactgatgagaagcactgtttctgccgggaatcggatctgttagctgttgttgaatgaattttaccctaaaat

SEQ ID NO: 14075 - protein, 133 aa, Panicum virgatum
  misc_feature: Ceres CLONE 1773007
  misc_feature (46)..(132): Pfam Name: Cpn10 Pfam Description: Chaperonin 10 Kd subunit
MAPSLLDNAPPPFLVAGSSCSRRPLVAAATRRAGLRVAALKYDPAKVAPQSDRVLVRLQQIPEKSAGGVLLPKSAVKFERFFMGEILSVGADVSEVEAGKIVLFSDINAYEVDLGTDEKHCFCRESDLLAVVE

SEQ ID NO: 14076 - DNA, 889 bp, Panicum virgatum
  misc_feature: Ceres CLONE 1773045
  misc_feature: Encodes the peptide sequence at SEQ ID NO. 14077
aaagctcgccattttgaagcagcgctttggtaggcctgcctgctcagctctcctgcttgtctctctctacccacgcaaagctaccaccagctgcgcatcgccagtagtagatcccggccaatatctgacgagagggaaacgccggtgggcttttggaaagggtgtccctgctctctgcagccttgctggtgtttgtgtagctgcatcagaagcttcagtgggcagagaggaaggaaggggaggagagagatggggaggaagctgggcctcgacagggtcctggactgcttctcgctttcgctgtgcgccaatgcctgcgcctgcgtgcactcggtggagaaggacgaggacgaggccgacgagcgcaaggccctggtgagcagccagctggaggagctggtcaagctcagggacttcgtcgacggagcggccaagacccttgctttccatctagagcccaagacagtggagctcaaggtgtccatgcactgctacggatgcgccaagaaagtccagaagcacatctccaagatggacggcgtgacgtcgttcgaggtggatttggagaggaagaaggtggtggtgatcggggatgtcacgccgtacgaggtgctggagagcgtctccaaggtgatgaagttcgcggagctgtgggtggcgcccaaccccaagccgcaggccgcggaggagaggcagtagacgttgctaggtgctttggccgccgtcgatctctcatgcgtccacggtctcggccacgtctccagttctccacctaccatgcgtagcaagcagaaagaacacggtcgctgtgtgacagacccgtcgagttgaaacacttaattaagcgtaaccgtcatcatttgaatttatcagacgtattagcttaatt

SEQ ID NO: 14077 - protein, 149 aa, Panicum virgatum
  misc_feature: Ceres CLONE 1773045
  misc_feature (74)..(142): Pfam Name: HMA Pfam Description: Heavy-metal-associated domain
MGRKLGLDRVLDCFSLSLCANACACVHSVEKDEDEADERKALVSSQLEELVKLRDFVDGAAKTLAFHLEPKTVELKVSMHCYGCAKKVQKHISKMDGVTSFEVDLERKKVVVIGDVTPYEVLESVSKVMKFAELWVAPNPKPQAAEERQ

SEQ ID NO: 14078 - DNA, 649 bp, Panicum virgatum
  misc_feature: Ceres CLONE 1773072
  misc_feature: Encodes the peptide sequence at SEQ ID NO. 14079
actagtgtgatctgactcttggccttggcaagctcccagctcccagcttcagcttggtgccggtgcctgctctgaagcatagcaagatgggcaggggcgctcagccatctgcgccgctcctgctcttctctctggggctggtgcttctctacatcaccgcaggcagcaccgtccgtcttgcggaggcacagaagacgtggtgcatcgcgaaaccgtcggcgtcgaacgagatcctggcgcagaacctggactacgcgtgctcccaggtgagctgcgccgtgatccagaagggcgggccgtgctactacccggacagcctggtgtcccgcgccgccgtcgccatgaacctctactacgcctacagcggccgccacgcctggaactgctacttcaacaactccgcgctcgtcgtccagtccgaccccagttacggatcctgcacgtactactgatggtgagtggcgccggttgtggagtggagggacgccgtgcgagctcaactgcaaactgctgatgcagctgagacaactcagattgtcggggaacggcagaggctactctctgattgttgtgtggtggattgtgatgtgtctagtgaactgtgatgcagttgacctttggagattttcgaacagctcattgatatctt

SEQ ID NO: 14079 - protein, 121 aa, Panicum virgatum
  misc_feature: Ceres CLONE 1773072
  misc_feature (37)..(120): Pfam Name: X8 Pfam Description: X8 domain
  misc_feature: SWISSPROT Homolog: EC 3.2.1.39 Glucan endo-1,3-beta-D-glucosidase
MGRGAQPSAPLLLFSLGLVLLYITAGSTVRLAEAQKTWCIAKPSASNEILAQNLDYACSQVSCAVIQKGGPCYYPDSLVSRAAVAMNLYYAYSGRHAWNCYFNNSALVVQSDPSYGSCTYY

SEQ ID NO: 14080 - DNA, 797 bp, Panicum virgatum
  misc_feature: Ceres CLONE 1773073
  misc_feature: Encodes the peptide sequence at SEQ ID NO. 14081
atcctccacttcacacctgctcgctatcacacagccaattgctctcgacaccaaccacttcttcttcttcaccatgtcgaacggcaccgagaagcaagcccaggcggctgcggcggcccagcagcagcagcagcagcagcagcagcagaggcccccggcggtgtccgcggagatgcagaaggtgttctcccgcttcgacgcggacggcgacggccggatttccccctcggagctggccgcggtctcgcgcgccatctccccgccgccgagctcctcgcacggcggccgcgaggtggccgccatgatggacgagctcgacgccgaccgcgacggctacgtggacctcggcgagttcgcggcgttccacgcgcgcgccgccggccgcggggacggcgagctcgaggccgagctccgcgccgccttcgacgtctacgacgtcgacggcgacggccgcatcacggccgccgagctcggcaaggtgctcgcgcagatcggggagggctgcagcgccgaggagtgcgagcggatgatcgccagcgtcgacggcgacggcgacgggtgcgtcgggttcgaggagttcaagaagatgatggcgccccaaccccaaggcagcgccgccgacgccgccgcgcccggcggcggcctccctgacaaggccaagaaggagtgagcagttacatatgtagccagggggaagtgctggagtgcctctagaattattttcacctagagtaaacgctcccccgtaatgttattaggaataaaaatcctccatgacttatatgtgttataactcc

SEQ ID NO: 14081 - protein, 198 aa, Panicum virgatum
  misc_feature: Ceres CLONE 1773073
  misc_feature (112)..(140): Pfam Name: efhand Pfam Description: EF hand
  misc_feature (33)..(61): Pfam Name: efhand Pfam Description: EF hand
  misc_feature (148)..(176): Pfam Name: efhand Pfam Description: EF hand
  misc_feature: SWISSPROT Homolog: EC 2.7.11.1 Non-specific serine/threonine protein kinase
MSNGTEKQAQAAAAAQQQQQQQQQQRPPAVSAEMQKVFSRFDADGDGRISPSELAAVSRAISPPPSSSHGGREVAAMMDELDADRDGYVDLGEFAAFHARAAGRGDGELEAELRAAFDVYDVDGDGRITAAELGKVLAQIGEGCSAEECERMIASVDGDGDGCVGFEEFKKMMAPQPQGSAADAAAPGGGLPDKAKKE

SEQ ID NO: 14082 - DNA, 722 bp, Panicum virgatum
  misc_feature: Ceres CLONE 1773101
  misc_feature: Encodes the peptide sequence at SEQ ID NO. 14083
cccgaataattcgtcatctccttcccctagtctccaccactctccccccatagccgtgccccagcgcgagggtacccaacgtcgccgccatgggcgccagtcggaagctgcagggcgagatcgaccgtgtcctcaagaaggtccaggagggtgtcgacgtcttcgacagcatctggaacaaggtctacgacaccgagaatgcgaaccagaaggagaagttcgaggcggacctcaagaaggagatcaagaagttgcagcggtaccgggaccagatcaagacgtggatccaatccagcgagatcaaggacaagaaggtgaaaattgccgcgggtcctgctctacttaggtcgctttgatgtctgtacatggaggggcagtgcgatgtttatgatgcaatcatgcaatgctgctgcttacttactgcatgcagcgatctatgtacagttatgctgttgtatttagttaactgctaggtcaaagggtgttttgaagaagctctcttgcgtatggcggtgatcagtgagtagggaccttgattgaagaactgttcctgttactctatatcagctactatatatcatagcggtgatgattcaggtgatagggcgtaggtgtaacccctgatgtaattagtttcttgtctatcctgtcagcatcaggggtgaaaaggttttttaggctattattgataacactccttttcttttgccgtttttggcctc

SEQ ID NO: 14083 - protein, 88 aa, Panicum virgatum
  misc_feature: Ceres CLONE 1773101
  misc_feature (2)..(87): Pfam Name: Not3 Pfam Description: Not1 N-terminal domain, CCR4-Not complex component
MGASRKLQGEIDRVLKKVQEGVDVFDSIWNKVYDTENANQKEKFEADLKKEIKKLQRYRDQIKTWIQSSEIKDKKVKIAAGPALLRSL

SEQ ID NO: 14084 - DNA, 1062 bp, Panicum virgatum
  misc_feature: Ceres CLONE 1773144
  misc_feature: Encodes the peptide sequence at SEQ ID NO. 14085
aggaggaaaagcgaggcgtttctcgtcctcctcgccgccggcgtcgctctccgccgggcgctgcatccgtcgccatcgtctccgcgcctttccgagttcggaattgcctctggaggaactcaacccatccgttgatctactgagaaaaactgctgaggccgtcggtgatttcaggaaaactccaatctatatcgttgacacggactgcacagccaagcgcaacattggcaagctccttgccaattctataatataccgctacctctgtagcgaggaactgctcgaggatgttcttggtggcaaggatgcccttagagccttcaaggaatcagatgagaagggctatcttgaagtcgagaccgaagggttaaagcagctcacgtccatgggtagccttgtgctttgctgtggggatggcgctgtcatgaactcaactaatctgggcttactgaggcatggtgtctccatttggatcgacgttcctctcgagatggcagcgaacgatatgctgaagagcacgggaacacaagctactacagatccagactctttctcacaggcaatgagcaagctccgtcagcagtatgatgaactgaaagaacgctatggaatttctgatattactgtttcagtacaaaaagtggcttctcagctgggctacagcagtgttgactctgtgacccttgaggacatggttcttgaaattgtgaggcaaattgagagactgatccgagcaaaagcgatgatggaagctgcagggaagcccttctagacaataggtgtggcattccgctccggcatttacatattatctccagttgccagagcaggcatttggctcttccatggagctgattacagttaacccacgaatcaagcacaagcattttcaaatccgaggagcagaatcacactgttgtgcttgaatatgcttatttcgtattgtaaaatcgcatgtcatttgatagcccattgtgtaaatctgccatggtgcagcaactttcagattgtatttactgtcaatggaaatgacagatctgcctgtccatgctccaaaggccg

SEQ ID NO: 14085 - protein, 256 aa, Panicum virgatum
  misc_feature: Ceres CLONE 1773144
  misc_feature (72)..(240): Pfam Name: SKI Pfam Description: Shikimate kinase
  misc_feature: SWISSPROT Homolog: EC 2.7.1.71 Shikimate kinase
GGKARRFSSSSPPASLSAGRCIRRHRLRAFPSSELPLEELNPSVDLLRKTAEAVGDFRKTPIYIVDTDCTAKRNIGKLLANSIIYRYLCSEELLEDVLGGKDALRAFKESDEKGYLEVETEGLKQLTSMGSLVLCCGDGAVMNSTNLGLLRHGVSIWIDVPLEMAANDMLKSTGTQATTDPDSFSQAMSKLRQQYDELKERYGISDITVSVQKVASQLGYSSVDSVTLEDMVLEIVRQIERLIRAKAMMEAAGKPF

SEQ ID NO: 14086 - DNA, 800 bp, Panicum virgatum
  misc_feature: Ceres CLONE 1773153
  misc_feature: Encodes the peptide sequence at SEQ ID NO. 14087
aacacctcgtacagttcatcaagtaaagccacatcagatcacacacaatctagctgcagaaatggcgtcgacggtggcgagcctctctaccccgacggcggcctttgcggccgcagacgtagtcccgaggaggaagatcgccggccgcgtctggttccccgtggcacgccgcgtcggcttcgcggtgaggtcgagcgggccggggacgccgccggggatctcggacaaggtgtcagagagcatcaagaaggcagaggagacgtgcgcggacgagaaggtctccggagagtgcgcggcggcgtgggacgaggtggaggagctcagcgccgcggcgagccacgcccgggacaagcttaaggagaacagcgacccgctggagaactactgcaaggagaaccccgagaccgacgagtgccgcatctacgacagctagaccatgcctgtatccagtggcggagccagggggctggcaggggccatgcccccccccccccccccgccaagcttggtgcggcgcgcagcagatggacttggtgccgggacaatatgtgggtgcggccgtgcaggttgtgtgacctcatacacaacatgcttaaaaaggtagtaatatgtacaataaagttttttgttttggtaggaatttggatatggtaatttcaccgatattatgatttgccgacgactcaagtcttttgaggttgtccatagagttagagttgtgcgcgtgtattcatatatgtgagtttgtatacgcgtatgtgaacatctgtatatgagcatatgtatttgtactaagttcg

SEQ ID NO: 14087 - protein, 123 aa, Panicum virgatum
  misc_feature: Ceres CLONE 1773153
  misc_feature (53)..(123): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)
MASTVASLSTPTAAFAAADVVPRRKIAGRVWFPVARRVGFAVRSSGPGTPPGISDKVSESIKKAEETCADEKVSGECAAAWDEVEELSAAASHARDKLKENSDPLENYCKENPETDECRIYDS

SEQ ID NO: 14088 - DNA, 1003 bp, Panicum virgatum
  misc_feature: Ceres CLONE 1773173
  misc_feature: Encodes the peptide sequence at SEQ ID NO. 14089
gtcgagggtggagggccgcagtggctgccccgccgtcgccgtcctcgccgatagccgcgctgtcgtcatcctcgccgagagcagctccatcccatcgcaccccccgaacctcttcccctccactcccaagtcccaatgatgaagtccctcctcttctccgcccaccacacgccgccgctcctccccgccccgcgcctccgcaggctcctccgcctttgcgcctcctccgcctccgcctccgcctccgccacgccacgcgccgaccgcctcgtgcccctctcgagcgcggcgcggccgtgcagggggctcgcggcggtgtctctatcgcgcggcgcggcgggacggaggttgccgagcgtgtcggtgatgtcgtcgtcgaccccgcctccagggcccgtgcagaagtcggaggaggagtggcaggctatcctaacgccggagcagttcaacatcctccgcctcaagggcaccgagtaccctggaacaggtgaatacgacaagttttttgatgagggcatttataaatgtgctggatgtggaactcccttatataaatcatctacaaagttcaactcagggtgtggctggcccgcattctatgagggacttcctggggccataagacagacgccggaccccgatgggaggcggacagagatcacatgtgctgcctgtggaggacatttggggcatatattcaaaggggaagggtttaaaacacctaccaatgagcgacattgtgttaacagcatttctctcaagttcattccagcctcagaggaagcctgacggcagatgaacaccaacgtgaaacccgacaacagaatgagaccttggcctttgttgggtgtttttacagtgtagacagatgaaggttgttgttctgtcgtttatcattatgtttactcatcctttaaacgacataccatcctgtttgtgaaagcttaatagattttgtgcagacaaacttgaacgaagttttgcctgaatttgtcatttcatt

SEQ ID NO: 14089 - protein, 217 aa, Panicum virgatum
  misc_feature: Ceres CLONE 1773173
  misc_feature (92)..(213): Pfam Name: SelR Pfam Description: SelR domain
  misc_feature: SWISSPROT Homolog: EC 1.8.4.12 Peptide-methionine (R)-S-oxide reductase
  misc_feature: Useful for making plants with modulated heat sensitivity
MMKSLLFSAHHTPPLLPAPRLRRLLRLCASSASASASATPRADRLVPLSSAARPCRGLAAVSLSRGAAGRRLPSVSVMSSSTPPPGPVQKSEEEWQAILTPEQFNILRLKGTEYPGTGEYDKFFDEGIYKCAGCGTPLYKSSTKFNSGCGWPAFYEGLPGAIRQTPDPDGRRTEITCAACGGHLGHIFKGEGFKTPTNERHCVNSISLKFIPASEEA

SEQ ID NO: 14090 - DNA, 611 bp, Panicum virgatum
  misc_feature: Ceres CLONE 1773197
  misc_feature: Encodes the peptide sequence at SEQ ID NO. 14091
cgattcagctgagtgtgctccatcatcaagcaatcaacaaagcctcccaattatcctttcatcagatcatcttccttcttccaaattgtcttgcagctgcctttcaagctgcaactgcggctccaactgcaagtgcggcaagatgtaccctgaccttgaggagaagagcagcggcggcgctcaggccaccatcgtcctcggcgtggccccggagaagaaggccggccagttcgaggcggcggcggagtccggcgagaccgcccacgcctgcaagtgcgataacagctgcagctgcgacccctgcaactgctgatttcgatggggaacgtcagaacacacctgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtctgtatgtgttgatcattgcaaagaaaccatgcaggcatacatctctgcatgtgtctctgtaatgatcggtccagagtgatgaatatataaaactggtttgcttc

SEQ ID NO: 14091 - protein, 103 aa, Panicum virgatum
  misc_feature: Ceres CLONE 1773197
  misc_feature (29)..(103): Pfam Name: Metallothio_2 Pfam Description: Metallothionein
DSAECAPSSSNQQSLPIILSSDHLPSSKLSCSCLSSCNCGSNCKCGKMYPDLEEKSSGGAQATIVLGVAPEKKAGQFEAAAESGETAHACKCDNSCSCDPCNC

SEQ ID NO: 14092 - DNA, 326 bp, Panicum virgatum
  misc_feature: Ceres CLONE 1773199
  misc_feature: Encodes the peptide sequence at SEQ ID NO. 14093
cgattccgctgagtgtgccccatcatcctttaatcaacaaagccccccaattatcctttcatcagatcatcttccttcttccaaattgtcttgcagctgcctttccagacgcccccgccgctcccactgcaagtgcggcaagatgtaccctgaccttgaggagaagagcagcggcggcgctcaggccaccatcgtcctcggcgtggccccggagaagaaggcccgcccgttcgaggcggcagcggagtccggcgagaccgcccacgcctgcaagtgcggtaacagctgcagctgcgacccctgcaactgctgatttcgatggggaa

SEQ ID NO: 14093 - protein, 103 aa, Panicum virgatum
  misc_feature: Ceres CLONE 1773199
  misc_feature (29)..(103): Pfam Name: Metallothio_2 Pfam Description: Metallothionein
DSAECAPSSFNQQSPPIILSSDHLPSSKLSCSCLSRRPRRSHCKCGKMYPDLEEKSSGGAQATIVLGVAPEKKARPFEAAAESGETAHACKCGNSCSCDPCNC

SEQ ID NO: 14094 - DNA, 624 bp, Panicum virgatum
  misc_feature: Ceres CLONE 1773237
  misc_feature: Encodes the peptide sequence at SEQ ID NO. 14095
atcccattcccatccatcgaccttagcgagctcacagttcaatcaggtccggttcggcttcaggccgggctcgtcaccgaggagatggcgctctctcgccgcatggccgcgccggttctcgtcttcctgctcctcctcgtcgccacagcagagatggggccggcgacggtggcggaggcgaggcactgcctgtcgcagagccaccacttcaagggcctgtgcgtgagcagcagcaactgcgccaacgtctgccggaccgagaacttccccggcggcgagtgcaagacggagggcgccacccgcaagtgcttctgcaagaggatctgctagccgccggcgccgcccggcacgcaatgcgagccgagcactggtcttggttctgttcgtcggttcttcgtcatgcacgctgcgccgtgatgctgcagcgggctgtgttcctgtcgtctcttgttctctttacctggaataaattaaactcggtgctggtgtctggtgatgcctgtgcgtgtggaacatctcactgttgttctgcacccatatgcactccattattagtgtagtaggcaagatgatgtaaggtcctcctttcaacattgatgtaataatgtgatgcagcttcgtgct

SEQ ID NO: 14095 - protein, 81 aa, Panicum virgatum
  misc_feature: Ceres CLONE 1773237
  misc_feature (33)..(81): Pfam Name: Gamma-thionin Pfam Description: Gamma-thionin family
MALSRRMAAPVLVFLLLLVATAEMGPATVAEARHCLSQSHHFKGLCVSSSNCANVCRTENFPGGECKTEGATRKCFCKRIC

SEQ ID NO: 14096 - DNA, 711 bp, Panicum virgatum
  misc_feature: Ceres CLONE 1773255
  misc_feature: Encodes the peptide sequence at SEQ ID NO. 14097
ggagccgcggaagcagcagcaggtggtgagaggtaatctcgccggctgcgggggattgaaccacccacccgctataaaacttcgatcccccgctcgttccgggccctatccatccatccgccgcgcaacctcttccgttccgatccccttcccccaccgaggaaggagctgagagggacgcgggagaacagacagccctaccgcaccgccggatccccgattgccaagatgcagatctttgtgaagaccctcactgggaagactatcacccttgaggtggagtcatctgacacaatcagcaatgtcaaggcaaagattcaagataaggagggaactccgccgggccagcagcggcttatctttgctggcaagcagctcgaggatggccgcatgtttgctgactacaacattcagaaagagtccaccctgcatcttgtccttcgtctccgtggcggcctgcagattgccaacaacaaccaccctgaggtggagtcgtttaacagtacctcttggtctctagtcttaatatctcgtttgatttacccgtttggctgagccggtcagttctttttttccttttctttttgaagaggcaggggcgctgccccttctatatagacctgggaagcgcagaaggttttagaatagcctcaagacaaatttgttctcacttctcagtaagaacaatttaaaaaagtcagttagcagtgc

SEQ ID NO: 14097 - protein, 108 aa, Panicum virgatum
  misc_feature: Ceres CLONE 1773255
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTISNVKAKIQDKEGTPPGQQRLIFAGKQLEDGRMFADYNIQKESTLHLVLRLRGGLQIANNNHPEVESFNSTSWSLVLISRLIYPFG

SEQ ID NO: 14098 - DNA, 923 bp, Panicum virgatum
  misc_feature: Ceres CLONE 1773276
  misc_feature: Encodes the peptide sequence at SEQ ID NO. 14099
agacgagacatgtaacgagcttatacttagcaagagctagctagagaacttctcgctcgggagaagccaagccattgttgctgcagctcgcctgcgggtgcgcctagcaatggaggaggactacgtgttcaagatcgtggtgatcggcgactcggcggtggggaagacgcagctgctggggcgcttcacccgcgacgagttcttcctcgactccaagtccaccatcggcatcgagttccagacgcgcaccgtcgacatcgcccggcggcgcgtcaaggcccagatttgggacaccgccggccaggagcgctacagggcggtcaccggcgcctactaccggggcgcgctgggggccatgctcgtctacgatgtcaccaggcgccacaccttcgagcacgccgcgcgctgggtcgacgagctccgcgcccacgccgacaagtccatcgtcgtcatgctcatcggcaacaaggccgacctggccgccggacgcgcggtggccgcagacgaggcggccgccttcgccgaggagcaggggctcttcttctcggaggcgtccgcactcagcggggagaacgtcgagcgcgccttcctcaggctgctcgaggagatccacgccaacgtgtccaggaggccgctgggggacgaggcggccagcgccgacggccgcgggcacggtggctcggacgtgctgatgctcaagggcactaagctctcgctcgctgaagagatgtccatcatggagacgagcgccttgaggcgagcaagcagctgctcgtgctcgtaataatcaatggcgtggtgcagccgtgcagggctgttctttcacacacacaaagtagtctcaagtttggacaagcatgtgaaaatctgcttgcaacggatcacaagaacaaaagatagtgaacacgggattgctttgtcat

SEQ ID NO: 14099 - protein, 224 aa, Panicum virgatum
  misc_feature: Ceres CLONE 1773276
  misc_feature (8)..(169): Pfam Name: Ras Pfam Description: Ras family
  misc_feature (8)..(122): Pfam Name: Miro Pfam Description: Miro-like protein
  misc_feature: Useful for making plants with altered lignin content
  misc_feature: Useful for making plants with altered alkaloid content
  misc_feature: Useful for making plants with altered terpenoid content
MEEDYVFKIVVIGDSAVGKTQLLGRFTRDEFFLDSKSTIGIEFQTRTVDIARRRVKAQIWDTAGQERYRAVTGAYYRGALGAMLVYDVTRRHTFEHAARWVDELRAHADKSIVVMLIGNKADLAAGRAVAADEAAAFAEEQGLFFSEASALSGENVERAFLRLLEEIHANVSRRPLGDEAASADGRGHGGSDVLMLKGTKLSLAEEMSIMETSALRRASSCSCS

SEQ ID NO: 14100 - DNA, 590 bp, Panicum virgatum
  misc_feature: Ceres CLONE 1773280
  misc_feature: Encodes the peptide sequence at SEQ ID NO. 14101
attgatacaactaccctgaactctcctctctcccagacatacaatacaaagatagcttgcgttagatggcctccagctccaagcagcagctgcaggctcctgctctcctcttggtggcatcagctctgctcatcctcgtctgcgctacaagggtccaggcagcaaggccggtaccaacatccaaggaccacatgccacagttcactgtctccgcgactgtggctggcgacgagaagagtggttcggcgcccgggatggaaatgcatcgagcacagcctgaggcgacagaggagtgcaagggcgaggaaggggaggagtgtctcatgaggaggacactggccgctcacgccgactacatctccgcccaggggaagcacaactagtacggtagtgtgcaggctcacccccaacaatgaagttcacaacagaagaatttcgcatgggccacgagctagcttatctgaagctctgcagttctgtcagctgtggatcatgtgttttcatatacgtgccctagacccctaccagcccgtgcgatttccatcggcttctcgagcacatggacggcctggaattgtatccctcatctt

SEQ ID NO: 14101 - protein, 105 aa, Panicum virgatum
  misc_feature: Ceres CLONE 1773280
  misc_feature (22)..(105): Pfam Name: PSK Pfam Description: Phytosulfokine precursor protein (PSK)
MASSSKQQLQAPALLLVASALLILVCATRVQAARPVPTSKDHMPQFTVSATVAGDEKSGSAPGMEMHRAQPEATEECKGEEGEECLMRRTLAAHADYISAQGKHN

SEQ ID NO: 14102 - DNA, 568 bp, Panicum virgatum
  misc_feature: Ceres CLONE 1773296
  misc_feature: Encodes the peptide sequence at SEQ ID NO. 14103
gaagtaccgcacgttcagttcagggaacagagcagcagcacaggcgtcgccatggcctcccagctctccgccgccgcgtccatgtccgccgccgtgccgcagttccacggcctccggggccggtccgtggcggcgctgccgccggcgagggccggcaggaagcgggcgcagggcatccggtgcgactacatcggctcggccaccaaccagatcatggtggtgtcgacgacgctgatgctggtggcggggcggttcgggctggcgccgtcggcgaaccggaaggcgacggcggggctgaagctcgagtcccgcgactccggcctgcagaccggcgaccccgccgggttcacgctcgccgacacgctggcctacggcgccgtcggccacatcatcggcgtcggcatcgtgctcgggctcaagaacaccggcgcgctcgaccagatcatcggctaggtccagtgtctgcctttgccgctctcggcgccggcccggtgcccatgtaacctgcgtgtgtacatcgactctgcgctcatgcatctcgttccaatggacatagcttgtttgttgc

SEQ ID NO: 14103 - protein, 133 aa, Panicum virgatum
  misc_feature: Ceres CLONE 1773296
  misc_feature (48)..(128): Pfam Name: PSI_PSAK Pfam Description: Photosystem I psaG / psaK
MASQLSAAASMSAAVPQFHGLRGRSVAALPPARAGRKRAQGIRCDYIGSATNQIMVVSTTLMLVAGRFGLAPSANRKATAGLKLESRDSGLQTGDPAGFTLADTLAYGAVGHIIGVGIVLGLKNTGALDQIIG

SEQ ID NO: 14104 - DNA, 818 bp, Panicum virgatum
  misc_feature: Ceres CLONE 1773310
  misc_feature: Encodes the peptide sequence at SEQ ID NO. 14105
aaggcgacaatcctgctcaacagtgtcgcttgcaccactccactcagctctcagcttcgccaatcgccatggccacgctcgccatgcgcctcatcctctgctcctccacctcctcgtccccctcgcagcgccgccgacggcccctgcctcccggcgccaccggcgcgggcggctcggacaagccgccgcagcagcagcaggcgccggcgccacactccgccacgcggcggctggcggtggccgcgtccacggcgctggccgcctcggccgcgctcgccgcgcgccggcccgcggcgcccccgcccgcgatggccgcggaggcggcgttcgtgcccgcgccgacgccgcccggggccgtgccgcggtggggcaccaagtcgtacgtgcgggagcgcttcttcgagaaggggctgaccgcggaggaggccgccgcgcgcatccggcagaccgcggagggcatgcgcacgctgcggcccatgctggagaccatgtcctggaagtacgtgctcttctacgtccggctcaagtccaagtacctcgacctcgacctcaccaccgccatggccggcgtccccgccggccgccgcgccgactacgtccgcgtcgccaacgagctcgtcgacaacatgacggagttcgatcgcttcgtgcggacgcccaaggtctacgagtcctacctcttctacgagaagacgctcaagtcgctggatgacgtggcagagttcttcgtctgacgtacatatactgtataagttgttctaggatatatggtgttgtaatttggctatggatgaaggtttcgaacacaattcttttag

SEQ ID NO: 14105 - protein, 221 aa, Panicum virgatum
  misc_feature: Ceres CLONE 1773310
  misc_feature (10)..(221): Pfam Name: PsbQ Pfam Description: Oxygen evolving enhancer protein 3 (PsbQ)
MATLAMRLILCSSTSSSPSQRRRRPLPPGATGAGGSDKPPQQQQAPAPHSATRRLAVAASTALAASAALAARRPAAPPPAMAAEAAFVPAPTPPGAVPRWGTKSYVRERFFEKGLTAEEAAARIRQTAEGMRTLRPMLETMSWKYVLFYVRLKSKYLDLDLTTAMAGVPAGRRADYVRVANELVDNMTEFDRFVRTPKVYESYLFYEKTLKSLDDVAEFFV

SEQ ID NO: 14106 - DNA, 668 bp, Panicum virgatum
  misc_feature: Ceres CLONE 1773313
  misc_feature: Encodes the peptide sequence at SEQ ID NO. 14107
aagcagcagctagcatcacaagtaatcctgccacacacaatcatcatccgatcctattgtcactccgcacttgaaggttaaggtccatccatggcggaggctaaacaccacccccccctcttccaccacaagaaggacgaggaggagcagcccaccggcgggtacggcggcgaggccgccaccgccgagtacacggagaccaccgtgacggaggtggtgtccaccggcgaggacgagtacgagaagtacaagaaggaggagaaggagcacaagcacaagcagcacctcggcgaggcaggcgccatcgccaccggcgccttcgcgctgtattataagcacgaggcgaagaaggaccccgagcacgcgcaccggcacaagatcgaggatgatatcgcggcggcggccgtgggctccggcggctacgccttccacgagcaccacaagaagaagaaggaccacaaggacgccgaggaggccggcggcgagaagaagcaccaccacctcttcggctgatgtgtccagtcgtcgactcagtacatacgtgtgcggcggccccaccacatgtatatgatgatctgtctatatacgtatatatgctgcgcatcttaattaatgtctccgtgtgctactgctacgtacgcgtgtactgtaagagtgagaggctgaga

SEQ ID NO: 14107 - protein, 140 aa, Panicum virgatum
  misc_feature: Ceres CLONE 1773313
  misc_feature (51)..(129): Pfam Name: ABA_WDS Pfam Description: ABA/WDS induced protein
MAEAKHHPPLFHHKKDEEEQPTGGYGGEAATAEYTETTVTEVVSTGEDEYEKYKKEEKEHKHKQHLGEAGAIATGAFALYYKHEAKKDPEHAHRHKIEDDIAAAAVGSGGYAFHEHHKKKKDHKDAEEAGGEKKHHHLFG

SEQ ID NO: 14108 - DNA, 949 bp, Panicum virgatum
  misc_feature: Ceres CLONE 1773341
  misc_feature: Encodes the peptide sequence at SEQ ID NO. 14109
ctcggcctccaccccctgccgccgccgcccgccgccccgccgccgcgccgcgagccgatccaatggcgccgtcgtctaagctgtcgctgggcatcaagaaggcctcgcggtcccactcctaccaccgccgcgggctgtgggcgatcaaggccaagcacggcggcgccttccccaaggcggagaagcccgccgccgccggcgagcccaagttctaccccgccgatgacgtgaaaccgcgcaagcccagcacccgcaagccgaaacccaccaagctcaggtcgtccatcactccgggcaccgtgctgatcctgctcgccgggaggttcatggggaagagagttgttttcctcaagcagctcaagtctggcatgctccttgttactggacctttcaagatcaacggagtcccaatccgccgtgtgaaccagacctatgtcattgcaacctccacaaaggttgatgtctctggtgttaatgtggagaaatttgatgacagctactttgctagggaaaagaagaagaaggcaaagaagactgagggtgaacttttcgagacagagaaggaggcgactaaggacctgccacagttcaagaaggatgaccagaagtctctggatgccgcactgatcaaagctattgaggccatgccagatctgaaaacctaccttggtgcacggttctctctcagggatggtgataagcctcatgagatggttttctagattagttggcgctaggtgcgaagctcaatagtcactttgcttggtctacctgagtgcgctcttgaattttgtatctgactggtgaacctttggtttctgtttgattcattgtcaaatctttaatgaaatcattgctccttaagttagcattgctttgcacaatactactataatatatgtaagctatcaacaatgacatttgtgcattcttccatagcttccagttt

SEQ ID NO: 14109 - protein, 219 aa, Panicum virgatum
  misc_feature: Ceres CLONE 1773341
  misc_feature (112)..(219): Pfam Name: Ribosomal_L6e Pfam Description: Ribosomal protein L6e
  misc_feature (1)..(49): Pfam Name: Ribosomal_L6e_N Pfam Description: Ribosomal protein L6, N-terminal domain
  misc_feature: Useful for making plants with modulated nitrogen use efficiency
MAPSSKLSLGIKKASRSHSYHRRGLWAIKAKHGGAFPKAEKPAAAGEPKFYPADDVKPRKPSTRKPKPTKLRSSITPGTVLILLAGRFMGKRVVFLKQLKSGMLLVTGPFKINGVPIRRVNQTYVIATSTKVDVSGVNVEKFDDSYFAREKKKKAKKTEGELFETEKEATKDLPQFKKDDQKSLDAALIKAIEAMPDLKTYLGARFSLRDGDKPHEMVF

SEQ ID NO: 14110 - DNA, 465 bp, Panicum virgatum
  misc_feature: Ceres CLONE 1773347
  misc_feature: Encodes the peptide sequence at SEQ ID NO. 14111
ccacggccctcgggaacggcccccggcggcgctgccgccggtgagggccggcaggaagcgcgcgcagggcatccggtgcgactacatcggctcggccaccaaccagatcatggtggtgtcgacgacgctgatgctggtggcggggcggttcgggctggcgccgtcggcgaaccggaaggcgacagcggggctgaagctcgagtcccgcgactccggcctgcagaccggcgaccctttcgggttcacgctcgccgacacgctggcctgcggcgccgtcggccacatcatcggtgtctgcatcgtgctcgggctcaagaacaccggcgcgctcgaccagatcatcggctaggtccagtgtctgcctttgccgctctcggcgccggcccggtgcccatgtaacctgcgtgtgtacatcgactccgcgctcatgcatctcgttccaatggacatagcttgtttgttgcg

SEQ ID NO: 14111 - protein, 115 aa, Panicum virgatum
  misc_feature: Ceres CLONE 1773347
  misc_feature (30)..(110): Pfam Name: PSI_PSAK Pfam Description: Photosystem I psaG / psaK
HGPRERPPAALPPVRAGRKRAQGIRCDYIGSATNQIMVVSTTLMLVAGRFGLAPSANRKATAGLKLESRDSGLQTGDPFGFTLADTLACGAVGHIIGVCIVLGLKNTGALDQIIG

SEQ ID NO: 14112 - DNA, 355 bp, Panicum virgatum
  misc_feature: Ceres CLONE 1773349
  misc_feature: Encodes the peptide sequence at SEQ ID NO. 14113
agatccacccatccttccggaggcgagcagaaaaatctccccacccaaaaaaatccccaaaaccctaggcctcggatctcccgatctgcgatggcgaacccccgcgtgttcttcgacatgaccgtcggcggcgccccggccggccgcatcgtcatggagctctacgccaacgaggtcccccgcaccgccgagaacttccgcgccctctgcacgggcgagaagggcgtgggcaagaggggcaagccgctccactacaagggctccaccttccaccgcgtcatccccgacttatatgtatatattcatgtatgcaaactgattgatgatatgaataaccctcggaatgaattgtgct

SEQ ID NO: 14113 - protein, 88 aa, Panicum virgatum
  misc_feature: Ceres CLONE 1773349
  misc_feature (5)..(88): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTVGGAPAGRIVMELYANEVPRTAENFRALCTGEKGVGKRGKPLHYKGSTFHRVIPDLYVYIHVCKLIDDMNNPRNELC

SEQ ID NO: 14114 - DNA, 915 bp, Panicum virgatum
  misc_feature: Ceres CLONE 1773364
  misc_feature: Encodes the peptide sequence at SEQ ID NO. 14115
gagatgcatcggatgggagagcttcagcttaaacaaaggacggagagtgtgtggctgccatctccatctccctcttcgatcacacggacagggtgtggaggatccagtccgttgccagtatatttgatctggaagtatagtagagcgagtgcggccggactggtcgttacgttcgccggcgatggacgcggaggagctcctgaagaggatacgggagctggaggagggccaggcggagctcaagcgggaggtgtccgacctcgtgacggcgacggagcgccgcgccaagcagcaacctgctgctgctgtgccgacggcgtcgcgccgggagctcaggcgggacgtgtccaagcatcagctcctcctgccgccgccggagcgccgcggcgcgcccagctcctcttcacggcgccgcctcccgccgccgccgccgcccgtgggccgcaccgggctgtcccgcaggcaccacgccatggtcctgcagtctctggggcaggccgtgcacatcctagatctccaggggaatgtcatctactggaaccgatgtgccgagcatctgtatgggtaccctgcatcagaagcaatcggtcgcaatgtcacggacctgctggtgcatgctgacgacattggcccatcaaccaacatcatcgggagcatattcgcagggaaatgctggagagggaagtttcctgtcaagaacaagtcaggggagaggttttcgattctcaccaatggcactcctctgtatgatgatgatggcaccatgcatgatcggcctcgtctgtctctcagatgatacacggaagctgcagcagatcgttggcttttcaccgacctcgggatactattattaaccaatgaattaatttcttttacatgtttgtaaacatgatttcgccgggtaatcttttttag

SEQ ID NO: 14115 - protein, 204 aa, Panicum virgatum
  misc_feature: Ceres CLONE 1773364
  misc_feature (94)..(198): Pfam Name: PAS Pfam Description: PAS fold
MDAEELLKRIRELEEGQAELKREVSDLVTATERRAKQQPAAAVPTASRRELRRDVSKHQLLLPPPERRGAPSSSSRRRLPPPPPPVGRTGLSRRHHAMVLQSLGQAVHILDLQGNVIYWNRCAEHLYGYPASEAIGRNVTDLLVHADDIGPSTNIIGSIFAGKCWRGKFPVKNKSGERFSILTNGTPLYDDDGTMHDRPRLSLR

SEQ ID NO: 14116 - DNA, 656 bp, Panicum virgatum
  misc_feature: Ceres CLONE 1773391
  misc_feature: Encodes the peptide sequence at SEQ ID NO. 14117
acatagctagcttggcaacacatacctttacagcccgaaggcccgcaggcatagaagtgaacgcccgtcgtaggtagttgcgcggcttgtgctgatcgacctcgagccgacccccccagcgcgtcgatggcgatccggaacatgcaggtggcgacgcgctcgctggacgcggacatgacggtggacgagttcaaggagtggctgcggcggttcgacacggaccgcgacgggcgcatcagccgcgaggagctgcggcgcgccatgcgcgccatccgcgcccggttcacggggtggcggagcaggcagggcatcagctacgccgacgcctacggcgacggctacatcgacgacagcgaggtggacggcctcatcgagttcgcgcatattaacctcgggctcaagatcgtcgcctactgatgatcgagctggtccactcaggggcggacccgggcggcggcgagctatagctcgatccatcaccatgggctagcagcgagcacgccatctggcgcctggccccccggcccgctaaaaataagaacaactgcttgatcgaccgcttgcttgcttccttaaagctttgctttcttgtacgtactctatcaattcatggctctgtatcccctctctctctctctctgtgatctatctatgta

SEQ ID NO: 14117 - protein, 96 aa, Panicum virgatum
  misc_feature: Ceres CLONE 1773391
  misc_feature (21)..(49): Pfam Name: efhand Pfam Description: EF hand
MAIRNMQVATRSLDADMTVDEFKEWLRRFDTDRDGRISREELRRAMRAIRARFTGWRSRQGISYADAYGDGYIDDSEVDGLIEFAHINLGLKIVAY

SEQ ID NO: 14118 - DNA, 948 bp, Panicum virgatum
  misc_feature: Ceres CLONE 1773413
  misc_feature: Encodes the peptide sequence at SEQ ID NO. 14119
attgcagcactcatctccttcattaattcccagctagtaggtgtgcacgccattgccgcgcgaactcttccctcctagcagctacctagctagctagctttatttcagcatcagctgctgcagctctagctagcaataattaagcagcaatggccaccgccctcagcagcctccgcgcgccggccagcagcttctcctccggcgtgcgcgccgccccagcgcccggcgtcgtcgccatgcccgccgccaagcaggttgttgcccgcggcgccaggctgcgcgcgcaggccacctacaacgtgaagctgatcacgcccgacggcgaggtggagctgcaggtgcccgacgacgtgtacatcctggaccaggccgaggaggaggggatcgacctgcccttctcctgccgcgcggggtcctgctcctcctgcgccggcaaggtcgtctccggctccgtcgaccaatccgaccagagcttcctcgacgacgaccaggtcgccagcggctgggtgctcacctgccacgcctaccccacctccgacgtcgtcatcgagacgcacaaggaggaggagctcaccgcttaagctccatcatcacatcatcatcatatcccatgcataaaattaaagctgctagctgccttgcaagagatctatcgatcgatgtaatcgagttgacgagaatccgatccgccggacaaatttcttttcctagcttaattgtatcatccatcatgcatgtcgatcaatgtcaccatgagaccaagcaagctaagcatcggcagcagggccatctgttaccgtacatgcttggtgtctgctgtatcattcatttttactgcatacggatgcatgatccacttctcatcaaagtaattaattaataatgttttacctctttttttgtaccttcatcaatacatatattatggaactgcaagcattgaagctt

SEQ ID NO: 14119 - protein, 143 aa, Panicum virgatum
  misc_feature: Ceres CLONE 1773413
  misc_feature (54)..(129): Pfam Name: Fer2 Pfam Description: 2Fe-2S iron-sulfur cluster binding domain
  misc_feature: SWISSPROT Homolog: EC 1.14.13.7 Phenol 2-monooxygenase
MATALSSLRAPASSFSSGVRAAPAPGVVAMPAAKQVVARGARLRAQATYNVKLITPDGEVELQVPDDVYILDQAEEEGIDLPFSCRAGSCSSCAGKVVSGSVDQSDQSFLDDDQVASGWVLTCHAYPTSDVVIETHKEEELTA

SEQ ID NO: 14120 - DNA, 551 bp, Panicum virgatum
  misc_feature: Ceres CLONE 1773431
  misc_feature: Encodes the peptide sequence at SEQ ID NO. 14121
attcccatcccttgctacccgcatccctcgaccttagcgagctcacagttcaatcaggtccggttcggcttccggccgggctcgtcaccgaggagatgttcctccccccccccccggccgcgccggtcctcgtcttcctgctcctcctcgtcgccacagcagagatggggccggcgacggtggcggaggcgaggcactgcctgtcgcagagcccccacttcaagggcctgtgcatgagcagcagcaactgcgccaacgtctgccggaccgagaacttccccggcggcgagtgcaagacggagggcgccacccgcaagtgcttctgctagaggatctgctagccgccggcgccgcccggcacgcaatgcgagccgagcactggtcttggttctgttcgtcggttcttcgtcatgcacgctgcgccgtgatgctgcagcgggctgtgttcctctcgtctcttgttctctttacctggaataaattaaactcggtgctggactgctggtgtctggtgatgcctgtgcgtgtggaacatctcactgttgttctgc

SEQ ID NO: 14121 - protein, 77 aa, Panicum virgatum
  misc_feature: Ceres CLONE 1773431
  misc_feature (33)..(77): Pfam Name: Gamma-thionin Pfam Description: Gamma-thionin family
MFLPPPPAAPVLVFLLLLVATAEMGPATVAEARHCLSQSPHFKGLCMSSSNCANVCRTENFPGGECKTEGATRKCFC

SEQ ID NO: 14122 - DNA, 670 bp, Panicum virgatum
  misc_feature: Ceres CLONE 1773448
  misc_feature: Encodes the peptide sequence at SEQ ID NO. 14123
atccacctcgcccaccgtctgccgtctgactgcccgttcttgcgtgcttgatactcgcatcgagcttggctggcagtggcagctgatccttcggccggccggtcatgagctaccaagcaggctacccgccgccgggcaccgccgcgtaccctccgccggggcagcaagcagcctacggcgcgcccccgccgcaggcctacgtcgcgccgccgccggcgtacccgccgtcccagcaggacgccggcgcgtacggccagcaccagaccaccagccgcggcggcgacggcttctggaaaggatggtgagcttacttctcgattcccccgtcttctcctttctccatccatcctgatgatgctcatcatcaccttcttgctgattcatccatgtcgatctgcctgtcgtcgcagctgcgccgccatctgctgctgctgcgtcctcgacatgtgcttctgaggacgacgacggagctgatggtcgaccaggactcgctgatcggtggagctgctctgctctagctgatgtgttaattacatttacatccatgcatcttgatacagtcattaattagtcttcgttattgtggcttgtagtagctagtatcaatttgtagagccattcttgtatttttatatgatagcaatatattatacataaatgttcccccgtt

SEQ ID NO: 14123 - protein, 66 aa, Panicum virgatum
  misc_feature: Ceres CLONE 1773448
  misc_feature: Useful for making plants with altered cell wall content and/or composition
MSYQAGYPPPGTAAYPPPGQQAAYGAPPPQAYVAPPPAYPPSQQDAGAYGQHQTTSRGGDGFWKGW

SEQ ID NO: 14124 - DNA, 953 bp, Panicum virgatum
  misc_feature: Ceres CLONE 1773482
  misc_feature: Encodes the peptide sequence at SEQ ID NO. 14125
cacgagctcagtgctaccctgaactactgaaggtgatatggcaagcctgcagaatctgatttgctccgtatccaaacaattggttgcgccaaattttgcggtgactgccaaactgaatggggcttctcactctgttgtctcagcaagctcaaggggagcatcctcgcatgaaaagaatgtcacgaaaaggcagttagctttgcttggtgctggagcattagccaccggcctactgaagacaacctctgcatttgctgaagaagtaccgaagaattacaagtcttacgtggatgcaaaagatggatattcgtatctttatccagccgaatggagggatttcgacttcttgggtcatgattccgcattcaaagatcgtaatctggctcttcagtgtgtccgtgtggggtttattcctactgataaaacagatgttcgtgacctagggccaatggatgaggccatcttcaatttggtaaacaacgtttacgctgccccaaatcaaataccgtcgatctatgagatgcaagagcgcacggtggatggcaagaactactggacgttcgagtacgatctggaggctccgggctacggtgtatccgcgttcgcgacagtcgccattggaaacggtcggtactacacgctgatcgtgaccgcgaacgaacgacggtggagcaggctccggaacaggctcaaagtcgtcgcggactctttcaagatctccgacctgactgcgtgaccgccagcgttcgtttaactgtagtgtacgctctcattcagtcatggtatacttacgcgcgccataatcgtgcgtgtttcatttggtgaaatgtaaaacgtcaaatattgatttgctaccgttttgtggcgtccaaaattgtatgttcggtgaaacagcacccaatcagggcaggtgcagggctatgccagcggtaaaacaccgaaacgaatcgacg

SEQ ID NO: 14125 - protein, 232 aa, Panicum virgatum
  misc_feature: Ceres CLONE 1773482
  misc_feature (46)..(228): Pfam Name: PsbP Pfam Description: PsbP
  misc_feature: Useful for making plants with modulated salt sensitivity
MASLQNLICSVSKQLVAPNFAVTAKLNGASHSVVSASSRGASSHEKNVTKRQLALLGAGALATGLLKTTSAFAEEVPKNYKSYVDAKDGYSYLYPAEWRDFDFLGHDSAFKDRNLALQCVRVGFIPTDKTDVRDLGPMDEAIFNLVNNVYAAPNQIPSIYEMQERTVDGKNYWTFEYDLEAPGYGVSAFATVAIGNGRYYTLIVTANERRWSRLRNRLKVVADSFKISDLTA

SEQ ID NO: 14126 - DNA, 754 bp, Panicum virgatum
  misc_feature: Ceres CLONE 1773516
  misc_feature: Encodes the peptide sequence at SEQ ID NO. 14127
atccgcggaggaagaacattggcccgacaccatgctcccaatggccgttcacccagccaccacgccggccctcgccccgcgcgcccgcctcgccccgcctagaccttctacctccctggccgccgcctcgtcctcctccggctctcgcatcgtcagtttcgagaccaggaggctgccccttggctcgctccgcagcgtctccgccgccgccgctgccaacgccgtcgaggcagaggacgaagaggtgcaactaggtggaggcggggatgcgttttacgaggaggaacctgaggagtataaggtggcggtgcccgagagacaggacccgatgctggtactcaagttcatctggatggagaagaacattggcatagcacttgaccagctggttccaggctatggcagcattccgttaagcccgtactacttttggccacggaaagacgcgtgggaggagttgagagcaaagctggaagagaaagagtggatctcgcagaagcagatgatcatccttctcaaccaggccaccgacataatcaacctctggcagcagggtggcgggagcctgtcaacatgagtccctcactccctcccctccctgttcgtccagccttgcaaacttgttttttattggtgtttttccacgccttatctattgttaatgttgaagtcacacagtacatggccttgtagatcagtttcggttcaatctgttcgaagatatggttttgttcatggaaatggtcggtgtgat

SEQ ID NO: 14127 - protein, 181 aa, Panicum virgatum
  misc_feature: Ceres CLONE 1773516
  misc_feature (128)..(176): Pfam Name: PSRP-3_Ycf65 Pfam Description: Plastid and cyanobacterial ribosomal protein (PSRP-3 / Ycf65)
MLPMAVHPATTPALAPRARLAPPRPSTSLAAASSSSGSRIVSFETRRLPLGSLRSVSAAAAANAVEAEDEEVQLGGGGDAFYEEEPEEYKVAVPERQDPMLVLKFIWMEKNIGIALDQLVPGYGSIPLSPYYFWPRKDAWEELRAKLEEKEWISQKQMIILLNQATDIINLWQQGGGSLST

SEQ ID NO: 14128 - DNA, 545 bp, Panicum virgatum
  misc_feature: Ceres CLONE 1773530
  misc_feature: Encodes the peptide sequence at SEQ ID NO. 14129
cgcccccgccgccggaacggaaccccccttagccgaacccccgccccggagcagagcggaggagaggagaggagatggcggagaagaagggagcggcggccctcaaggaggacccgcccccaagggagtaccccatccaccctcacaagcgcccccccggctgcccattcaagaagaaggccccccatgccatcaaggagatcaggaagtttgcacagaaggccctgggcaccactgatgtccgggttgatgtgaagctgaacaagcacatctggagcagcgggatcagaagcgttccgcggagggtgcgtgtgagaatagcccgcaggaggaacgatgaggaggatgcccaggaggaactctactccctcgtcaccgccgctgagatccctgctgagggtttgaaagggctgggaaccaaggccatcgacgaagcggattaagctctcgcatcctttacatctttagaacaagtgtagcttgtattgtcaacagcaaaccttttgtggcccaacgaagttttgaactcctgtactgtgatgcga

SEQ ID NO: 14129 - protein, 122 aa, Panicum virgatum
  misc_feature: Ceres CLONE 1773530
  misc_feature (10)..(104): Pfam Name: Ribosomal_L31e Pfam Description: Ribosomal protein L31e
MAEKKGAAALKEDPPPREYPIHPHKRPPGCPFKKKAPHAIKEIRKFAQKALGTTDVRVDVKLNKHIWSSGIRSVPRRVRVRIARRRNDEEDAQEELYSLVTAAEIPAEGLKGLGTKAIDEAD

SEQ ID NO: 14130 - DNA, 429 bp, Panicum virgatum
  misc_feature: Ceres CLONE 1773537
  misc_feature: Encodes the peptide sequence at SEQ ID NO. 14131
ccccccccccccggcctcggcggccacctgagtggctccattccagggcctcaagtccaccgctggcctccccatcacccgccgctcccgaagctccgccggcttcggcaacgtcaccgccggcggaaggatcaggtgcatgcaggtgtggccgacggagaacaacaagaagttcgagacgctgtcgtacctgccgccgctctccacggaggacctcttttttttggtcgacctactgatccgcaacaactgggtcccctgcctcgagttcagcaatgtttttttcctcttccgcgagaacgccacttcccccgggtactacgacgggcgctactggaccatgtggaagctgcccatgttcggctgcacggacgcgacccaggtgtacgccgagctcgaggagtgcaagaaagcctacccggacaacta

SEQ ID NO: 14131 - protein, 96 aa, Panicum virgatum
  misc_feature: Ceres CLONE 1773537
  misc_feature (11)..(96): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MQVWPTENNKKFETLSYLPPLSTEDLFFLVDLLIRNNWVPCLEFSNVFFLFRENATSPGYYDGRYWTMWKLPMFGCTDATQVYAELEECKKAYPDN

SEQ ID NO: 14132 - DNA, 693 bp, Panicum virgatum
  misc_feature: Ceres CLONE 1773545
  misc_feature: Encodes the peptide sequence at SEQ ID NO. 14133
gatcccaatccccaacgcccgacccaactaccgcagcgagaggggagggagaaggaaaggagcagcggcggcggcggcggcggcggcgaggtctatggcgtcgacggcggggtacctggcgcggcgggcggcgcagaaggagcgggtgcgcctgctctaccgccgggcgctcaaggacacactcaactgggccgtccaccgccacctcttctaccaggacgcgtcggatctcagggacaagttcgaggccaaccgacatgtggataacctggacgtaatcgataggctcatcgatgatgcagatgctcagtataggaatttccagcaccccgatccttacatcgttccatgggcacctggtggcactaaattcacaagaaaccctcctccacctcaagggattgagattgtctacaattatggcaaggaggactagtaaacaagagtcctgcaagtggggacagaactctgcatatccagagctctgaatcacttcttgtttaatcgagttgttgtacgagaaataagaatgaaattactggacctcatctgtgtttctcattttccatggatgcttgttctgataaccctgtgttcttcatctagtcattggtcaagtgatgtttgccgtgacacaatggaattttgctttatttggcatgcagttaagcgcaaactgatgggctgcatgtc

SEQ ID NO: 14133 - protein, 113 aa, Panicum virgatum
  misc_feature: Ceres CLONE 1773545
  misc_feature (13)..(78): Pfam Name: Complex1_LYR Pfam Description: Complex 1 protein (LYR family)
MASTAGYLARRAAQKERVRLLYRRALKDTLNWAVHRHLFYQDASDLRDKFEANRHVDNLDVIDRLIDDADAQYRNFQHPDPYIVPWAPGGTKFTRNPPPPQGIEIVYNYGKED

SEQ ID NO: 14134 - DNA, 570 bp, Panicum virgatum
  misc_feature: Ceres CLONE 1773547
  misc_feature: Encodes the peptide sequence at SEQ ID NO. 14135
aaaaaccctagcgccgccgccgccgccgccgccgccgagaatggccccgaagaaggacaaggccccgccgccgtcctccaagccggccaagtccggcggtggcaagcagaagaagaagaagtggagcaagggaaagcaaaaggagaaggtgaacaacgcggtgctcttcgaccaggccacctacgacaagctgctctcggaggtgcccaagtacaagcagatcaccccctcagtcctctccgagcgtctcaggatcaatggctccctggctcggagggccatcaaggacctgatggctcgtggcctcatccgaatggtctcagtgcactcaagccagcagatctacaccagggcaaccaacacctaaggattcgggaagctgtaatgcctctgtttgccctctgtaggaggagctcctctgccttagaacagttgtcatctttgtcaagggtttgctaatgttatgttacctgtgatgagtatctccatgtggctgaaacatttcagtgattttgcgaattagttcagtactatggtttacctattataagttgccttacatcaatagcc

SEQ ID NO: 14135 - protein, 108 aa, Panicum virgatum; identical to SEQ ID NO: 12376
  misc_feature: Ceres CLONE 1773547
  misc_feature (1)..(106): Pfam Name: Ribosomal_S25 Pfam Description: S25 ribosomal protein

SEQ ID NO: 14136 - DNA, 457 bp, Panicum virgatum
  misc_feature: Ceres CLONE 1773563
  misc_feature: Encodes the peptide sequence at SEQ ID NO. 14137
taggtcgtccgcgccccctctggtccgctcgatcgccgtggatgatcgactatccccatggctgaaagaggaagccccctgccgaagtgtggggagtgggatgtcaacgaccctgcttcagatgaggaatttgcaggaatattaaacaaagctagagatgacaaaaatagtgaaggaaattcgcaggggacaagatgaacaaattaaaagtgaacaccaaccatctgggcaaggcttccacgctcccacgaagaaaaggatgtgcagcattcaacccactgccacttaatcctaaagttaccaagatagcgtctggatcgcgtaaatgagctgtgcttccttgtcaaattcctaaagacgttctgcgacatacacgcagacctgttatcgtcattctttttacggtcctgtaacgacacatggtccgcgaggcaagtaatgatactatcctgtctct

SEQ ID NO: 14137 - protein, 46 aa, Panicum virgatum
  misc_feature: Ceres CLONE 1773563
  misc_feature (1)..(46): Pfam Name: NOI Pfam Description: Nitrate-induced NOI protein
  misc_feature: Useful for making plants with modulated nitrogen use efficiency
MAERGSPLPKCGEWDVNDPASDEEFAGILNKARDDKNSEGNSQGTR

SEQ ID NO: 14138 - DNA, 840 bp, Panicum virgatum
  misc_feature: Ceres CLONE 1773578
  misc_feature: Encodes the peptide sequence at SEQ ID NO. 14139
gccaccgctgcgctgctgcgtggtagcttctgcctcacctgacctcacctccccaccccagcgagcatcaccagcagagccagcctctctctctgtcccgccgccgccccccgatccgagagagcgagcatggcgcactccctcgccgccgccgcatccttctcgccggccgccgcccggcgccaggtgacgaatgtttccttccagagccgcaggatgacttctgtgtccattcgttcaagaccaaattctcttcggcttaagatttgctgttcggctaaaaaagagacagtcgataaggtttgtagtatagtgaaggagcagctagctctccctgatgggactgcgctcagcggcgaatcaaaattcgctgaactcggtgctgattcactggatacggttgagattgtgatgggcctcgaggaggcattcaacatcactgtcgacgaaacgagcgcacaagacatcgcaactgtgcaggatgcggcggacctcattgagaagcttgtgctcgagaaggctgcataagcaccataagtggacgatccaactggacccttcgaccctgtgatcaatgactttgcattcgatctctgttgttcaagttacccatttgttgtttcttgatcgttcaagataagattttgtattgaattattgatgttgctgaggcaaattagatgcaccaaagactacatgaagcaaatgaaaatgatgtattccactttccatttgtatgttgttaaactggcgaagagtcactgcaactgtcttctagatttctgagaagtcatacagtgctttataaaaagtctgaatacgacgatgtatcgttgacct

SEQ ID NO: 14139 - protein, 132 aa, Panicum virgatum
  misc_feature: Ceres CLONE 1773578
  misc_feature (56)..(123): Pfam Name: PP-binding Pfam Description: Phosphopantetheine attachment site
MAHSLAAAASFSPAAARRQVTNVSFQSRRMTSVSIRSRPNSLRLKICCSAKKETVDKVCSIVKEQLALPDGTALSGESKFAELGADSLDTVEIVMGLEEAFNITVDETSAQDIATVQDAADLIEKLVLEKAA

SEQ ID NO: 14140 - DNA, 786 bp, Panicum virgatum
  misc_feature: Ceres CLONE 1773663
  misc_feature: Encodes the peptide sequence at SEQ ID NO. 14141
accaggcattttgtcaccggtagaaattttggcaacagcagcggcgactcgccaaaaccctcgccggcttcggctccgtttcttccccctttccctttctctgtctctcccctcccttggtcttcctttcctggcggcgccgactgggcgagcggcggcgccattcgtcacgtcttcgccgggccctccgccggcgacgaacactcaccagagatggacacatcaagccctgcagcattcgtcaatggagagattctgaaaatgtttcttgggcgaagagtgcgcacggtggttcaagtccaacgcattgaaggtggaatggttgtcggccagtccactgatgggcgtctgttgactatcaaaagtgccatggacattcctgtatcgcacttcatggaggtttatggaattactgaaaacgaccagaccatccgcgctgaagtttgcacagattttggtcccaactttgatgccaaggcatttgatgggttgtgcaagctcgcaagtgacaagttcaagcatctgttcctgtagaggtcatcattgttcggaggacctttggccgactaaagctttttcaatgctgatgacgtctctagatttaagattttgctaaatgttctggcattgagcccagtactgttacttaaaagtcagtattggacagctattagtacgtattaacccaagcagtgttaggactatgaagacaagcgaaatctatctagtcgaagaacttatggtctttcctgcttctaagcaaagcaaatctatgctttatgttgc

SEQ ID NO: 14141 - protein, 106 aa, Panicum virgatum
  misc_feature: Ceres CLONE 1773663
  misc_feature (1)..(105): Pfam Name: Rep_fac-A_3 Pfam Description: Replication factor A protein 3
MDTSSPAAFVNGEILKMFLGRRVRTVVQVQRIEGGMVVGQSTDGRLLTIKSAMDIPVSHFMEVYGITENDQTIRAEVCTDFGPNFDAKAFDGLCKLASDKFKHLFL

SEQ ID NO: 14142 - DNA, 597 bp, Panicum virgatum
  misc_feature: Ceres CLONE 1773690
  misc_feature: Encodes the peptide sequence at SEQ ID NO. 14143
gattaaatggcagccaagacctactacctatgaactcttgatctgcaaaagattttgctgtccgcccctgattagtggattgtgctttcgtctaaactggccgtttctctgctgatttgcaggcagcaccgtccgtcttgcggaggcacagaagacgtggtgcatcgcgaagccgtcggcgtcgaacgagatcctggcgcagaacctggactacgcgtgctcccaggtgagctgcgccgtgatccagaagggcgggccgtgctactacccggacagcctggtgtcccgcgccgccgtcgccatgaacctctactacgcctacagcggccgccacgcctggaactgctacttcaacaactccgcgctcgtcgtccagtccgaccccagttacggatcctgcacgtactactgatggtgagtggcgccggttgtggagtggagggacgccgtgcgaactcaactgcaaactgctgatgcagctgagacaactcagattgtcggggaacggcagaggctactctctgattgttgtgtggtggattgtgatgtgtctagtgaactgtgatgcagttgacctttggagattttcgaacagct

SEQ ID NO: 14143 - protein, 36 aa, Panicum virgatum
  misc_feature: Ceres CLONE 1773690
  misc_feature: SWISSPROT Homolog: EC 3.2.1.39 Glucan endo-1,3-beta-D-glucosidase
  misc_feature: Useful for making plants with altered carbohydrate content
MNLYYAYSGRHAWNCYFNNSALVVQSDPSYGSCTYY

SEQ ID NO: 14144 - DNA, 563 bp, Panicum virgatum
  misc_feature: Ceres CLONE 1773697
  misc_feature: Encodes the peptide sequence at SEQ ID NO. 14145
acgttcagttcaggcaacagagcagccttacaggcgtccccatggcctcccagctctccgccgccgcttccatgtccgccgccgtgccgcagttccacgtcttccagggcccgcccccggcggcgctgccgccggtgagggccggcaggaagcgcgcgcagggcatccggtgcgactacatcggctcggccaccaaccagatcatggtggtgtcgacgacgctgatgctggtggcggggcggttcgggctggcgccgtcggcgaaccggaaggcgacagcggggctgaagctcgagtcccgcgactccggcctgcagaccggcgacctcttcgggttcacgctcgccgacacgctggcctgcggcgccgtcggccacatcatcgttgtcggcatcgtgctcgggctcaagaacaccgacgcgctcgaccagatcatcggctaggtccagtatctgcctttgccgctctcggcgccggcccggtgcccatgtaacctgcgtgtgtacatcgactccgcgctcatgcatctcgttccaatggacatagcttgtttgttgctcctt

SEQ ID NO: 14145 - protein, 133 aa, Panicum virgatum
  misc_feature: Ceres CLONE 1773697
  misc_feature (48)..(128): Pfam Name: PSI_PSAK Pfam Description: Photosystem I psaG / psaK
MASQLSAAASMSAAVPQFHVFQGPPPAALPPVRAGRKRAQGIRCDYIGSATNQIMVVSTTLMLVAGRFGLAPSANRKATAGLKLESRDSGLQTGDLFGFTLADTLACGAVGHIIVVGIVLGLKNTDALDQIIG

SEQ ID NO: 14146 - DNA, 825 bp, Panicum virgatum
  misc_feature: Ceres CLONE 1773719
  misc_feature: Encodes the peptide sequence at SEQ ID NO. 14147
aagcagccccccccccccccccccgccggatcgaaccgcctagggtttgcgctgcgcgaagatgaagcggccgcgcggcggcggcgaggcgtcggccggcgagggagggagcggcggcgggttcgggaaggggaaggggaaagggaggtggggcggcgggagccggaggcggaacgagcagcggctgggcgtcggcggcggcggggcgctctccctcgcggcgttcgccagcgccaagtcccggaacaccggctacaacccggccctcatcaagaagaagaaagagttctacaagaatgctaagttaattagcaagtacaaaaggacaaagaagcaacacagtcagtcaaacaaccctccagaatttccaatccgtgaggatagggatgataatgcacaaaatgtgccaaagccgcatcataaagggaagaagcgcactgcgcaaagcttgaaggcagagtatgagaaaaagcgtgcggaggatgagaaggctaagaaggagcgggatgtgatcattcaggcaaagagggaacagcaggagaagtctgaggcgaagcggagggaactgagggagaagatgttcaagaagacaagatctggccaacctgtgatgaaataccgtatcgagcatctcttggagactgcgctacaaaactgatgcaagtgacacgatatcagtaatcgccatgaccgctgtccgcccgggacctaagcatgcacacaaactttgtagttatgttcaaccatcagtttggtttaagtttaacatactttgttgacttattgtatatatcttttctagcaatctttggatttgatcacatc

SEQ ID NO: 14147 - protein, 198 aa, Panicum virgatum
  misc_feature: Ceres CLONE 1773719
  misc_feature (57)..(195): Pfam Name: rRNA_processing Pfam Description: rRNA processing
MKRPRGGGEASAGEGGSGGGFGKGKGKGRWGGGSRRRNEQRLGVGGGGALSLAAFASAKSRNTGYNPALIKKKKEFYKNAKLISKYKRTKKQHSQSNNPPEFPIREDRDDNAQNVPKPHHKGKKRTAQSLKAEYEKKRAEDEKAKKERDVIIQAKREQQEKSEAKRRELREKMFKKTRSGQPVMKYRIEHLLETALQN

SEQ ID NO: 14148 - DNA, 747 bp, Panicum virgatum
  misc_feature: Ceres CLONE 1773725
  misc_feature: Encodes the peptide sequence at SEQ ID NO. 14149
cctagtctccatccccccacccgccgcccctcaaccctacccagccgccgccgccgccgccgccgccgccgcgcggaggcgaccccctaccgccgccaagatgcagatcttcgtgaagaccctgacggggaagaccatcacgttggaggtggagtcctcggacaccatcgacaacgtgaaggccaagatccaggacaaggagggcatccccccggaccagcagcggctcatcttcgccggcaagcagctcgaggacggccgcaccctcgccgactacaacatccagaaggagtccaccctccacctggtgctccgcctccgcggtggcgccaagaagcgcaagaagaagacctacaccaagcccaagaagatcaagcacaagcataagaaggtgaagctcgccgtcctgcagttctacaaggtcgacgacgccactggtaaggtcacccgcctccgcaaggagtgccccaacgccgactgcggcgcgggtaccttcatggccaaccacttcgaccgccactactgcggcaagtgcggcctcacctacgtctacaaccagaaggcgtaatcgcttgcatcgctttgcttagcattacccgcctacctatcatgaaattgagctgttggtttctcgagttggatatcatttagatctgtctgaggttgaaacttaaatggagtagcagtatctattttctcggaacgcctgttactgagctgatatgatgcgagtttaattttggttcc

SEQ ID NO: 14149 - protein, 155 aa, Panicum virgatum
  misc_feature: Ceres CLONE 1773725
  misc_feature (6)..(74): Pfam Name: ubiquitin Pfam Description: Ubiquitin family
  misc_feature (101)..(148): Pfam Name: Ribosomal_S27 Pfam Description: Ribosomal protein S27a
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNADCGAGTFMANHFDRHYCGKCGLTYVYNQKA

SEQ ID NO: 14150 - DNA, 747 bp, Panicum virgatum; identical to SEQ ID NO: 14148
  misc_feature: Ceres CLONE 1773726
  misc_feature: Encodes the peptide sequence at SEQ ID NO. 14151

SEQ ID NO: 14151 - protein, 155 aa, Panicum virgatum; identical to SEQ ID NO: 14149
  misc_feature: Ceres CLONE 1773726
  misc_feature (6)..(74): Pfam Name: ubiquitin Pfam Description: Ubiquitin family
  misc_feature (101)..(148): Pfam Name: Ribosomal_S27 Pfam Description: Ribosomal protein S27a
  misc_feature: Useful for making plants with modulated nitrogen use efficiency
  misc_feature: Useful for making plants with modulated cold sensitivity
  misc_feature: Useful for making plants with modulated flowering time

SEQ ID NO: 14152 - DNA, 525 bp, Panicum virgatum
  misc_feature: Ceres CLONE 1773764
  misc_feature: Encodes the peptide sequence at SEQ ID NO. 14153
aaactagctagcactaccagtcccttgctgctactccgttcctgtacctagcctagtgctcagctgagcttaccacccaaatatataaggcgcaaaccatggcatccaaggccgtcctcttcttggcactcaacctcctcttaatcacggtggccaacgcctgccgcacctgcccaaccccaccaacccccccggctgtgcccccgccgccgccaccttctaccccacccccaacatccagcgccaagagccccgcgaactcgctcccattccgcgagtgcctccacccgctccgcctcggcaagggccaggcccgccaggagcccgcacaaccatgctgcagcctcctcaaccgcctccccgacttgcaggccgacctctgcctctgcacggccatcaaagcccactggctctgcgtcgccatccacatccctatcaagctcatcgccctcgtcaactactgcggcaagtgcgtgcccaaaggctacacctgtgcgtaaacacgccgcggctacacgctcgtat

SEQ ID NO: 14153 - protein, 133 aa, Panicum virgatum
  misc_feature: Ceres CLONE 1773764
  misc_feature (44)..(132): Pfam Name: Tryp_alpha_amyl Pfam Description: Protease inhibitor/seed storage/LTP family
MASKAVLFLALNLLLITVANACRTCPTPPTPPAVPPPPPPSTPPPTSSAKSPANSLPFRECLHPLRLGKGQARQEPAQPCCSLLNRLPDLQADLCLCTAIKAHWLCVAIHIPIKLIALVNYCGKCVPKGYTCA

SEQ ID NO: 14154 - DNA, 924 bp, Panicum virgatum
  misc_feature: Ceres CLONE 1773784
  misc_feature: Encodes the peptide sequence at SEQ ID NO. 14155
gctcgtgccggcgacgaccacgacaaggaggccgcggcgcgagagctccccagggatctatttctcttcgcagcaccagcggcagcagcagcaagaggaagatgccgtcggcgttcagcggcgatgagaccgcccccttcttcggcttcctcggcgccgccgccgcgctaatcttctcatgcatgggggcggcgtacgggacggccaagagtggcgtcggcgtggcgtccatgggtgtcatgcgcccggagctcgtcatgaagtccatcgtgcccgtggtcatggctggtgtgctcggtatctacggcctcatcattgccgtcatcatcagtactgggatcaaccccaaggccaagccatactacctcttcgacggctatgcccacctgtcgtctggccttgcctgtggtcttgctgggcttgctgccggcatggccattggcattgtcggtgatgctggtgtcagggccaacgctcagcaacctaagctgttcgtgggcatgatcctcatcctcatttttgccgaagcactcgccctctacggtctcatcgtaggcatcatcctctcatcccgcgccgggcagtcccgtgcagactaggcgcgttccagatgtcaataccatgtctggccctggcagggccctgttttatattcatgagacaagaaggcggagctctttagaggcttattttcatactgtctagttttcgttcttctgtttgggtctgaaacatgtgcaaccaagggaggtgggacttccctttgtggtgccgatgccattctttatccgtcgtggtggtggtgggctgtggtcgatgctcattatttatgcacagcttttctgttggggtgtggtacggctggacggcgttgtaatgtggtgaataagaataagcaaggacatgcaacacgacgagtgtcgg

SEQ ID NO: 14155 - protein, 165 aa, Panicum virgatum
  misc_feature: Ceres CLONE 1773784
  misc_feature (93)..(158): Pfam Name: ATP-synt_C Pfam Description: ATP synthase subunit C
  misc_feature (14)..(79): Pfam Name: ATP-synt_C Pfam Description: ATP synthase subunit C
  misc_feature: SWISSPROT Homolog: EC 3.6.3.14 H(+)-transporting two-sector ATPase
MPSAFSGDETAPFFGFLGAAAALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 14156 - DNA, 623 bp, Panicum virgatum
  misc_feature: Ceres CLONE 1773795
  misc_feature: Encodes the peptide sequence at SEQ ID NO. 14157
agaaggtggagaaagtaagaactacccttgctgatttatttgcagcagaagcattttcatctagtgctccaggggagaagaattgccaggatatcgtcattgttgctggggcatccacttcgaagcctgcattgtgcactgaaaaggtgcatcaaaagaaaccaacgaagcccacaccaaagccactgaaagccacaagaaaattaagtcgggtcatgaggaagatgttggggaagaaaatccacccagagcagctcaatgggcgtagcaatgcagagggtcctcttactgcatgatgtacttagccttgccgacaagtttgcttccctatctggcttcattgaatccctacgactgagattccttgcccgagagaagcatccatggatagttcgacagtgtcgaagtaccttttttgttgccgtgtttcttcgccagtgaagcattccgctttccctatacatattctcgtcgttcctatttgcatgtaaaaatcaactgttgaggtgtgtacgatcttgtaaggtgtcgttctccggcgcgctgtcggcgccgcactgtcccgtcgtcgcagtatgtgtcggaaagaaaaattaataaacctcctctgtttatcagttggc

SEQ ID NO: 14157 - protein, 97 aa, Panicum virgatum
  misc_feature: Ceres CLONE 1773795
  misc_feature: Useful for making plants with modulated light quality sensitivity
KVEKVRTTLADLFAAEAFSSSAPGEKNCQDIVIVAGASTSKPALCTEKVHQKKPTKPTPKPLKATRKLSRVMRKMLGKKIHPEQLNGRSNAEGPLTA

SEQ ID NO: 14158 - DNA, 997 bp, Panicum virgatum
  misc_feature: Ceres CLONE 1773798
  misc_feature: Encodes the peptide sequence at SEQ ID NO. 14159
acgccgccaccacaccactctctctctctctctctctctctctctctttcctcgctcgccccgaaaccagatcggcgcggagagcggaggggggccgggggcgtagcgggcagaggagcaatggcggcggggtaccgggcggaggacgactacgactacctcttcaaggtggtcctgatcggcgactccggcgtcggcaagtccaacctgctctcccgcttcacgcgcaacgagttcagcctcgagtccaagtccaccatcggcgtcgagttcgccacccgctccctccaggtcgacggcaaggtcgtcaaggcccagatttgggacaccgccggccaggaaagatatcgagctatcactagtgcatattaccgaggtgctgttggagctttgcttgtttatgatgtcactcgtcactcaacctttgagaacgttgagcgctggtcgaaggaattgagggaccatacagatcccaacatagttgttatgctggttggcaacaaatctgatctgcgccatcttgtagcagttcaaacagatgaaggcaaggcattcgcagagagggaatcactctacttcatggagacctctgcgctcgagtccaccaatgttgagaacgcattcgcaaaggtgttgacccagatctaccgcatcgtgagtaagcgagcagtcgaagcgggcgaagacgcagcctctgggcctggcaagggtgagaagatcaatataaaggatgatgtttcggcggtgaagagtggtggctgctgctcttagctgagcagcactggtgtattttttgagttgtgtgatgtagcttatgttatggttttttcccagcgaccgagaattgttagtggcattagcagcttctatgttacctagagagtttattgccaaactggaaaagttaaaaactgaaggttagatcagtttagatctttctgttaccatgtttattgtattgtgtatccggctataggcatggtattgatttttctgt

SEQ ID NO: 14159 - protein, 216 aa, Panicum virgatum
  misc_feature: Ceres CLONE 1773798
  misc_feature (16)..(177): Pfam Name: Ras Pfam Description: Ras family
  misc_feature (16)..(130): Pfam Name: Miro Pfam Description: Miro-like protein
  misc_feature: Useful for making plants with altered lignin content
  misc_feature: Useful for making plants with altered terpenoid content
  misc_feature: Useful for making plants with altered alkaloid content
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWSKELRDHTDPNIVVMLVGNKSDLRHLVAVQTDEGKAFAERESLYFMETSALESTNVENAFAKVLTQIYRIVSKRAVEAGEDAASGPGKGEKINIKDDVSAVKSGGCCS

SEQ ID NO: 14160 - DNA, 645 bp, Panicum virgatum
  misc_feature: Ceres CLONE 1773819
  misc_feature: Encodes the peptide sequence at SEQ ID NO. 14161
attcgctgcgccgtcacttccttccactccccccaacctctcaaaccctcgtcggcgaggcctccggcggcggcgagtatggtgaagggacgccaaggccagcgcgtcaggatgtacgtgcggggcacgatcctgggctacaagcggtccaagtcgaaccagtacgagaacacgtcgctgctgcagatcgagggcgtcagcaccaaggaggatgtggcgtggtacggcggcaagcggatcgcctacgtctacaaggccaagaccaagagcgacggcaccagcatccggtgcatctggggcaaggtgacgcgcccgcacggcaactccggcgtcgtgcgcgccaagttccggtccaacctcccgcccaactccatgggtaagaaggtccgcgtcttcatgtatcccagcagtatctaatcaaggtatcttccatattcggtcaagcttcctacttttgaggatgtttagctgaaaagtttccatggcgattttgagcagtttagctttgcttttttttttactgaacaggctgttagtcgcgacctagacaacttatgtcaattgtaactggcttttagtcgcaacctagacaacttttgtcaattgtaactcattggccttgaaatgaaagtattatgctgtgtt

SEQ ID NO: 14161 - protein, 112 aa, Panicum virgatum
  misc_feature: Ceres CLONE 1773819
  misc_feature (12)..(106): Pfam Name: Ribosomal_L35Ae Pfam Description: Ribosomal protein L35Ae
MVKGRQGQRVRMYVRGTILGYKRSKSNQYENTSLLQIEGVSTKEDVAWYGGKRIAYVYKAKTKSDGTSIRCIWGKVTRPHGNSGVVRAKFRSNLPPNSMGKKVRVFMYPSSI

SEQ ID NO: 14162 - DNA, 825 bp, Panicum virgatum
  misc_feature: Ceres CLONE 1773862
  misc_feature: Encodes the peptide sequence at SEQ ID NO. 14163
gagcgctggcatcactaggagtcttgcctctgtaggtagagactgttgttgcaggggaagagaccagaagaggggaagagggcaatggcgacctccttccaggggacgacaaccaagtgcaccgcctgcgacaagacggtgtacctcgtcgacaagctcaccgccgacaaccgcgtctaccacaaggcctgcttccgctgccaccactgcaagggcaccctcaagctcgcgaactacaactccttcgagggggtgctctactgcaggcctcacttcgaccagctgttcaagaggacggggagtctggacaagagcttcgaaggaactcccaaggttgtcaagccagaaagaaagaatgagaatgctattaaagtctccactgcctttgctggcaccagagagaaatgtgttggatgcagcaagacagtctatccaattgagaggagctgcttcaagtgctgccatggaggatgcaccatcagcccttcgaactacatcgcgcacgaggggaagctctactgcaagcatcaccacatccagctgatcaaggagaaggggaacttcagccaactcgagaatgatcacgagaagacatcacaggctggatcgctggaggacgaagaagcagagtattaatctttgagcatttccacagatgaataatgaatctccttgcatttgctcgagagcaatatatctttctgtggcacggtttgatttcagttttaccaatggaggtcatgtgcactgagaacaatgatacatcgtcttgtatctgcatgtaaaccttgttaaatctgagtcaaattctctaccggtttcacc

SEQ ID NO: 14163 - protein, 183 aa, Panicum virgatum
  misc_feature: Ceres CLONE 1773862
  misc_feature (12)..(68): Pfam Name: LIM Pfam Description: LIM domain
  misc_feature (108)..(154): Pfam Name: LIM Pfam Description: LIM domain
  misc_feature: Useful for making plants with altered carbohydrate content
  misc_feature: Useful for making plants with modulated heat sensitivity
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
MATSFQGTTTKCTACDKTVYLVDKLTADNRVYHKACFRCHHCKGTLKLANYNSFEGVLYCRPHFDQLFKRTGSLDKSFEGTPKVVKPERKNENAIKVSTAFAGTREKCVGCSKTVYPIERSCFKCCHGGCTISPSNYIAHEGKLYCKHHHIQLIKEKGNFSQLENDHEKTSQAGSLEDEEAEY

SEQ ID NO: 14164 - DNA, 673 bp, Panicum virgatum
  misc_feature: Ceres CLONE 1773891
  misc_feature: Encodes the peptide sequence at SEQ ID NO. 14165
aactaggctctcttcacacgagcgcaaccaccaccccccaccactacaagcggaagcgagcggcggcggcggcggcggcggcgatgtcgggcaggggcaagggcggcaaggggctcgggaagggcggcgcgaagcgtcaccggaaggtgctccgcgacaatatccagggcatcacgaagccggcgatccggaggctggcgaggaggggcggagtgaagcgcatctccgggctgatctacgaggagacccgcggcgtgctcaagatcttcctcgagaacgtcatccgcgacgccgtcacctacacggagcacgcccgccgcaagaccgtcacagccatggacgtcgtctacgcgctcaagcgccagggccgtaccctctacggcttcggcggctaggttaggggtctgtcgttgtggttcggttccatgggtagccttatcgccttacatgttttccggtagttgctgtagcgagtagtagctggttgcttggtccctttggcgtcggctgtgtcgatgtaagaaccgctggttcgaagcaattggtctggatgcaggatgctgatgtaggaaatctgcagttcactttcaattgttattctacgaatactgtttgtctcgaagtaaactctgcacaaattgtcctggattgggcggtgtaaacctgttcggtt

SEQ ID NO: 14165 - protein, 103 aa, Panicum virgatum; identical to SEQ ID NO: 12044
  misc_feature: Ceres CLONE 1773891
  misc_feature (25)..(94): Pfam Name: Histone Pfam Description: Core histone H2A/H2B/H3/H4

SEQ ID NO: 14166 - DNA, 675 bp, Panicum virgatum
  misc_feature: Ceres CLONE 1773922
  misc_feature: Encodes the peptide sequence at SEQ ID NO. 14167
aacgggtcgcttttgaatcctccgacgattctccccgaatcgccgccgccctggcgcacccaatgccggcgccctccccgctccacctcctgctcctcgcccccatcctcctgctcctctccccgcgcgcgtccgccgcgggggcgggggtcggggtgagcggcgggggccagctgtggtgcgtggccaagaacaacgccgaggacggcgcgctgcagagcgccatcgactgggcgtgcagcgccgacggcggccgcgccgactgcgccgccatccagcagggcggcgcctgctacggcccgcccgacctccagcgccacgcctcctacgccttcaacgactacttcctccgcgccggcggcgccgccagccccgccgcctgcgacttctccggcgccgccgcgctcaccgcgctgaaccccagttatgggagctgcgtgtttccttccagcacttccccaaaaaatggcagcttcacaggaacaacaacctacggttcaagcagtacagaattaagctacaattcttcttggaaacccatcccctggtcgtggctcttacatatctctttatctttaattcttttgtttatcacacattcgtgacaagttttctgaaactcttgtttgcgagtacgatgaactatcatgcttctggaatataattggttctctt

SEQ ID NO: 14167 - protein, 180 aa, Panicum virgatum
  misc_feature: Ceres CLONE 1773922
  misc_feature (38)..(127): Pfam Name: X8 Pfam Description: X8 domain
  misc_feature: SWISSPROT Homolog: EC 3.2.1.39 Glucan endo-1,3-beta-D-glucosidase
MPAPSPLHLLLLAPILLLLSPRASAAGAGVGVSGGGQLWCVAKNNAEDGALQSAIDWACSADGGRADCAAIQQGGACYGPPDLQRHASYAFNDYFLRAGGAASPAACDFSGAAALTALNPSYGSCVFPSSTSPKNGSFTGTTTYGSSSTELSYNSSWKPIPWSWLLHISLSLILLFITHS

SEQ ID NO: 14168 - DNA, 466 bp, Panicum virgatum
  misc_feature: Ceres CLONE 1773943
  misc_feature: Encodes the peptide sequence at SEQ ID NO. 14169
tcgactcggatcggagactcccatcgtcgtagcagttggcgcgacagccagccagcagcagaagagcacccggatccggattaactagcgtcgccccctcctactattgcattgctcgctggcctgatggcgtctgtggaggcagcgcgcggggcggcggcggcggaggagaagtcggcgcgggcggcggtggacgggagggcggtggaccaggcggtggcgtacgtgctcatggccgccgcgctcgccgtcacctacctcgtccactgaaggaacgtcccggccggctgtttcgtaggcgcacgcggtgggtcaattggtttttttttttaggggtgtggtgggtcaattagttcaccgtggctcgctcggtggagcggccgtctgtacagtttgctactgcctgataatacgactattatcataagcagtgttcaaaattttggcaaaatttccaaattcgcag

SEQ ID NO: 14169 - protein, 47 aa, Panicum virgatum
  misc_feature: Ceres CLONE 1773943
  misc_feature: Useful for making plants with altered cell wall content and/or composition
  misc_feature: Useful for making plants with modulated nitrogen use efficiency
  misc_feature: Useful for making plants with modulated salt sensitivity
MASVEAARGAAAAEEKSARAAVDGRAVDQAVAYVLMAAALAVTYLVH

SEQ ID NO: 14170 - DNA, 799 bp, Panicum virgatum
  misc_feature: Ceres CLONE 1773948
  misc_feature: Encodes the peptide sequence at SEQ ID NO. 14171
atccgatcctctcactgcatgcccttggttcgatcactacccatcaatactgctgggtgctgactggccatcctacacactaagagagaagggaaagaagaagttgacccaactagcactcgcattcgcattgccatccagtgcaacacgatggctctcaggctgtgggctagctcagcagccaatgcgctcaagctctccggagccagggctgccggcccgtcctactccatctccagattcttctccacagttcatgacgggttgctgtacactacgtctcatgagtggctcaaggaccatggggacggcgtcgtctcggttggcatcacggaccatgctcagagtcaccttggcgaggtggtcttcgtggagctgccggaacccggcgcgacggtcgctgcaggaggatccttcggcaacgtggagagtgtgaaggccaccagcgacgtcaactcccccatctccggcgaggtcgtcgaggtcaactccaagctgtccgagacgcccggcctgatcaactcgagcccgtacgaggaggggtggatgatcaaggtgaagccgagcagcccggcggagggcctgctggacgccgccaactacaccaaggactgcgaggaggaagacgctcactagagagccagcagatagatcatgcacgtacacgctgcgtttgctgcttatgatccacatacatagtgtgttctattggttgtttcagtcattttttttttgctttatttattttcttgcaaaagctccaccaacctttatgcaataaccaaaggcactcaccttt

SEQ ID NO: 14171 - protein, 161 aa, Panicum virgatum
  misc_feature: Ceres CLONE 1773948
  misc_feature (39)..(158): Pfam Name: GCV_H Pfam Description: Glycine cleavage H-protein
MALRLWASSAANALKLSGARAAGPSYSISRFFSTVHDGLLYTTSHEWLKDHGDGVVSVGITDHAQSHLGEVVFVELPEPGATVAAGGSFGNVESVKATSDVNSPISGEVVEVNSKLSETPGLINSSPYEEGWMIKVKPSSPAEGLLDAANYTKDCEEEDAH

SEQ ID NO: 14172 - DNA, 960 bp, Panicum virgatum
  misc_feature: Ceres CLONE 1773955
  misc_feature: Encodes the peptide sequence at SEQ ID NO. 14173
agccgagctcacagctccctgctcacctcccatggccgccgccgccggagcagccgcgactgccttctccagcgggcggaggatcccgcccggcacgcgtgccgccgcggtttccccacgcgccgaggcccccggcaagtaccgcggccgcgtcgtccctgctattcccaggaggaatgtgctgtcgacaatgttatccacctcaacagtcctacttttaggacccaagcagatcaccctagctgagactaccggcggcgcattcagggagtacatcgacacatttgatggctacaccttcctgtaccccaaaagctggatccaggtgcgaggtgctggcgcagacatattcttcagggaccccttcgtcctggacgagaacatgtctgttgagatatcatccccttcgtcatcaaaatacaccagtgtcgaggatctcggccttccggagaaggctgcggagaaggttctgaagcagtacctgacggagttcatgtcgaccaggctaggcgttcggcgcgaatcgaacatcctgtcggcgtcatccaaggttgccgacgatggcaggctgtactacgaagttgaggtgaacataaaatcctatgcgagcaacaacgagctggcagtgatgccgcaggacagggtgcagagcttggagtgggaccggcgatacctgtcggtcctcggtgtcgagaacaagcggctctacgagctccggttgcagacgccagagcaggttttcatgcaggaagaggaggaccttagaagagtcatggactccttcagggtcatcgagacggcgtagtacggtgcagacagaaccaagcgcttgcagaacattgcaatgctttgcctgagggtagagcacggaatttttgtatagctggtctcatatttgttgataaacttgtcttggataagatattaaggttatatgtaatgtcatgatgctgtaaatcg

SEQ ID NO: 14173 - protein, 257 aa, Panicum virgatum
  misc_feature: Ceres CLONE 1773955
  misc_feature (40)..(254): Pfam Name: PsbP Pfam Description: PsbP
MAAAAGAAATAFSSGRRIPPGTRAAAVSPRAEAPGKYRGRVVPAIPRRNVLSTMLSTSTVLLLGPKQITLAETTGGAFREYIDTFDGYTFLYPKSWIQVRGAGADIFFRDPFVLDENMSVEISSPSSSKYTSVEDLGLPEKAAEKVLKQYLTEFMSTRLGVRRESNILSASSKVADDGRLYYEVEVNIKSYASNNELAVMPQDRVQSLEWDRRYLSVLGVENKRLYELRLQTPEQVFMQEEEDLRRVMDSFRVIETA

SEQ ID NO: 14174 - DNA, 983 bp, Panicum virgatum
  misc_feature: Ceres CLONE 1773975
  misc_feature: Encodes the peptide sequence at SEQ ID NO. 14175
atcaccaaccaccccttgcgcccgtcctctccccctcaccggccctcccaccgattcgctcgctcgccgcccgcccgcgcgcgcgcgcgagatccagaccagacgccgccgccgcgcgccgacggggtctctgcccacccgacgggacgaacctgtaggacggcgccgaagaggacgaggtggaagcgggggccatggaggcgtcttcctgggacgcccttcgcaagcaggcgaggaggttggaagctcagttagatgaccaaatgattgcataccgtaaattggtttctatgaaatcggatggttcagagaacgatattgagtcagatatagaaagatcgctgaagcaattgcaacaagtaaattcgcaaatgcaaacttgggtatcatcaggaggttctgaagttctttctcatactctgactcgtcatatggagattttgcaagaccttacccaggaattctaccggcttcgatcaagcctcagagtgaaacaacaacatgcttcactccttgacttgagagattttgatagagcaaagtttgatgttgaagaggcatcagactcagctgatcaagctcttctaagggaacaagctgcaataagcaggagtactggacagatggataacgtgatatcgcaagctcaagcgatgctaggctctctcatgactcaacggtcaacatttggcggcatcacttcaaagataagcaatgtcagcagccggcttccgacgattaaccacgtcctctcgtccatcagaaggaaaaaatccatggacaccatcattctttcgctcgtcgcctccgtctgcgccttcctcatcttcatctactggttgtctaagtagtttttgccagagcaaaaggtattacagtgttgtacgtttgggatcacactaccggtacagataaacttgattggtgtttgtacaatattggttgattcaatgctattacgattcgggcgtgctgtagccacc

SEQ ID NO: 14175 - protein, 218 aa, Panicum virgatum
  misc_feature: Ceres CLONE 1773975
  misc_feature (46)..(196): Pfam Name: V-SNARE Pfam Description: Vesicle transport v-SNARE protein
MEASSWDALRKQARRLEAQLDDQMIAYRKLVSMKSDGSENDIESDIERSLKQLQQVNSQMQTWVSSGGSEVLSHTLTRHMEILQDLTQEFYRLRSSLRVKQQHASLLDLRDFDRAKFDVEEASDSADQALLREQAAISRSTGQMDNVISQAQAMLGSLMTQRSTFGGITSKISNVSSRLPTINHVLSSIRRKKSMDTIILSLVASVCAFLIFIYWLSK

SEQ ID NO: 14176 - DNA, 661 bp, Panicum virgatum
  misc_feature: Ceres CLONE 1773991
  misc_feature: Encodes the peptide sequence at SEQ ID NO. 14177
ttcaacccacagaaaaagcaaggacagagcgagataaagaggggaagagtcttcgggccttccgagagagggagatggtgtccagggagcagaagggaggagttttgcatgagaagctgcagattctccgaagcgttactcattctcatgcgggagataacatgtccataatcgctgatgcatcatcatacatcaaagatctgaagcagaaaatcgcaaagctgaaccaagagatcgcatctgcacaacacgccaatgtttgccaaccattggtaagtgttgaggtcgtagagaacggtttcctgatcaatgtgttcatggacaagtgtagcccaggactgcttggttccattcttgaggcatttgatgagattgggctaagcgtgcttgaggccagggctacctgcgctggatcatttcgtcttcaagctgtaggagaggaagaagctgaggatttaatcgatgcacatgcagtggagcaagccgtgattcaagcaatcaagaactgtccttcaaaaaaataaacttagagctgttcggtctagtttaatctgttgctgttgaaattagtgctaggagcacaagattttccgtctaaactccaagttatacctatttgttatcatcctttagaagagagcaaagtatattctcttcgtgc

SEQ ID NO: 14177 - protein, 149 aa, Panicum virgatum
  misc_feature: Ceres CLONE 1773991
  misc_feature: Useful for making plants with modulated biomass
MVSREQKGGVLHEKLQILRSVTHSHAGDNMSIIADASSYIKDLKQKIAKLNQEIASAQHANVCQPLVSVEVVENGFLINVFMDKCSPGLLGSILEAFDEIGLSVLEARATCAGSFRLQAVGEEEAEDLIDAHAVEQAVIQAIKNCPSKK

SEQ ID NO: 14178 - DNA, 663 bp, Panicum virgatum
  misc_feature: Ceres CLONE 1773995
  misc_feature: Encodes the peptide sequence at SEQ ID NO. 14179
atccgttcccaaagctcccacagacaatcaagctagcgagaaactacgacaagaagccagacagcggcgagatcgctcggatcaaagtgatccatggggccgaggaggtcgacttcgccggccgggagcagcgggggcagcggcccataccagcagccgaggctgcgcggcgtgcgaaagcgggcgtggggccggcacccggcgcacatgccacaccccgtgcgccaggcgcgcgtgtggctcggcaccttccacacgaccgaggaggcggcgcgcgcctacgacgccgccgcgcgcaggctccgcgggcccggcgccgccaccaactaccccgcccagggcgcaaaggcaccggcggcgagcgcgagcgggagcatcgggttgtcggtggacgcgtcgtcatcctgctcctcccgggactcgccgcgggcggtgacggcgtccgtcgcggcgcccccgtcgctggacctgagcctggcgctcccggccatggtgaccacaccgtcgtcgcaccacgtgttcatggacccggcctcgacgatggtggccgtggcgccggcgctgctgcagttcctgccgcccaagagcgaggaagagcagagcttgtcagggtcgtcctcgtggtcgtcgtcggtggtgttcgacgcggcgccggccgtgggc

SEQ ID NO: 14179 - protein, 189 aa, Panicum virgatum
  misc_feature: Ceres CLONE 1773995
  misc_feature (22)..(73): Pfam Name: AP2 Pfam Description: AP2 domain
MGPRRSTSPAGSSGGSGPYQQPRLRGVRKRAWGRHPAHMPHPVRQARVWLGTFHTTEEAARAYDAAARRLRGPGAATNYPAQGAKAPAASASGSIGLSVDASSSCSSRDSPRAVTASVAAPPSLDLSLALPAMVTTPSSHHVFMDPASTMVAVAPALLQFLPPKSEEEQSLSGSSSWSSSVVFDAAPAV

SEQ ID NO: 14180 - DNA, 895 bp, Panicum virgatum
  misc_feature: Ceres CLONE 1774116
  misc_feature: Encodes the peptide sequence at SEQ ID NO. 14181
aagccctaaccaaaaatctatccccccttcccgctggcggcggccacccccgacgagccggcgcccccctccgccctgcacccacccggagcctgtctccgccggcgagctcctctgcccccccgcgccgagcgcgcccctcaccttccgctcgggcgcgccctcacccgtaccgccgggagcgcgcgtcgcggcgcctctcgcacctcctcgcgccgtcgggtggcctgtggcaagcaaaatggctttctcatcaattttcaggagagtgaatgtcaaagaactgatctcaaatgcttcagtgtatgctagcgcaacagaatcttctggagtaatgagcttggtgtttagacgctgggccaccaagaagactgctggatcgacaaaaaatggccgtgactccaatcccaagtatttaggcgtcaagaagtttggtggagagaaagtggaaccaggaaacatcattgttcgccaaagaggaacgcgcttccaccctggaaactacgtcggcatgggcaaggatcacactctcttctgcctgaaggaaggacatgtgcgatttgagcgcaacaaactgactggcaggaaatgggttcatgttgaccctgtggctggccatgtcctccaccctgtctacgccagtggctcgactactgcagctgacctggatgcacaattgtagcgaccatgcagttgcttatgctcttcccgccgattgtgccgctcctgtgctagtcttgcacaatgcaacttgttccagtaaagatgcgtgcgagtaagaaatattgcagctatacgtagcttcagtgaggagcagataatttgagtttggttgatgttcctttataacatcacttatttttagactcaatgttggttttgtggtttcatatcc

SEQ ID NO: 14181 - protein, 146 aa, Panicum virgatum
  misc_feature: Ceres CLONE 1774116
  misc_feature (40)..(121): Pfam Name: Ribosomal_L27 Pfam Description: Ribosomal L27 protein
  misc_feature: Useful for making plants with modulated biomass
MAFSSIFRRVNVKELISNASVYASATESSGVMSLVFRRWATKKTAGSTKNGRDSNPKYLGVKKFGGEKVEPGNIIVRQRGTRFHPGNYVGMGKDHTLFCLKEGHVRFERNKLTGRKWVHVDPVAGHVLHPVYASGSTTAADLDAQL

SEQ ID NO: 14182 - DNA, 712 bp, Panicum virgatum
  misc_feature: Ceres CLONE 1774119
  misc_feature: Encodes the peptide sequence at SEQ ID NO. 14183
aatctcgcttgcacacgacacgcgacgaccgcagcgccgccggaggtgggaagaaggcggcgccggcgccggcgccggcgaggaattcaagggagactaagccatggtggtccggatccggctggcgcggttcgggtgccggaaccggcctttctaccgcgtgatggccgccgacagccgctccccgcgcgacggcaagcacctcgaggtcctcggctactacaacccgctcccagggcaggatggtggcaagaggatgggtctgaaattcgaccgggtgaagtattggctctcagttggggcacaaccatctgatcctgttcagcgtattctgtttcgggctggacttcttcctccacctccaatgctagccatggcacgtaagggtgggccccgtgataggcgccccatccatccaatgaccgggaaacccttggatcttgagggcgtcacaatagttgatgactccaatgctcctggaggcgatgctgaagaacctaaagatgaggtgacgtcataagtcttttgctttagcatgtgaaaatgatgctagattttgtatcttagcatatgcagtgatgctgcaagagaaaacaaacatgtttgttgttgctctgacaaacctgagtactctatgatgtggcaaacttttggacatgtattgtttcatccattttgttctacaaaatgacagtattgttgttttcctcct

SEQ ID NO: 14183 - protein, 138 aa, Panicum virgatum
  misc_feature: Ceres CLONE 1774119
  misc_feature (9)..(70): Pfam Name: Ribosomal_S16 Pfam Description: Ribosomal protein S16
MVVRIRLARFGCRNRPFYRVMAADSRSPRDGKHLEVLGYYNPLPGQDGGKRMGLKFDRVKYWLSVGAQPSDPVQRILFRAGLLPPPPMLAMARKGGPRDRRPIHPMTGKPLDLEGVTIVDDSNAPGGDAEEPKDEVTS

SEQ ID NO: 14184 - DNA, 636 bp, Panicum virgatum
  misc_feature: Ceres CLONE 1774162
  misc_feature: Encodes the peptide sequence at SEQ ID NO. 14185
accgcgaaaccttatccccaaaaaaacccacccggataaaccctagcgctccgtcgatgtcggcggccatccgctccggcgagctcctcgcgtgccccgtcgcgctgcggcgggcgccgctggcggtgtcggtgcgggtgcgggtgcggggggcgccggcagcgagggcggtggtgcgggcggaggcgacggccgagggggtcgggaaggccaagggggcgggggcgggggcggggaagaagagggcggcgagcgggatcacgaaacccaagccaatctcgcccgagctgcgggagttcgtcggcggcgcggcggagctgccccggaccgaggccatcaagctcgtctgggcgcacatcaagggcaacaacctgcaggatccaaataacaagaagataataatctgtgatgacaaattgaagaagatatttggaggtcgtgatcgtgttgggttcctcgaaatctctgggcttcttaacccccacttccagaaatgactggatttttgtagatcccactgttttgttttgtactagctgtggctgttgtatgggtatatttagctaaaccctggtttacatggtctcttaatgcttgtttaagaaaggcaaatgtgttccctgacgacacatggtc

SEQ ID NO: 14185 - protein, 146 aa, Panicum virgatum
  misc_feature: Ceres CLONE 1774162
  misc_feature (68)..(145): Pfam Name: SWIB Pfam Description: SWIB/MDM2 domain
MSAAIRSGELLACPVALRRAPLAVSVRVRVRGAPAARAVVRAEATAEGVGKAKGAGAGAGKKRAASGITKPKPISPELREFVGGAAELPRTEAIKLVWAHIKGNNLQDPNNKKIIICDDKLKKIFGGRDRVGFLEISGLLNPHFQK

SEQ ID NO: 14186 - DNA, 609 bp, Panicum virgatum
  misc_feature: Ceres CLONE 1774167
  misc_feature: Encodes the peptide sequence at SEQ ID NO. 14187
atctaacttccggaagctgcatagggactcccctttcttcctgcttcgaacagtggcaagagagagaagcggagagagtgcggcggaggcgatggcgagcggagggaaggggctgaacgcgaccggggagttcttccggcagagggacgagtggaggaggcacccgatggtggggaaccagctgcgccacgccttaccggggctcggcaccgccatcgtcgcctttgggatctacctcgtgggcgaggccgcctacaaccgcctcgcccgcccctccggcgaccaccaccactaggtggccggccgggatccgtgactccaaggtaaagtagctggagcaaactttaccaagttcattggtgttgtttttcttttaccagtttgagctcatgagatcagccatgaccatcatctagtttgtaaccatggagtcgaccactcttgaaacgctgtgctttatggcatttgggaatggcattgttcttgtaatactcaactcaagcaaatctgttgcacgcatgtttgatttctgaagtgttgatctgaactcatacagagctgctatatgtgaaattggcggtttcaatctgaaacttatcttggctgagc

SEQ ID NO: 14187 - protein, 67 aa, Panicum virgatum
  misc_feature: Ceres CLONE 1774167
  misc_feature: Useful for making plants with modulated flowering time
  misc_feature: Useful for making plants with modulated time to senescence
MASGGKGLNATGEFFRQRDEWRRHPMVGNQLRHALPGLGTAIVAFGIYLVGEAAYNRLARPSGDHHH

SEQ ID NO: 14188 - DNA, 902 bp, Panicum virgatum
  misc_feature: Ceres CLONE 1774179
  misc_feature: Encodes the peptide sequence at SEQ ID NO. 14189
atcgctagttcttccgagagctacttaagcagagccatgggacgctacctgctgtgaggtgcagtcccacggtcacacacatctgaatatctgatctgcaggaggattaaccggtggtgatgttgggttggcgaccattgccggcaacagcagtgactgctgtcctgcttgtgtgggtattcagctgtaaccatggggaagcaaggattgattttgctaacatgactgcactccaaaagcatgccgaattttttgaccgggataaagatggcatcattacaccttcagagatgtttgaaggatatgttgcaattggatgtgatgtggaatatgccagggctacagctgcatccgtcagtgccggtgttggtgctattacaagccctgttgatgcaccactgcctcacttatcaatatacgtagagtttatccataaagcaatgcatggaagtgatacaggcgcatatgatgctaaaggaaggtttgtcccagaaaagtttgaagaaattttcacgaagcatgcaaaggttggaccagatgcgttaacatccatggagatcgaggagatgattctagcaaaccgagatccagtagaccctcaatcatgggctgcgcctgaaaaagaatggggactaatatacaagctagcaagtgataatgaaggatttcttcacaaggatagtgcgagaggtatatatgatggcagtgtgttctacaagttggaggaacagaggacatcttcacgaagtgatatgtgattgagttcagcattcagatgcaatataatatatacgaaagcaattgtgaaagtccaataacttgcttgtacctatagtgtattattacagtcattagattgtattgaaagaatcaatattgttcattctgcaacattagttatt

SEQ ID NO: 14189 - protein, 212 aa, Panicum virgatum
  misc_feature: Ceres CLONE 1774179
  misc_feature (30)..(203): Pfam Name: Caleosin Pfam Description: Caleosin related protein
MLGWRPLPATAVTAVLLVWVFSCNHGEARIDFANMTALQKHAEFFDRDKDGIITPSEMFEGYVAIGCDVEYARATAASVSAGVGAITSPVDAPLPHLSIYVEFIHKAMHGSDTGAYDAKGRFVPEKFEEIFTKHAKVGPDALTSMEIEEMILANRDPVDPQSWAAPEKEWGLIYKLASDNEGFLHKDSARGIYDGSVFYKLEEQRTSSRSDM

SEQ ID NO: 14190 - DNA, 760 bp, Panicum virgatum
  misc_feature: Ceres CLONE 1774183
  misc_feature: Encodes the peptide sequence at SEQ ID NO. 14191
accaacacgagagacatgagcaccggcggcgcggacaagcccagcggcggcggcgcggtgaagacgccgtccgacttcctcaagtccatccgtggccgccccgtcgtcgtcaagctcaactccggcgtagactacagaggtattctcgcttgccttgatggttatatgaacatcgcgatggagcagaccgaggagtacgtaaatggtcagctgaagaacaagtatggtgacgccttcataagaggcaacaatgttttatacatcagcacgtcgaagcggacactcaccgatggcgcgtagggctgagtggagccctcccttttctgtcgtgtaactctcaagccattaacttggttgcactctgactcgatgcttcctttcaatctctgtacttgctgtctggaggaagtctgggaaagggaagatgtatcagatgctattcttgatgtaactggcattttgctttcccgtatcagcttttaggatatggataagatttgtgtttgctggtcgttgctttgcgccagtgttgtttaggcgttaatggtttggatcaactcttgactctgtgatatgtggtgagtttcaaactcctgtggttgatcctctctaccgggcggtctcgccgttcagtggccgttaagcagtaccggcagcagcacccgtggcgctgtgtggctggctagcacttgttaaacaattatggaaaaaatccttccgacctccctcaactattgtcattatttgatttagctccttc

SEQ ID NO: 14191 - protein, 94 aa, Panicum virgatum
  misc_feature: Ceres CLONE 1774183
  misc_feature (20)..(85): Pfam Name: LSM Pfam Description: LSM domain
MSTGGADKPSGGGAVKTPSDFLKSIRGRPVVVKLNSGVDYRGILACLDGYMNIAMEQTEEYVNGQLKNKYGDAFIRGNNVLYISTSKRTLTDGA

SEQ ID NO: 14192 - DNA, 659 bp, Panicum virgatum
  misc_feature: Ceres CLONE 1774194
  misc_feature: Encodes the peptide sequence at SEQ ID NO. 14193
cttgtttggggttgagaccctctccggagtccttgctggtgctctcgtctctggtgttcagattgccatctctgcatccaacactggtggtgcctgggacaatgccaagaagtacattgaggctggagcttcagagcacgccagaactcttggtccgaaaggctctgaccctcacaaggcggccgtcattggtgacaccattggagatcccctcaaggacacctctggcccctccctcaacatcctcatcaagctcatggctgtggagtccctcgttttcgcccccttcttcgccactcatggtggcatcctcttcaggtggctctaaactggctggagctgcgcgatgaacgccatagtttttgcagcggggagggcagcatgtcagctaatacagcatcaatggcatacgctttgctcgtgttgatgaaccccgtgtgtacgtggtttccttctctctttttttcccgcgtggtgtctttctagttccaggttccgaccatgttttgatcccataaatttgcctctagccttcgagtaactgagtacatcgtcataaagtcatcagcccctccgggacattgaaacatcggaaaacttcgagattcgaagagatgtatcgatgatgttgattaatctcaatcaatttttttcttgac

SEQ ID NO: 14193 - protein, 108 aa, Panicum virgatum
  misc_feature: Ceres CLONE 1774194
  misc_feature: SWISSPROT Homolog: EC 3.6.1.1 Inorganic diphosphatase
  misc_feature: Useful for making plants with modulated water use efficiency
LFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGILFRWL

SEQ ID NO: 14194 - DNA, 787 bp, Panicum virgatum
  misc_feature: Ceres CLONE 1774282
  misc_feature: Encodes the peptide sequence at SEQ ID NO. 14195
attcaagcctacgtccttgcatcttcatcaagctactataatactcatatctgagatgaatcccttgctttgccttatgaatcttcacgtcctgttcttctttgtctttaccattccatcatttgttaacagcaagcaccaatttgtctactccggcttcactggtgctaacctcaccctcgatggtatggcctctatcacaccaaatggtctacttcaactgaccaatggcaccctccggctcaaaggccatgcgttccacccaactccattccacttccgcaagaagcccaatgggacagtgcaatcgttttctgtcacatacgtctttgccatctactgcatccaatgtgccatctgtggtcatggcattgcgttcctcattgctgcaagaaacaacttctcggatgcattgcaggcataaaggatcactcaccggcgcagtggatcctaagctgatgaggcatgcctgctactaaagttaggattgctgtgttcacacccgtttatcaatgcaaggccaaacatgaggcaagtcatgcactatctcagtggcaacatgccactaccagtgcagaacaaacttccactccggcgaccctgacagactcattatttggggcaagtacatattacctgacatcttaggagctaggttaaatgcatgtatttctaattttataaatgttacttctttattatatatgaacagacatttgtactgagtcggtggtgaacattatctgactgtaaatataagcaaattataatcagagattcttgttgt

SEQ ID NO: 14195 - protein, 122 aa, Panicum virgatum
  misc_feature: Ceres CLONE 1774282
  misc_feature (26)..(122): Pfam Name: Lectin_legB Pfam Description: Legume lectin domain
MNPLLCLMNLHVLFFFVFTIPSFVNSKHQFVYSGFTGANLTLDGMASITPNGLLQLTNGTLRLKGHAFHPTPFHFRKKPNGTVQSFSVTYVFAIYCIQCAICGHGIAFLIAARNNFSDALQA

SEQ ID NO: 14196 - DNA, 905 bp, Panicum virgatum
  misc_feature: Ceres CLONE 1774322
  misc_feature: Encodes the peptide sequence at SEQ ID NO. 14197
atcaaactaccgcgggggccaacgaactttgcttctccttcccgcatgttctctcgtcttcctcctccactcgtcgtccaccaacttgacccctcctcctgcagctccggatctggaaggccgggggaagtcgcacgctggcggaagggaaacggcgcaattgagccgaagcagaggagtacagggccgttgaggcgcaggcctctgtgagagttcgggacagaggcatcgcgtagctgccgttggggaaagctcaatcaatcaatacatggattggctgcctggagagctgtgcctcaaaatcttccagctcctggatcaccagtccctcgcctccgctccccaagtttgcaggaaatggagggcgttgacctcggacgatgagctgtggcgcaagctgttcagcgacaggtggggcacggacgccgcggcgttctacgcgccggagggctccaagtcctggaaggacgtcttcgtcgtgcaggaccggtgcgatcgctacggactgggtgtcaggatcatcagggaagggaaggactactacctgatctaccagggcgagatccagcggtacctgggctcgcgccaggacacggatggtgatggcggcaaggacgcgccgcggcaggacgctgacgacgacgagcagcggcagatagcgaaccggatcctgttcttcctgggggatctggaggcggcctgtgcggacgccaaacgtgtcaaggcgtgaacgcatttatcctgtgcggctctccagagcacattgccgccgccagtgtatgttgcataattgcatagctcgtgcatagttttgttctgtactacatgcatagtgcttcaccctcagtttatttgtacaaaatcatgtactcatgtgattcaccctgtgtaaagtcgagttgatc

SEQ ID NO: 14197 - protein, 153 aa, Panicum virgatum
  misc_feature: Ceres CLONE 1774322
  misc_feature (1)..(46): Pfam Name: F-box Pfam Description: F-box domain
MDWLPGELCLKIFQLLDHQSLASAPQVCRKWRALTSDDELWRKLFSDRWGTDAAAFYAPEGSKSWKDVFVVQDRCDRYGLGVRIIREGKDYYLIYQGEIQRYLGSRQDTDGDGGKDAPRQDADDDEQRQIANRILFFLGDLEAACADAKRVKA

SEQ ID NO: 14198 - DNA, 885 bp, Panicum virgatum
  misc_feature: Ceres CLONE 1774325
  misc_feature: Encodes the peptide sequence at SEQ ID NO. 14199
ctcgctctgaccagcgcggcgagggcggcgaggcgcttccccgtcccatccttataaatcgagccggaggcgggctgcctccctcccaggccgcagcagcacgcagccgacgaggggcccgagccgtgccggcgaagtggaaggggagggggcgattggctcgatggcgaagctgtacgtgcaggcggtgccacccccggatctgaacaggaacacggagtggttcatgtaccccggggtctggaccacctacatcctcatcctcttcttctcctggatcctcgtcctctccgtcttcgggtgcgcccccggcacggcgtggacgctcgtcaacctcggccacttcgcgatcacataccactttttccactggaagaaggggacaccgtttgctgacgatcaagggatgtataacacattgacatggtgggaacaaatggacaatggcaaacagcttactcgcaacagaaagtttttgactgctgtccctgttgttctgtacttgatagcttcccataccacggactatcaacatcctatgctcttcctcaacaccctagcagtcactgtgctggttgttgccaagctaccaaacatgcacaaggttcggatttttgggatcaatgccggcagctaaggagcagtgtcccatggtacacacctatacatgtcatgtttgatttggatgacgggatgttttagctctgaattgaatcgcgggagtaccagtgagtagtgcttgagagctgttcgtagatgacatgtaatcattgtacagagaaatgctaaggctggaacgattatgctttctgcaactagtgaacaaaggttctgtagaccgtaatcttgctatatacgttctctagcaagaatttggcaattgat

SEQ ID NO: 14199 - protein, 157 aa, Panicum virgatum
  misc_feature: Ceres CLONE 1774325
  misc_feature (14)..(156): Pfam Name: ORMDL Pfam Description: ORMDL family
MAKLYVQAVPPPDLNRNTEWFMYPGVWTTYILILFFSWILVLSVFGCAPGTAWTLVNLGHFAITYHFFHWKKGTPFADDQGMYNTLTWWEQMDNGKQLTRNRKFLTAVPVVLYLIASHTTDYQHPMLFLNTLAVTVLVVAKLPNMHKVRIFGINAGS

SEQ ID NO: 14200 - DNA, 716 bp, Panicum virgatum
  misc_feature: Ceres CLONE 1774327
  misc_feature: Encodes the peptide sequence at SEQ ID NO. 14201
aaaaacccccgcaatccactctgacggtcggacctcgtcatccatgcctcccctccccgccgcggccatggccaccgcgacgctgcctctccgcctcctcccctccaagactctgaccctctcctccatcccctctgcgcgccgctgcctctccgtcgccgccgtcccgcaccggcgctggcagctccgagccgccgacgaggaggcgcccgaggccgtggaggttgagttcgtggagcccgaggcggaggatgaggaggaggaacccgcggttccggagcccgtcgaggctcagctcgctgccgcgggggccgggaaggatgccgacatcttcgctgttgtcatgattggttcaaggcaatacattgtgatgccgggccgatatatatacacacagagattgaaaggtgccaatgtcaatgatcagatcatactaaacaaggtgctactagtgtcaactagagacaaagcatacattggaatgccagtggtgaccaatgctgctgtgcacgcagtggtcgaagaacaggggcgggatgataaagttatagtcttcaagtacaagaagaagaagaagtaccagaggaaacttggtcacagacagccaaacacaaggttaagaatcacaggcataagcggatatgaagagtaccctgctgacccaatacttgaccctgctgcagcttaagctaaattttattattgagttgcatgca

SEQ ID NO: 14201 - protein, 206 aa, Panicum virgatum; identical to SEQ ID NO: 14071
  misc_feature: Ceres CLONE 1774327
  misc_feature (88)..(184): Pfam Name: Ribosomal_L21p Pfam Description: Ribosomal prokaryotic L21 protein

SEQ ID NO: 14202 - DNA, 708 bp, Panicum virgatum
  misc_feature: Ceres CLONE 1774338
  misc_feature: Encodes the peptide sequence at SEQ ID NO. 14203
gagaggcaccgccaagaagataaggctgcacccaccccgtcccctcatctcattccgctttgagcttgcttgcagctccagctcccctcgtctcttggtggctacgccatggccaccgtagtcctgatgaactgcagcctccgcgcgccggccagcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggatcaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatataaatataattaaaccctacgtcgtgcgtgctatagctatagctatagctatactatacttaattggtttgcaattcagctatatgc

SEQ ID NO: 14203 - protein, 149 aa, Panicum virgatum
  misc_feature: Ceres CLONE 1774338
  misc_feature (58)..(133): Pfam Name: Fer2 Pfam Description: 2Fe-2S iron-sulfur cluster binding domain
MATVVLMNCSLRAPASSGLSGVRAAPAPAIVAMPAAKQQVVGRGARLRAQATYNVKLITPDGEVELQVPDDVYILDQAEEEGIDLPYSCRAGSCSSCAGKVVSGSVDQSDQSFLEDDQVAGGWVLTCAAYPTSDVVIETHKEEELTSSS

SEQ ID NO: 14204 - DNA, 778 bp, Panicum virgatum
  misc_feature: Ceres CLONE 1774349
  misc_feature: Encodes the peptide sequence at SEQ ID NO. 14205
gggcacgccttctatccttgcgccgccgccgccgccgccatctacgcccgagccgcttccccgtcagtctcttcgagcatcaaccatggccgagcagactgagaaggctttcctcaagcagcctaaggtgttcctctgcccgaagaaggccaccaaggggaacaagcctggcaagggcggcaacaggttctggaagaacattggccttggtttcaagactcccagagaagccattgaaggaacctacattgataagaaatgcccgttcaccggcactgtgtcaattagaggtcgcatcattgcgggaacatgccatagtgctaaaatgaacaggactatcattgttcgtaggaactaccttcacttcgtcaagaaataccagaggtatgagaagaggcactctaacatccctgcccacatttccccctgcttccgtgtgaaggaaggagaccacgtgatcattggccagtgcagaccactgtccaagaccgtgaggttcaatgtgctgaaggtgatccctgctgggtccaagagtggtgcagtaaagaaggcattcactgctgcctgagattctgaaaaccacagatcatcagattttgatgtcccattctgtattgctatttgatctgtactaggatttttgactgaaaatatcgtgagaaattaaagtcaaagagcggctgaattcagcaatattgtcaagacaaaaaaaggttctgtaatactatgttgtgaatgctttgtttcagttagaagatcattttttgttgctggttgc

SEQ ID NO: 14205 - protein, 160 aa, Panicum virgatum
  misc_feature: Ceres CLONE 1774349
  misc_feature (74)..(143): Pfam Name: Ribosomal_S17 Pfam Description: Ribosomal protein S17
MAEQTEKAFLKQPKVFLCPKKATKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 14206 - DNA, 985 bp, Panicum virgatum
  misc_feature: Ceres CLONE 1774354
  misc_feature: Encodes the peptide sequence at SEQ ID NO. 14207
atggattccttggctccccacccctaagccagctccctagaccgtgagaagaactcggtcgcacaacattcgagccgagagagaggttgaccacatcgcccgtcgcgatggcgttagcctgcacagccaggctaatccaccgtggcatggtgtccaacaatccaagaacgccaccaccaccgcacttgcacctccacacccattggcccaaggccatcacgatggcatcgtcgtcccatcacttcgcgctccactccgtcgacgtctctaaggacgacaagccgctggagacgccgccgccgccgccgactgcagagggcgctcagcaagacgcggcggcgccgttgcagccggaggacgacggctcgaagcttgacccgcggcggtttgaggagaagttcgcggtgctcaacacggggatccacgagtgccggtcgtgcgggtaccgatacgaccaggcggcgggggacccgtcgtacctggtgccgccgggcctgccgttcgcgcagctgcccgacgactggcggtgccccacgtgcggcgccgcacagtccttcttcgagagcaagagcgtcgagatcgccgggttcgcgcagaaccagcagttcgggctcggcggcaactccctcacctcgggacagaaggggctgcttatctacggcagcctcctcctcggcttcctcttcttcatctccggctacttcttgaaatgagaaccaagatacaggctgctgctgctccttggtagtagcttgcaacgatggtcgtcgattgattctaggcgtgtgagcttgcatgtttaattgctaagtcgatctggatatataagcatctatcagagagatggttaattttgccgtgaatgcagttgggataaatctctatgataaatgttatagattttgcgagaccaattcaaatgttatagattttgcaagaccaattcattttcttttaccacggaaattatagtttgcgaggttgc

SEQ ID NO: 14207 - protein, 201 aa, Panicum virgatum
  misc_feature: Ceres CLONE 1774354
  misc_feature (105)..(151): Pfam Name: Rubredoxin Pfam Description: Rubredoxin
MALACTARLIHRGMVSNNPRTPPPPHLHLHTHWPKAITMASSSHHFALHSVDVSKDDKPLETPPPPPTAEGAQQDAAAPLQPEDDGSKLDPRRFEEKFAVLNTGIHECRSCGYRYDQAAGDPSYLVPPGLPFAQLPDDWRCPTCGAAQSFFESKSVEIAGFAQNQQFGLGGNSLTSGQKGLLIYGSLLLGFLFFISGYFLK

SEQ ID NO: 14208 - DNA, 712 bp, Panicum virgatum
  misc_feature: Ceres CLONE 1774363
  misc_feature: Encodes the peptide sequence at SEQ ID NO. 14209
actctccctcactctactctttccatccagcgcgagaggcaggtcggcagcagagcgagagcgcgtgccagcccatggcgagcaccaacatggcgtcggccacctcgcggttcatgctggccgcgggcgtgcccgcggcgggcagcggccgcgtcggcttcgcgtcggtgcccggcaggccgcagggcaggaggctcgtggtgcgcgccgaggaggaggccgccgcggcggccgagccggcgccggaaggggagggcgccgtggccaccaagcctaaggccgagaagccgccgccgatcgggcccaagaggggcgccaaggtcaagatcctgaggagggagtcctactggtacaacgggattggcaacgtcgtcacagttgatcaggaccccaacacccgctacccggtggtggtgcggttcaacaaggtgaactacgccggcgtatccaccaacaactacgccttggacgagatccaggaggtgaaatgagcagcgaggctggctggctggctgtgaaatgagggtcacaacatctagtgtgtaatagcttaatctctgtaatcattatgtaattgcttgcttgcttcaccgtggacacaataatctcctgctcttaagttgttgtattcttttcttgtgattttgtacatgcacataaacctcttttcctgccaccgtttgtgcgcgatgctggaaacttgatcgatact

SEQ ID NO: 14209 - protein, 138 aa, Panicum virgatum
  misc_feature: Ceres CLONE 1774363
  misc_feature (77)..(138): Pfam Name: PSI_PsaE Pfam Description: Photosystem I reaction centre subunit IV / PsaE
MASTNMASATSRFMLAAGVPAAGSGRVGFASVPGRPQGRRLVVRAEEEAAAAAEPAPEGEGAVATKPKAEKPPPIGPKRGAKVKILRRESYWYNGIGNVVTVDQDPNTRYPVVVRFNKVNYAGVSTNNYALDEIQEVK

SEQ ID NO: 14210 - DNA, 746 bp, Panicum virgatum
  misc_feature: Ceres CLONE 1774368
  misc_feature: Encodes the peptide sequence at SEQ ID NO. 14211
acctcacacagcaatcgaatccaagcatccccagttccccaaaccccaagcacctccgcagccgcagcaccaccgatggcgccgaaggcggagaagaagccggcggcgaagaagcccgcggaggaggagcccgcggcggagaaggccccggctgggaagaagcccaaggcggagaagcgcctccccgcgggcaagtccagcgccggcaaggacggcgagggcaagaagggcaagaagaaggccaagaagagcgtcgagacctacaagatctacatcttcaaggtgctcaagcaggtgcacccggacatcggcatctcctccaaggccatgtccatcatgaactccttcatcaacgacatcttcgagaagctcgccgccgaggccgccaagctcgcccgctacaacaagaagcccaccatcacctcccgcgagatccagacctccgtccgcctcgtcctccccggggagctcgccaagcacgccgtctccgagggcaccaaggccgtcaccaagttcacctcgtcttagttaggtttgccgcctcttgtggtgccagtactagttcggttgggtgctgctgctagacctggctccctcggtttaatttatctggtagaagtagtactatcatcagcagtgtcgaatggaaatggatggttagtgtgtagttgtatgaattgtgtacctaatggatctggaacatcaatggtgcctgttctgttctattaacttttgttcatctgttc

SEQ ID NO: 14211 - protein, 150 aa, Panicum virgatum
  misc_feature: Ceres CLONE 1774368
  misc_feature (57)..(127): Pfam Name: Histone Pfam Description: Core histone H2A/H2B/H3/H4
  misc_feature: Useful for biocontainment applications
  misc_feature: Useful for making plants with modulated flowering time
MAPKAEKKPAAKKPAEEEPAAEKAPAGKKPKAEKRLPAGKSSAGKDGEGKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 14212 - DNA, 1069 bp, Panicum virgatum
  misc_feature: Ceres CLONE 1774392
  misc_feature: Encodes the peptide sequence at SEQ ID NO. 14213
gccgccaccacttgcctcttcctccccgacgccgccgctccgctcgctagaaggtcgcagcagccgctgccgccggcaaaatggccccgaagagaggaggcaaggcgccggttcccgccaagaagaagacggtggtgacgaacccgctgttcgagaagaggccgaagcagttcgggatcggcggcgcgctgccgcccaagaaggacctccaccgcttcgtcaagtggcccaaggttgtgcgcatccagcgccagcgccgcatcctcaagcagcgcctcaaggtgcccccggcgctcaaccagttcacccgtaccctcgacaagaaccttgcaacaaacttgttcaagatgcttctgaagtaccgccctgaggacaaagctgccaagaaggagaggcttttgaagagagcccaggctgaaaatgaagggaaaactgttgaggcaaagaaaccaattgttgtgaagtatggcctcaaccatgtgacatacctcatcgagcagagcaaggcccagctggttgtcatagctcatgatgttgatccgattgagctggttgtgtggctcccggccctttgcaggaaaatggaggttccatactgcattgtcaagggaaaagcacgccttggatcgatcgttcacaagaagaccgcatctgttctttgcctgaccactgtcaagaatgaggacaaacttgagttcagcaagatcctggaggctattaaggccaacttcaacgacaagtttgatgaggtcaggaagaagtggggtggtggtatcataggctccaaatcgcaggcgaaaaccaaggccagggaaaagctgctcgctaaggaggctgctcagcggatgacctaagtcttgccctgttaaatttatcctgtacttcttggatcgtgtacaatcatattgtcgttgtctgatctagtttttttgctcgtgagaccatgctagaaagaaaccttgtaagaattgaaagtttttgttcggtgcgggttagtttgtatgactcgactgctatattggtggtgaatcactccctccacttattctgtgcaattactagtttactg

SEQ ID NO: 14213 - protein, 257 aa, Panicum virgatum
  misc_feature: Ceres CLONE 1774392
  misc_feature (112)..(207): Pfam Name: Ribosomal_L7Ae Pfam Description: Ribosomal protein L7Ae/L30e/S12e/Gadd45 family
MAPKRGGKAPVPAKKKTVVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVEAKKPIVVKYGLNHVTYLIEQSKAQLVVIAHDVDPIELVVWLPALCRKMEVPYCIVKGKARLGSIVHKKTASVLCLTTVKNEDKLEFSKILEAIKANFNDKFDEVRKKWGGGIIGSKSQAKTKAREKLLAKEAAQRMT

SEQ ID NO: 14214 - DNA, 673 bp, Panicum virgatum
  misc_feature: Ceres CLONE 1774447
  misc_feature: Encodes the peptide sequence at SEQ ID NO. 14215
acccccaatctctgcgccgccgccgttcccgtcctcctccgccagtccgcgctcctccgccgtcgcggtcgcggtcgcgccctcgccgtcgcctgccgaccgcgagcttcctcgccactaccggtccaccgggggcggcgccatgtcccagtcccagaacaacaacccctcccagctcctcccctcagagctgatcgaccggtgcatcgggtccaagatctgggtgatcatgaagggggacaaggagctcgtcggcaccctctgcggcttcgatgtctacgtcaacatggtgctggaggacgtcaccgagtatgaatacacagctgaagggcgtcgcattacaaaacttgaccagatactgctgaacggcaacaacatagccatcttggttcctggtggttcaccacccgatgtgtaacgagcttgtgcttccagagtaacgatttgaggcgaaggcagcttggtgaactctgcaccttgtgttggtcagaagcatcggatgttttctcagctcaaatgtgtttctcctgttcgtgattgtaccgaagtttattagcaagtctgtcaacatggaagctctctcctgtaatgaacttactgatctcagtagaggacttgcgcatgcttatacgattggctatgctaattccgatgctcatcatcgtcgtgctgc

SEQ ID NO: 14215 - protein, 91 aa, Panicum virgatum
  misc_feature: Ceres CLONE 1774447
  misc_feature (16)..(84): Pfam Name: LSM Pfam Description: LSM domain
  misc_feature: Useful for making plants with modulated cold sensitivity
  misc_feature: Useful for making plants with modulated drought sensitivity
MSQSQNNNPSQLLPSELIDRCIGSKIWVIMKGDKELVGTLCGFDVYVNMVLEDVTEYEYTAEGRRITKLDQILLNGNNIAILVPGGSPPDV

SEQ ID NO: 14216 - DNA, 595 bp, Panicum virgatum
  misc_feature: Ceres CLONE 1774453
  misc_feature: Encodes the peptide sequence at SEQ ID NO. 14217
atcgcatctcctattctcctctcgctctctgttgtgtgactgattgccaagaaagctctctgcttgcttgtgttccagcctctgaatctcgcgaggatgtcgtgctgcggaggcaactgcgggtgcggctccggctgcaagtgcggctccggctgcggagggtgcaagatgtacccggacatgactgagcagggcaccaccagcagcagccagactgtcatcatgggcgttgcaccaaccaacaaggggcacgccgagggcggaccggaagagatctgaagctagtatagcggcgttgtgtgtgcgtcgttcgtttgtctgaaagtgtgtgtggcatgcttaataacggtgttgcgcgtgctgctagtagatggtactgatggggaacaataataatgatggtgctgagatgtcgtcggcgtcgccgccgccgtcgtgtccttcctccccggccggtcgggcacctgtggcggtgctctagcagtgtgttgtgtgtgcagcagaccatgctctgatctttgtggtgtatgtgtgtggcctgctgcttggtgtccctagtgtcatgtgtaaccatccatctatatcgatctacatc

SEQ ID NO: 14217 - protein, 60 aa, Panicum virgatum
  misc_feature: Ceres CLONE 1774453
  misc_feature (1)..(60): Pfam Name: Metallothio_2 Pfam Description: Metallothionein
MSCCGGNCGCGSGCKCGSGCGGCKMYPDMTEQGTTSSSQTVIMGVAPTNKGHAEGGPEEI

SEQ ID NO: 14218 - DNA, 592 bp, Panicum virgatum
  misc_feature: Ceres CLONE 1774460
  misc_feature: Encodes the peptide sequence at SEQ ID NO. 14219
atagctagcttggcaacacattctggtacgcctcgacggcgcgcaggcatagaagtgaacgcctctcttaggtagctgcgcggcttgtgcatgatcgaggaggtgccgagcgagcgagcgcgtcgatggctatccggacgcatgccggtggcgacgcgctcgctggacgcggacatgacggtggacgagttcaaggagtggctgcggcggttcgacacgcgacgcgacgggagcatcagccgcgaggagctgcggcgcgccttgcgcgccatccgcggccggttcacggggtggcggatcagggagggcatccgctacgccgacgccgacggcgacggctgcatcgacgacagcgaggcggacggcctcatcgagttcgcgcacaacaacctcgggctcatgatcgtcacctactgatgatctagctggtccactcgggggcggacccgggcggctgctagctatagttcgagccatcacgatggggtatccacgaccacgccatctggcgcctgcccccccggtccgctaataataagaacatctgcttgaccgaccgtttgcttgcttccttaaagctttgctttcttgt

SEQ ID NO: 14219 - protein, 91 aa, Panicum virgatum
  misc_feature: Ceres CLONE 1774460
  misc_feature (16)..(44): Pfam Name: efhand Pfam Description: EF hand
MPVATRSLDADMTVDEFKEWLRRFDTRRDGSISREELRRALRAIRGRFTGWRIREGIRYADADGDGCIDDSEADGLIEFAHNNLGLMIVTY

SEQ ID NO: 14220 - DNA, 935 bp, Panicum virgatum
  misc_feature: Ceres CLONE 1774512
  misc_feature: Encodes the peptide sequence at SEQ ID NO. 14221
agcgtgtcaactgaccgcgccatggccttctccgctttctcatggccgtttcgccgccgggggagcggcagcggggctggcggcagtgtaaacaagtcggccgaggagaacgaggagcttggcgtgaccccgcagctcctggacttcctccggacgctctcccccgacgccttcaaggccgccgccctccagctccaagggggctctgcggaggcggccgccggcgacctcacaagctgggaggagcggcatgccgtgcgcgtgctatccaaagccaaggaactcgccaagattcggtacgatctgtgccctcgtcacatgaaggataagcagttctggaagatatacttcctgctttccaagagttatatctcaccgtacgagctacgtgccatacagaaagaaaagctaagaaggatggagatggaaaatggcaagtccaaagaagtgattactgttgaggtggagatgcaagaatcaaaaggcagtagagtctcccaaccatcagaaattgatttagaatctcaatcttagcttcacattatagcttctaacaggatttagcctaggtaatgagagtagtcctattattccttcacagatcaatagctcatatgtccagttgcaacaactggtgtgcagtgcgccatacaagttccacaagctcgtcagatgatgcatgctctgctactctcgctgtattggaagtctgctgtgtgctttttttgtacactgaaaccaagtagttctttttggcatcatgtagcatatgctcgttggctgtgctctgagccactgacgtaacctcatggtatcttttttttttttgcgagtaaccacatggtatcttgaatgtaattttgatgcgagaacataaatattgtacctcccatattaacttgcttgtcccacttctttggtgaattttatctgcc

SEQ ID NO: 14221 - protein, 170 aa, Panicum virgatum
  misc_feature: Ceres CLONE 1774512
  misc_feature (61)..(123): Pfam Name: BSD Pfam Description: BSD domain
MAFSAFSWPFRRRGSGSGAGGSVNKSAEENEELGVTPQLLDFLRTLSPDAFKAAALQLQGGSAEAAAGDLTSWEERHAVRVLSKAKELAKIRYDLCPRHMKDKQFWKIYFLLSKSYISPYELRAIQKEKLRRMEMENGKSKEVITVEVEMQESKGSRVSQPSEIDLESQS

SEQ ID NO: 14222 - DNA, 603 bp, Panicum virgatum
  misc_feature: Ceres CLONE 1774518
  misc_feature: Encodes the peptide sequence at SEQ ID NO. 14223
ctcctccgccgtcgcctctccactttccccatcctgcgccgacgtcgcggtcgcctcgcagtccgaagagcccccgactccgatggccagccgctgggtccgacccgaggtgtacccgctgttcgcggcgatgggcgtggccgtcggcatctgcggatttcagctcttccggaacatcaccggcaacccggaagtcagggtaaacaaggcagggagggcagctggtgtgcttgagaatcatgaggaggggaggcgttacgcaatgcacagcctcagaagctttgtgcatgacaagacccctgaaataatgccatccatcaacaagttcttcactgagccgaagtgaagcgatttgctcgggtgctgctgctggagtcactattgtctagttcctattaaggcattcaatgtcatgtcatccataaattggaggacagcagatacctcttattaaaagtaccttatgagtgattggtgatggcttggtatgtgtatggtttatgagtgttgcatcacccctgtttgatgttcatgctcatctgtcatgtggatttgctgtgcctcagtgataaattgtcagccaacgctcatttggttactgct

SEQ ID NO: 14223 - protein, 87 aa, Panicum virgatum; identical to SEQ ID NO: 13010
  misc_feature: Ceres CLONE 1774518
  misc_feature (2)..(87): Pfam Name: B12D Pfam Description: B12D protein

SEQ ID NO: 14224 - DNA, 652 bp, Panicum virgatum
  misc_feature: Ceres CLONE 1774548
  misc_feature: Encodes the peptide sequence at SEQ ID NO. 14225
acacgcgcgctctcccgcggcgacagagcagcacgacgcgcgaggccgccaccgccatggacatgggcggagggcacgacatgggcggcatgatggccccgccgccgtccccgccgggcggcggcggcatggggatgcagtacacccacatgaccttcttctggggcaagaactcggagatcctcttcacggggtggcccggcgccgacggcggcatgtacgcgctggcgctcgtggccgtcttcgtgctcgcgttcgtcctcgagttcctgggctcccgcaggctggacgcgctcctccgcccgcgcgcggcgcgcgcggcggtgcacgcgctgcgcgtgggcgcggcgtacctgctcatgctcgcgatcatgtcgttcaacggcggcgtgctcctcgtcgccgtcgcggggcacgcggcggggttcctggcgttcaaggccggcctgttcggcgacgggcgggcgcaggtggaggacgggcgcggcaaggaggagctcgagccggcggcgtgctgacgacaggcggcgtgctgcgacgatggcgtttgcttgtctggcgttgtttatgcgttttcgattcgtttgtgccgtgtcgctgcccaaccctgggcataaaataccgaataacgagtaccgaaccgaatttattg

SEQ ID NO: 14225 - protein, 153 aa, Panicum virgatum
  misc_feature: Ceres CLONE 1774548
  misc_feature (30)..(131): Pfam Name: Ctr Pfam Description: Ctr copper transporter family
MDMGGGHDMGGMMAPPPSPPGGGGMGMQYTHMTFFWGKNSEILFTGWPGADGGMYALALVAVFVLAFVLEFLGSRRLDALLRPRAARAAVHALRVGAAYLLMLAIMSFNGGVLLVAVAGHAAGFLAFKAGLFGDGRAQVEDGRGKEELEPAAC

SEQ ID NO: 14226 - DNA, 489 bp, Panicum virgatum
  misc_feature: Ceres CLONE 1774633
  misc_feature: Encodes the peptide sequence at SEQ ID NO. 14227
aagtgcccccacccccccccccccccgggtggagggcggcgcacaaccgcgtcccggtctcggcgtttcctcgcggcttccggagttccaacttccaacacgcctcgatccagatccgggcattcccttccggtctcccccgagactattcatattccattcgcccgcaacggaagaggcgcctgccgccgccgcctcgtcctcgactccctcctcgtcctcgctcgtccgccgcttggagtgcgctcctccgttcccagaagcgcagcatggcaaagctcaagccaaaggcgttgctggcacaaagcaaagtgaagaaggcccctagccaaatcagtgtgatcacaatcttcacctacttggtcctcggtgtcatagttgtatcctctgtttatgctgcttacagcagccggcgtcgaggggaattaaacctcaaactatgtaactgattttgttgttgtatcatccagttggataattttggttgct

SEQ ID NO: 14227 - protein, 59 aa, Panicum virgatum
  misc_feature: Ceres CLONE 1774633
  misc_feature: SWISSPROT Homolog: EC 5.2.1.8 Peptidylprolyl isomerase
MAKLKPKALLAQSKVKKAPSQISVITIFTYLVLGVIVVSSVYAAYSSRRRGELNLKLCN

SEQ ID NO: 14228 - DNA, 740 bp, Panicum virgatum
  misc_feature: Ceres CLONE 1774719
  misc_feature: Encodes the peptide sequence at SEQ ID NO. 14229
atcacagcacaacagcagcagaagcgagtcactgcacggactcacatcttcaacaaacagagcgatcgatacgtgttcactgcgctccggacatcgtttcccatggcgaccacggtgatggcctccgccgccaccggcgcgcgcgccgggcgcttccccgctaggctccctgcggccggcgggctcgcgccgcgccggcgcgcggcgctcgtcgtcagggcgcaggccgaggacgctgagaaaagcgcgagcccggggctctgggacgcgctggcgttcagcggcccggcgccggagcggatcaacgggcgcctcgccatggtgggcttcgtgtccgcgctcgccgtcgaggcggcccgcggggacggcctcctcgcgcaggccggcaacggcgcggggctcacgtggttcgcgtacaccgccgtcgtgctgtccgcggcgtcgctggcgccgctgctccagggggagagcgctgaggcccggagcggcggcttcatgaccgcagacgccgagctctggaacggccgcctcgccatgctcggcctcgtcgcgctagccgccaccgagtacctcaccggggcccccttcgtccacgtttagatacggcgtatatattgtacacatgtagctagtagtggagctagtgtatacgtatttgtgacttgtgtacggctagggtgcttgtaagctcggttaagtacggcagtctggaaacattatagaaagttttcttttgacac

SEQ ID NO: 14229 - protein, 165 aa, Panicum virgatum
  misc_feature: Ceres CLONE 1774719
  misc_feature (41)..(156): Pfam Name: Chloroa_b-bind Pfam Description: Chlorophyll A-B binding protein
  misc_feature: SWISSPROT Homolog: EC 4.99.1.1 Ferrochelatase
MATTVMASAATGARAGRFPARLPAAGGLAPRRRAALVVRAQAEDAEKSASPGLWDALAFSGPAPERINGRLAMVGFVSALAVEAARGDGLLAQAGNGAGLTWFAYTAVVLSAASLAPLLQGESAEARSGGFMTADAELWNGRLAMLGLVALAATEYLTGAPFVHV

SEQ ID NO: 14230 - DNA, 620 bp, Panicum virgatum
  misc_feature: Ceres CLONE 1774735
  misc_feature: Encodes the peptide sequence at SEQ ID NO. 14231
gattctgttcttgctctcttgtttcgtccttgactcgcgtttgcgaacgcggcagccagagggagcgcgaccgcgagcgcgcggcggcgcggaagcccaacgccaaggggtcccaggacgggctcaccccagagcagcgccgcgagagggacaagaaagcgctggaggagaaggcggccaagaaggcgcagcaggcggcggccggcgccgccggtacctccacggacaacaagaacaagggtggcggcaagaagtaggcgccaccaacacgcgcggcgcaacctctgtacgattatcgatgcttaccttcgcatcttcgtagatgcgatgtttgttgggtcataaactcgttgtctgcgatattttagctacctgatacatcatgagttggtgatgacaataataagtggtgatctggttttgtaggtcatgttttgttgcttttgtgttccgtgatctgtgtgactttgctgttgatgaatcttttgagtatcataactagcatgcagggcgcatgagctactgaactcttgccatctgtaaacaacagtctactagcatgcctgtaaacaacagtctactagcatgttgaaactggaaagtagattatgttgttgttt

SEQ ID NO: 14231 - protein, 84 aa, Panicum virgatum
  misc_feature: Ceres CLONE 1774735
  misc_feature (16)..(69): Pfam Name: 4F5 Pfam Description: 4F5 protein family
FCSCSLVSSLTRVCERGSQRERDRERAAARKPNAKGSQDGLTPEQRRERDKKALEEKAAKKAQQAAAGAAGTSTDNKNKGGGKK

SEQ ID NO: 14232 - DNA, 1054 bp, Panicum virgatum
  misc_feature: Ceres CLONE 1774745
  misc_feature: Encodes the peptide sequence at SEQ ID NO. 14233
aaacagagcccagctgccgacgagccccgagccgagcgccgcgcgcaagggagaggcagacggggccttcccgttggcgaccgaggagcggaggcggaggcagcggggggtcggagatgaacctgttccggctcgcgggggacatgacccacctcctcagcgtggtggtgctgctcctcaagatccacaccatcaagtcctgcgcaggcgtatctctgaagacgcaggagctgtacgcacttgtttttgcagctcggtacctggacttgtttgttcattttgtgtctctgtacaacacagtcatgaagctggtcttcttggcaagctctttctcaatagtttggtacatgaggaagcatatgattgtgcgaagaacctacgacaaggatcatgacacctttcgccattactttttagtgttgccttgtcttcttctagctctaatcatcaatgagaagtttactttcagagaggtgatgtgggcattctccatttatttggaagctgttgccatatttccacaacttgtactgctacaacggacaaggaatattgataacttgactggacaatatgtcttcttcttgggtgcataccgcgtgctttacatccttaactggatataccgctacttcactgagccccattttgttcactggataagctgggttgcaggaattgtgcaaactctgttgtatgctgacttcttctactattatataatgagttggaagaacaatgtgaagctagagcttccagcttaagcttgttgttcgcttgcaaggtagactagggtaatacatggtaatacaatggataggaagactcggcacgcagcatgagcatcaatatcaccttcggggttatgacatgcatattggttctctggcttataccctttgcatctttctcctattattgggaggagaggcaggtcgggttcaccttgaaccttacaataagctgtgtaagctcagcaccaggaagataggagttacgagtgctttggggagtttcgtgctgctgtgacccattcggcaagtgattctcattc

SEQ ID NO: 14233 - protein, 215 aa, Panicum virgatum
  misc_feature: Ceres CLONE 1774745
  misc_feature (1)..(205): Pfam Name: ER_lumen_recept Pfam Description: ER lumen protein retaining receptor
MNLFRLAGDMTHLLSVVVLLLKIHTIKSCAGVSLKTQELYALVFAARYLDLFVHFVSLYNTVMKLVFLASSFSIVWYMRKHMIVRRTYDKDHDTFRHYFLVLPCLLLALIINEKFTFREVMWAFSIYLEAVAIFPQLVLLQRTRNIDNLTGQYVFFLGAYRVLYILNWIYRYFTEPHFVHWISWVAGIVQTLLYADFFYYYIMSWKNNVKLELPA

SEQ ID NO: 14234 - DNA, 584 bp, Panicum virgatum
  misc_feature: Ceres CLONE 1774760
  misc_feature: Encodes the peptide sequence at SEQ ID NO. 14235
gcgccggccaacaggtaaaaccgtgtccttactgccccggaacccgtggcgcccgctatccttttcatgcccgccgccaagaagcaagatgcccgcggcgccaggctgcgcgcccaggtgacctacaacgtgaagctagtcacacccgacggggaggtggagctgcaggtgcccgacgacgtgtacatcctggaccaggacgaggaggaggggatcgaccttacctactcgtgccgcgccgggtcctgctcctcctgcgccggcaaggtcgtctccggctccgtcgaccagtccgaccagagcttcctcaacgacgaccaggtcgccagcggctgggtgctcacctgccacgcctaccccacctccgacgtcgtcatcgagacccacaaggaggaggagctcaccgcttaatatacaattaattaagctcgctccatcgtgcgtcgatatatatcatcatcatctagtatatctcaatctgcctgccttgcaagagatgttgtaatcgatcgagttgacgaagccggccgccggagaaatttcttcctagctttaatttgtatcatccatcatgcatgtcgatc

SEQ ID NO: 14235 - protein, 114 aa, Panicum virgatum
  misc_feature: Ceres CLONE 1774760
  misc_feature (25)..(100): Pfam Name: Fer2 Pfam Description: 2Fe-2S iron-sulfur cluster binding domain
MPAAKKQDARGARLRAQVTYNVKLVTPDGEVELQVPDDVYILDQDEEEGIDLTYSCRAGSCSSCAGKVVSGSVDQSDQSFLNDDQVASGWVLTCHAYPTSDVVIETHKEEELTA

SEQ ID NO: 14236 - DNA, 874 bp, Panicum virgatum
  misc_feature: Ceres CLONE 1774775
  misc_feature: Encodes the peptide sequence at SEQ ID NO. 14237
ctctctcttctcccacgccttcactcccttggtctcgtctcggccttcctttcctagcggcggcgacagggcgagcggcgccgcccgccagttcttcgtcgggcgcttcaccggcgacgagcatccgacagggatccgtaaagcagtaacatggcaactctcaaagatgcagcggcaagaaaaccaattttagcaacaatccgtcttatagttcctgctggcactgcacgccccgcaccaccagttggaccagctctgggtttctataggcttaatttgatggcattctgcaaagatttcaatgccaggacccagaagtacaaggcagatactccgatgcaagttactttgactgcctacaaggatagtacattcgagtttgtagtcaagtcaccttcagtttcatggttcctgaagaaagctgcaggaattgagactgccagcagtcgcccaggccacaacgcagtgtcgtccctcactcttcgccatgtgtatgagattgcaaaactgaagcagtctgatccattttgcaagcacatgtcaatggaggcgttatgcaaatccatcattgggacggctaactccatgggcattgaaattgttagagacctttgagtgggctggcagacaattgtcggaccaattccaagctcagtttgctttctcatctgtatgagttcggttttatttgatctgaatgaaatagacatttgattactataggaagtatagtgtgcttcttctgtatcagcttctgtccgcaccttctttcagatgtagcaactaatatgattcttacagaggctttttgctgaatatgttgtctgaaccttattgagttgcaaaccattgcctttgcgaatatattttcttc

SEQ ID NO: 14237 - protein, 154 aa, Panicum virgatum
  misc_feature: Ceres CLONE 1774775
  misc_feature (80)..(150): Pfam Name: Ribosomal_L11 Pfam Description: Ribosomal protein L11, RNA binding domain
  misc_feature (16)..(75): Pfam Name: Ribosomal_L11_N Pfam Description: Ribosomal protein L11, N-terminal domain
MATLKDAAARKPILATIRLIVPAGTARPAPPVGPALGFYRLNLMAFCKDFNARTQKYKADTPMQVTLTAYKDSTFEFVVKSPSVSWFLKKAAGIETASSRPGHNAVSSLTLRHVYEIAKLKQSDPFCKHMSMEALCKSIIGTANSMGIEIVRDL

SEQ ID NO: 14238 - DNA, 786 bp, Panicum virgatum
  misc_feature: Ceres CLONE 1774790-R
  misc_feature: Encodes the peptide sequence at SEQ ID NO. 14239
ttacaacctaaatatataaggcgtaaaccatggcatccaaggccgtcctcttcttggcactcaacctcctcttattcacggtggccaacgcctgcggcagctgcccgaccccaccaacgcccccggctgtgccgccgccgccgccaccttctaccccacccccatcatccagcggcaagtgcccggtgaacgcgctcaaattcggcgtgtgcgtcaacgtgctcggcctcgtcaagggcgaggccggcaaggtgcccgctgagccgtgctgcagcctcctcaacggcctcgccgacttggaggccgccgtctgcctctgcacggccatcaaggccaacgtgctcggcgtcgccatcgacatccctatcaagctcagcgccctcgtcaactactgtggcaagtgcgtgcccaaaggctacacctgtgcgtaaacacgccgcggctacacgctcgtatagccgctcacgcaatctgcatggcatatatacgtgcgttgggtttgctgctgaactcttctgtctcatttgtgcatgcaacttcggttctgcaacctagaaccatgcatttcgtccaaatgctttgtcagtttgtgtgtattgcattgtgtctcttgtcgaatttcctttcatttttgaatttgttcataagaggcatgcatctctccttgaagtgaacaagaggagtagtgttgcttctagttattgcaaatcatgtaatctgttgggaaacttttattgtgtatgtaaaatcaagcgcttgaactatctgtaataatacttattcgtc

SEQ ID NO: 14239 - protein, 133 aa, Panicum virgatum; identical to SEQ ID NO: 96
  misc_feature: Ceres CLONE 1774790-R
  misc_feature (51)..(132): Pfam Name: Tryp_alpha_amyl Pfam Description: Protease inhibitor/seed storage/LTP family
  misc_feature: Useful for making plants with modulated oxidative stress sensitivity

SEQ ID NO: 14240 - DNA, 106 bp, Panicum virgatum
  misc_feature: Ceres CLONE 1774790
ccctcgccggtggggttcgcaaccagccgcgtgattccacagcctctgcctgccttacacggacaagtggctattatggctccgcgtgctgggggtgcgtgaggcg

SEQ ID NO: 14241 - DNA, 1007 bp, Panicum virgatum
  misc_feature: Ceres CLONE 1774801
  misc_feature: Encodes the peptide sequence at SEQ ID NO. 14242
actaaggcagagcacaggcagcggccggagtcgagatgctcccatgggcggccacggcatcaccagccaccactccggccaccgctgccatctccttagctagtctcctccgcgtcgccgttctccgccctccacggcctctcttccggccgcctccgctgctgctgttgcgtgcgggcctcagggccccgccgcgcgccgcctcttccgacggcaacgtcttctgggaggagccggacgacgggtccgggagcgactatgaggacgaagttgaggaagagaacgagcggaggaggaactcaagtcctccgtccccctcgccgttctccaggctcgaggcggcgcggcagcaagagcaggagctccgaagagaaatcgagctcctcttgacgccagaagagaaggctatcttggatcaacacgagacccctgatgtcactaaaatatcatcaccgaaatggcatccgcttcatagttatgcgttggcgctgcagatacctctcatggacaagctccttgacagtggagttgacatcaatttacttgataaagatggcttcaccccccttcacaaggcagtcataggcaagaaagaggctgtcattagccatctcctaagaaaaggggcaaatccccatgttagagatagggatggagccacaccattacattatgctgttcaagctggtgccctgcaaaccgtgaagttgctgattaagtacaaggttgacgtcaatgttgctgataatgatggatggacaccgctacatttagccatacagagtagaaatagagatatagtaaaggtcttgcttgtcaacggtgcggataggacaagaagaaccaaggatggaaggactgcattggatctaagcttatgttttggaagggatttcaagtcatatgatcttgcaaagcttgtaaaacttattccagcaaacagagtgtgattttgctctgccacatatctgagagaaataaagagcaaatgctagccattgaagcct

SEQ ID NO: 14242 - protein, 304 aa, Panicum virgatum
  misc_feature: Ceres CLONE 1774801
  misc_feature (206)..(238): Pfam Name: Ank Pfam Description: Ankyrin repeat
  misc_feature (239)..(271): Pfam Name: Ank Pfam Description: Ankyrin repeat
  misc_feature (173)..(205): Pfam Name: Ank Pfam Description: Ankyrin repeat
  misc_feature: SWISSPROT Homolog: EC 2.1.1.43 Histone-lysine N-methyltransferase
MLPWAATASPATTPATAAISLASLLRVAVLRPPRPLFRPPPLLLLRAGLRAPPRAASSDGNVFWEEPDDGSGSDYEDEVEEENERRRNSSPPSPSPFSRLEAARQQEQELRREIELLLTPEEKAILDQHETPDVTKISSPKWHPLHSYALALQIPLMDKLLDSGVDINLLDKDGFTPLHKAVIGKKEAVISHLLRKGANPHVRDRDGATPLHYAVQAGALQTVKLLIKYKVDVNVADNDGWTPLHLAIQSRNRDIVKVLLVNGADRTRRTKDGRTALDLSLCFGRDFKSYDLAKLVKLIPANRV

SEQ ID NO: 14243 - DNA, 504 bp, Panicum virgatum
  misc_feature: Ceres CLONE 1774809-R
  misc_feature: Encodes the peptide sequence at SEQ ID NO. 14244
gtacttggtctccacatacagggagaacaagtaacagactgctcagaactttgcgactgagttctccattaaattcctgcctggatctgctgcttcaagatagagtaagctcaattcctataattgatgacaatggatccctccgtgatgtctactcactcagtgatatcatggctctggcgaagaatgacgtctacgctcgcattgaacttgaacaagtaactgtgcaaaatgcattggatgtgcagtaccaggtgcagggccgaagacaatgtcatacgtgtttgcagacgagtaccttgcttgaagtcttggagaaattgtgtattccaggggtgcggcgggtggttgttattgaacaaagtaccagatttgtggaaggaatcatctcattgagagacatatttacatttcttcttggatagcatctgtgtagccatttcatacatgaaagcttcttgtacctgattcggacaaaataaaaaaggttgttggaaatgtgat

SEQ ID NO: 14244 - protein, 140 aa, Panicum virgatum
  misc_feature: Ceres CLONE 1774809-R
  misc_feature (8)..(139): Pfam Name: CBS Pfam Description: CBS domain pair
TWSPHTGRTSNRLLRTLRLSSPLNSCLDLLLQDRVSSIPIIDDNGSLRDVYSLSDIMALAKNDVYARIELEQVTVQNALDVQYQVQGRRQCHTCLQTSTLLEVLEKLCIPGVRRVVVIEQSTRFVEGIISLRDIFTFLLG

SEQ ID NO: 14245 - DNA, 507 bp, Panicum virgatum
  misc_feature: Ceres CLONE 1774809
cttgccagtcccatccagccaagctggtcgggcggtttcgcacctgtaccacccaccctcccatgcgacggtaggagctgctcgggatggccagttccgcttcggttctccttgtccgcctgctggtcttcgccgcgatagatgacctgggggctggccccccccgtcccgtccgccgctgccgtgccggccgcgaggaggacctagctcctcccctgccactgcgacacctcaccgcgctcatccgggggaaggggcgacgggatgtccgtctccagtccataccacgactaggagggccgggaggcgtcgtcgccgccgccgccgacggagaatccctcccgcggatgcagcacactggtgtggccgagcttggattggctgtccttcatcgatactctcccgacggggcaactctgagataaccacccaccctccgctcgtccgtaccgtggtgatccagcgatcgattgtcgtcggcgctgactccccgcagttatgttctga

SEQ ID NO: 14246 - DNA, 846 bp, Panicum virgatum
  misc_feature: Ceres CLONE 1774840
  misc_feature: Encodes the peptide sequence at SEQ ID NO. 14247
gatcagagtttcagttctgactaagtaaccatccaacccaaaactcggtgcgaataggggatgggctaattcttcgagcctcccaccagtcgcccctgacaatggcgagcgctgcttccgtcgcccccgccgtcgctgcttccagaagcttcagcttcactgccgcggcatacccctccccctcgcgcacgcttcgtccggccgccctctccggtggggtccgcaaccagcagcgcccgtccaccgcctctgcctgcctccagccgccaactgcctcccatggcgccgccaccaggttgtacgtccgcggtctatcgttccgtacaaccgaggagaacctccggagcgcgttcgagaaattcggtcagcttacagaagttcatctcgtgatgtatcgagtagaaaagcggccgagaggtttcgcgttcgtgtcctacgctgtcgaggaggaagccaagagcgccatggaaggaatgcacgggaagttcctggatggcagagtgatctttgtcgaggttgcaaaacaaaggcctggactctgaaggatcgcgcccaggtgccaagcgaagtgccatccagtttccctgacgcttcgaagacgggttattcagagaaacctggcgagcctttcgaaattacatgaacctgcgtgcgcaaatttcaatccattacagatttctgtagcatggcgaccaccaaacctccatagtattatgatttttcagggcattgatacttcatagtagtatgatttgcaagtcactggacgatgtccagaaacttgattgtttgattccagcaagtctctgatgagacgcgctgacttaagtccataagtccctcagc

SEQ ID NO: 14247 - protein, 146 aa, Panicum virgatum
  misc_feature: Ceres CLONE 1774840
  misc_feature (66)..(137): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MASAASVAPAVAASRSFSFTAAAYPSPSRTLRPAALSGGVRNQQRPSTASACLQPPTASHGAATRLYVRGLSFRTTEENLRSAFEKFGQLTEVHLVMYRVEKRPRGFAFVSYAVEEEAKSAMEGMHGKFLDGRVIFVEVAKQRPGL

SEQ ID NO: 14248 - DNA, 517 bp, Panicum virgatum
  misc_feature: Ceres CLONE 1774850
  misc_feature: Encodes the peptide sequence at SEQ ID NO. 14249
aatagaagccgcatcagacacggcggcatacatgatcacgtcgtcagctctggtggggacggacaggggccagggcctgccgaccaacgggcgccgcgcctcctccttcgccgtcggctgcggcaccggcaataagatcaagaccgacaagcccttcaggattggaggtggcctcaccgtcgactacaatgcctccgggaggaaggtcaagggtaagggcatgaaccacttggtcgacaactaccgcgccaacgtcgacggatacgacccaatctacaaagaggaggactggtctcccaccgatgacgtctacgacggcggaaccaccagacttctgatctggtccatcaccctcatcgggcaccttgacagaggcgccctccttgtgtacaacaccagcgccctcgtcagctagcaacattattcatgcatagcccatgaacgcccttgctgacggtacaaatataatatttaacatccgccagggtgtctgtgtggaatctatcctgcagcttcg

SEQ ID NO: 14249 - protein, 127 aa, Panicum virgatum
  misc_feature: Ceres CLONE 1774850
  misc_feature (31)..(127): Pfam Name: PsbR Pfam Description: Photosystem II 10 kDa polypeptide PsbR
MITSSALVGTDRGQGLPTNGRRASSFAVGCGTGNKIKTDKPFRIGGGLTVDYNASGRKVKGKGMNHLVDNYRANVDGYDPIYKEEDWSPTDDVYDGGTTRLLIWSITLIGHLDRGALLVYNTSALVS

SEQ ID NO: 14250 - DNA, 603 bp, Panicum virgatum
  misc_feature: Ceres CLONE 1774862
  misc_feature: Encodes the peptide sequence at SEQ ID NO. 14251
ttatccccaaaaaaaaacccacccggataaaccctagcgctccggcgatgtcggcggccatccgctccggcgagctcctcgcgtgccccgtcgcgctgcggcgggcgccgctggcggtgtcggtgcgggtgcgggtgcggggcgcgccggaagcgagggcggtggtgcggacggaggcgacggccgagggggtcgggaaggccaagggggagggggcgggggcgagggcgggggcggggaagaagagggcggcgagcaggatcacgaaacccaagccgatctcgcccgagctgcgggagttcgtcggcggcgcggcggagctgccccggaccgaggccatcaagctcgtctgggcgcacatcaagggcaacaacctgcaggatccaagtaacaagaagataataatctgtgatgacaaattgaagaagatatttggaggtcgtgatcgtgttgggttcctcgaaatctctgggctgcttaacccccacttccagaaatgactggatttttgtagatcccactgttttgttttgtactagctgtggctgttgtatggatacatttagctaaaccctggtttacagggtctcttaatgcttgttt

SEQ ID NO: 14251 - protein, 150 aa, Panicum virgatum
  misc_feature: Ceres CLONE 1774862
  misc_feature (72)..(149): Pfam Name: SWIB Pfam Description: SWIB/MDM2 domain
MSAAIRSGELLACPVALRRAPLAVSVRVRVRGAPEARAVVRTEATAEGVGKAKGEGAGARAGAGKKRAASRITKPKPISPELREFVGGAAELPRTEAIKLVWAHIKGNNLQDPSNKKIIICDDKLKKIFGGRDRVGFLEISGLLNPHFQK

SEQ ID NO: 14252 - DNA, 606 bp, Panicum virgatum
  misc_feature: Ceres CLONE 1774865
  misc_feature: Encodes the peptide sequence at SEQ ID NO. 14253
aatccccccaagcactctcctcggatcagatcccctccattggattggatctcctcttctccttcctgtcggagcaaggccaggtggtccggatctctctatcagtcgccatggatgatgaggaacttgttgatcaaaagaagtatcttgaggaacgatgcaagccacagtgtgtaaaatcactttatgagtatgataaatgtgtcaagagagtcgagaatgatgatactggacacaaacactgcaccgggcagtattttgattactggtcatgcatcgacaaatgtgtagcaccaaagctgtttaagaagctaaagtgatgtctgtggtggtgcttttggcaagtgactcagatgatgcatgatgctactttcggcgagcgacttatccatttgcgttaaccttggcgcctttggaacttggctgagctcacgaactgttatgtttgtgcttgattctgtgaacttgtaataaaccaacaattttccttcccaagcatgtgtgttcctttggacttagcatggataagttgatgtttgctgaatctaatgtcattgccccagtgccattccattgaactgagcatggatataagttgatgttcgg

SEQ ID NO: 14253 - protein, 69 aa, Panicum virgatum
  misc_feature: Ceres CLONE 1774865
  misc_feature (7)..(69): Pfam Name: UCR_hinge Pfam Description: Ubiquinol-cytochrome C reductase hinge protein
MDDEELVDQKKYLEERCKPQCVKSLYEYDKCVKRVENDDTGHKHCTGQYFDYWSCIDKCVAPKLFKKLK

SEQ ID NO: 14254 - DNA, 667 bp, Panicum virgatum
  misc_feature: Ceres CLONE 1774878-R
  misc_feature: Encodes the peptide sequence at SEQ ID NO. 14255
cttcgtccccttctggagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgagggcggcggtggctacggcggcggcggcggcggcggcggctacggtcgccgcgagggcggtggcggctacggcggcggcggcggcggctacggtggccgcgccgccgcttcctcagccatgggtaaggtgcacggatcgctggcccgtgccgggaaggtccggggccagacgcccaaggtggcgaagcaggacaagaagaagaagccccgcggccgcgcgcacaagaggatgcagtacaaccgccgattcgtcaccgccgtcgtcggcttcggcaagaagcgcgggcccaactcatccgagaagtaagcgccgcgccgcgcagccgccggctcgacccgccccggttcctctattccgttctcagtatgcttatgctcttgtcggtagtagtttcgttgtgcaagcaaaggaagaaccttttgtagtttcagtttcgttgttcgtgtgatgagatgggaacttgagatggtatctgtaccccgtttaagattttgagatatgatgatatgatcccat

SEQ ID NO: 14255 - protein, 151 aa, Panicum virgatum
  misc_feature: Ceres CLONE 1774878-R
  misc_feature (92)..(150): Pfam Name: Ribosomal_S30 Pfam Description: Ribosomal protein S30
  misc_feature (1)..(84): Pfam Name: GRP Pfam Description: Glycine rich protein family
FVPFWSEQAMRDAIEGMNGKELDGRSITVNEAQSRGGPRSGGGGGYGRREGGGGYGGGGGGGGYGRREGGGGYGGGGGGYGGRAAASSAMGKVHGSLARAGKVRGQTPKVAKQDKKKKPRGRAHKRMQYNRRFVTAVVGFGKKRGPNSSEK

SEQ ID NO: 14256 - DNA, 421 bp, Panicum virgatum
  misc_feature: Ceres CLONE 1774878
agttccctccgaggtggtttggcttctcctccccctccatttcggttcggatttggttcgtgagggccgtggggttccctatcggtggtgagaggacgaggggcacgcctctgatgttgcttcccgctgcttcctccgccttcttgcctggggcgccgaccacccctcggtccggagctccttccatgcctgcggcgaggtcctttggtgcccgatcgtcctcgatgggcagacccgcaagttccgccgcttcggtttcctcgccttctcgagagagggagctatcgcgcgacgcactacagggaatgaccggaacggagctggacggacgcgatatcaccgccattctcgtgccgtcccgcgtcgggcccctcccgcgccgcggcggccgccaccggctccgccagggcggccgacccta

SEQ ID NO: 14257 - DNA, 492 bp, Panicum virgatum
  misc_feature: Ceres CLONE 1774884
  misc_feature: Encodes the peptide sequence at SEQ ID NO. 14258
accaatatttcccagccctccccctgccgcggttcgcgttgctaccccacgatccaggaccagatatccactaagataatcgaggaggaggggggaggcgtgctcagcgaccacgcggaggccgagcctataccgaagtggagcctgatggaccaggccgaggatttcctgggggacacgatcgcccacctccccaggccggaggcgacgctcgacagcgtctccttcaagagcatgagccgcgagtgcgtcaccctgcacagcaacctcgacgtctccaacccctactaccaccgcctccccatccgccaggtcacctactccctcaagtgcgccagcaatgttgcggcgtccggctccgtgcccgaccccggatggatcgccgccagcgacaccacctacctggagacctcggcctaggtgcccttgtacttcctcatctctttcatgaaggacgtggccaaggactggcacatcgactacgagctccag

SEQ ID NO: 14258 - protein, 139 aa, Panicum virgatum
  misc_feature: Ceres CLONE 1774884
  misc_feature (47)..(138): Pfam Name: LEA_2 Pfam Description: Late embryogenesis abundant protein
TNISQPSPCRGSRCYPTIQDQISTKIIEEEGGGVLSDHAEAEPIPKWSLMDQAEDFLGDTIAHLPRPEATLDSVSFKSMSRECVTLHSNLDVSNPYYHRLPIRQVTYSLKCASNVAASGSVPDPGWIAASDTTYLETSA

SEQ ID NO: 14259 - DNA, 974 bp, Panicum virgatum
  misc_feature: Ceres CLONE 1774891
  misc_feature: Encodes the peptide sequence at SEQ ID NO. 14260
actgcgagaagggatttttttttctttttggctcggaaatccgctcaactctcgactcggcgaggtgtcgatcctccgactgctcctccgccggcgacgcgcgagctcctcccttcgcccgcagcaggggagggggcccgcgaagaggtagcggagcggagcagagccggcggtcatggacacgatgcgcggcgcgctggagcgggccaagatgctggtgggcatggaggtcgacgaggagtccgggctgccgccccccgaggagcagtccttcttcgacgacatcaaccgcaactgcaccctcaacactacccagaggctctacggtttcgcgatttgcttggctgccggcctgacgtgcaccttcctgtcaatgattgttttcttcaatccggtgaaatttggggtaacattcacccttggcaacttgatggcgctgggaagtacagcatttcttataggccccaaaaggcagtttgatatgatgcttgattcagtgcgaatatatgccactgctatatacattgcaagcatcataattgctctattctgtgctctctatgttcacagcaagctgttgactctactggccatcattttggaatttggtgcccttgtttggtacagccttagctacatacctttcgcgaggtcaatcttgtcgaaagtgatgacatcctgcttcgacactgatttctagagcaatgatccttgcctgcttgagtctcggcagacatcagcaggcaatctagtgtgtacttctgacagatgtggagggagtcacctcaccctcttgtaatcactgtgactcgagtttgtgtgcgtttggtcacgctagaccagaagattgtgctaataccgactgttctccccctttgatgcacttgctgacttgcacatggaatccaagcttcagtctgtttgggcattccatctgctgtgcagtgcttggcgcatccactgtggatttatag

SEQ ID NO: 14260 - protein, 174 aa, Panicum virgatum
  misc_feature: Ceres CLONE 1774891
  misc_feature (43)..(162): Pfam Name: SFT2 Pfam Description: SFT2-like protein
MDTMRGALERAKMLVGMEVDEESGLPPPEEQSFFDDINRNCTLNTTQRLYGFAICLAAGLTCTFLSMIVFFNPVKFGVTFTLGNLMALGSTAFLIGPKRQFDMMLDSVRIYATAIYIASIIIALFCALYVHSKLLTLLAIILEFGALVWYSLSYIPFARSILSKVMTSCFDTDF

SEQ ID NO: 14261 - DNA, 751 bp, Panicum virgatum
  misc_feature: Ceres CLONE 1774921-R
  misc_feature: Encodes the peptide sequence at SEQ ID NO. 14262
catgatgctcacgggagaccatgaatcaagtgcccagagggtgctaaaagctgtttgtattgatgaagtccacttctctttaaagcctgaggaaaaattgaataaagtaaaagcagtttcgagggagggaggtggaggtttaataatggtcggtgatggtataaatgatgctccagctcttgcagctgcaacagtcggaatggttctagcccaacgtgccagtgcaacagcagtggctgttgcagatgttctgttgttgcaggacaatatttgtggggtgccattctgcattgctaaagctcgccaaacaacttcactggtcaaacaaagtgtggctctggccttaacttgcattgtttttgctgcgcttccttctgtcctgggatttcttcctctttggttgacggtacttcttcatgaaggaggaacccttctagtgtgcctcaactcaatacgggccctgaatgctccgacatggtccttggtagacgacatccagcagctcttagatggcctaagaaattatttctcatccaagttcaaaagctcttcttcaaactatgtcacaaacaccgttcccttgtagataccatgtacagcaacgtttgtccttttcttttttaccttctctgtgtggtgccgtatgagtttagatcaggggttctaacctaatttttgtaggctatatatcaccaccatgtaaagaaagtaatttcgcttcatgttgagctaacagtaaaaaacagtgctg

SEQ ID NO: 14262 - protein, 194 aa, Panicum virgatum
  misc_feature: Ceres CLONE 1774921-R
  misc_feature: SWISSPROT Homolog: EC 3.6.3.5 Zinc-exporting ATPase
MMLTGDHESSAQRVLKAVCIDEVHFSLKPEEKLNKVKAVSREGGGGLIMVGDGINDAPALAAATVGMVLAQRASATAVAVADVLLLQDNICGVPFCIAKARQTTSLVKQSVALALTCIVFAALPSVLGFLPLWLTVLLHEGGTLLVCLNSIRALNAPTWSLVDDIQQLLDGLRNYFSSKFKSSSSNYVTNTVPL

SEQ ID NO: 14263 - DNA, 536 bp, Panicum virgatum
  misc_feature: Ceres CLONE 1774921
attcccccgctgagagggggcaacaggtccgcagacgagcccgagctcgccgtgcctggccatggccaccaccgagatggcctcggccacctcctgattgatgccgttccggggcctgcgcccggcggtgggcaccccagcccccgtcgctttcgagtctccgccgggtacggcgccggccccgacggccgagggacccggcgagtgacgagggcggcccactgagaggaacgggaagtcgcagaggccgtcttacctgacgtccacctccacgcaggaccccctgccgcaagtcgactacatgatccgctacaacagggtcccctccctcgatttcaccacggttcagcttctccttccgaggatgacgccacttcccccggtctactaccaggggcccgacctggatcaactggatgctgcccgtgctcgccggcaccgactccacccacgtgtactgcaagctcgaagattgctagcaacgcctaccctggacccctacctgcgccatcctccgggctcgaccacgtcagggt

SEQ ID NO: 14264 - DNA, 584 bp, Panicum virgatum
  misc_feature: Ceres CLONE 1774923-R
  misc_feature: Encodes the peptide sequence at SEQ ID NO. 14265
caagggcgggcccgagtcggagcgctccttcgggctgtacaagacggacctgacggcgaactacgacgccgggctagccaagagcggcggcacggcggctccaaccattttgactccgtctccgccgcagggcacgctgcagccgagcaggggggcaacgccgatggggttttgtcagacgacggccaccgtgccgggcagcacgcaaggccaacaggtgccgctgagcagctcgtgctacatcccggccggagccgtgtcgcgtcaggcagacgccggcacatggcagcttgtttggttcggtgttttgctgtgcctggcaatggtagcaggcatgtagttacagcgtttgtaacgtgacggaacaagtacagtacagtacagtttttttttttgcaacccactccataccacggctttgccaccatattagtagatttcacgaaagaacaactacacacagtgacacagaacattgggccgatcggctgccttgcctttgccgcgatggctccacctgcactgcacccctttggaagtggatataaaagtcagatgagatggattgcgtgagccttacttct

SEQ ID NO: 14265 - protein, 112 aa, Panicum virgatum
  misc_feature: Ceres CLONE 1774923-R
  misc_feature: SWISSPROT Homolog: EC 3.2.1.39 Glucan endo-1,3-beta-D-glucosidase
KGGPESERSFGLYKTDLTANYDAGLAKSGGTAAPTILTPSPPQGTLQPSRGATPMGFCQTTATVPGSTQGQQVPLSSSCYIPAGAVSRQADAGTWQLVWFGVLLCLAMVAGM

SEQ ID NO: 14266 - DNA, 135 bp, Panicum virgatum
  misc_feature: Ceres CLONE 1774923
attagcatactatgaattttatatacggctccccccgccccccccgtccccgtccgcttggtggctgccctggtggcggccgagaccgcttcggctggagggagctgggcccgggtgagggcgcgactggtaact

SEQ ID NO: 14267 - DNA, 845 bp, Panicum virgatum
  misc_feature: Ceres CLONE 1774926
  misc_feature: Encodes the peptide sequence at SEQ ID NO. 14268
agcagctctagcaataatggccaccgccctcagcagcctccgcgcgccggccagcagcttctccggcgtccgcgctgccccggcacccgcggcgcccgccatcgtcgccatgcccgccgccaagcagcaggttgcccgcggcgccaggctgcgcgcccaggcgacctacaacgtgaagctcgtcacgcccgacggcgaggtggagctgcaggtgcccgacgacgtgtacatcctggaccaggccgaggaggaggggatcgaccttccctactcgtgccgcgccgggtcctgctcctcctgcgccggcaaggtcgtctccggctccgtcgaccagtccgaccagagcttcctcgacgacgaccaggtcgccagcggctgggtgctcacctgccacgcctaccccacctccgacgtcgtcatcgagacccacaaggagaaggagctcaccgcttaatatacaattaattaagctcgctccatcgtgcgtcgatatatatcatcatcatctagtatatctcaatctgcctgccttgcaagagatgttgtaatcgatcgagttgacgaagccggccgccggagaaatttcttcctagctttaatttgtatcatccatcatgcatgtcgatcaagcaagctaagcatcggcagcagggccatctgttaccgtcgcagtacctgcgtgcttggtctctgtatcattcaccatttttactgcatgcggatgcatcatctacttctcatcaaagttattaattaataatgttttttcctctttatgtttctactgtcatcaatacatatatattacggaaattaatgcatatatctatcagctttatttcagt

SEQ ID NO: 14268 - protein, 145 aa, Panicum virgatum
  misc_feature: Ceres CLONE 1774926
  misc_feature (56)..(131): Pfam Name: Fer2 Pfam Description: 2Fe-2S iron-sulfur cluster binding domain
MATALSSLRAPASSFSGVRAAPAPAAPAIVAMPAAKQQVARGARLRAQATYNVKLVTPDGEVELQVPDDVYILDQAEEEGIDLPYSCRAGSCSSCAGKVVSGSVDQSDQSFLDDDQVASGWVLTCHAYPTSDVVIETHKEKELTA

SEQ ID NO: 14269 - DNA, 733 bp, Panicum virgatum
  misc_feature: Ceres CLONE 1774957
  misc_feature: Encodes the peptide sequence at SEQ ID NO. 14270
acggtaagcgtcgttcgttcatgccgcattcttctcatcctctgcagcatcgcgattctcaccttcttctccgttgccgtcgaggcgcaggctctagcccaccgagcgcaggaatggcgtcgttcgccgtggcaacgatcccgtcgctggcggccccggcggccaggaagaggtccggcggcgtcacctacgtggagggcatgaacgcctacagcggcctcaaggggctcaacaaggtcaccatgctcgggctgcgcaagaccgccgactactccttcgccaagatcgtggcgtcgctcagccccgccggcaaggcgcggcgcggcagcgcgttcggggcgcagatgaacgccgccgcggagatcttcaggatcgccgccatcatgaacggcctcgtgctcgtcggcgtcgccgtcgggttcgtgctgctccgggtggaggccgccgtcgaggaggccgagtaggggtggatgcccgcgcccgccctgattgcagccactccggctgtcgcctcttgcctcatataagccgtgatatataaaacgtgacgtatgcttttggttgaatttacttcggtatgtatccatgacaattgataaataccgtgcaaacatgtttctggtcttctggagtcgaggtctgcaatggatcttcaggtgtttttgcgactctctgagatcagaatgcaaaaacatccacgtcttgcaaatgaaatcgtgtacaaatttgtagc

SEQ ID NO: 14270 - protein, 116 aa, Panicum virgatum
  misc_feature: Ceres CLONE 1774957
  misc_feature (78)..(114): Pfam Name: PetM Pfam Description: PetM family of cytochrome b6f complex subunit 7
MASFAVATIPSLAAPAARKRSGGVTYVEGMNAYSGLKGLNKVTMLGLRKTADYSFAKIVASLSPAGKARRGSAFGAQMNAAAEIFRIAAIMNGLVLVGVAVGFVLLRVEAAVEEAE

SEQ ID NO: 14271 - DNA, 965 bp, Panicum virgatum
  misc_feature: Ceres CLONE 1774991
  misc_feature: Encodes the peptide sequence at SEQ ID NO. 14272
agcggagcgccgcacaggcggctagcgctgacgcctcaccagcagcttccgcctccccgcgcccggatgccccccggcgccggcgcctagagcggcggcggtctagcgggacgccacccaccgatggccgacgcgctcctcctcccgcgccgcttcctcgccccgtccccctcagcctcctcgtcgtcgtccgcgccgtctcgctgggtgctctcgtcccccggctcgccgcggcgggcgcgcctcgcggccgctcgcccgcacccgcgcccccgccggctcgctcgccacaaggttcattcggcagacccagagagcagtgagcaaccaaaatggtgggagaaagatgctggaccaaatatgattgacatccactccacagtggagttcttggatgcactgagagatgctggagacaggcttgttgttgtcgagttctacggaacctggtgtggttcatgccgagcactctttccaaggctttgccggacagctttggagaatcctgatatattgtttcttaaagtaaattttaacgaaaacaaaccaatgtgcaaacgactgaatgtcaaagtccttcctttcttccatctttatcgtggggctgatgggctactggaggctttctcctgttccttggcgaagtttcagaagctgaaggatgccattgcaattcacaacacggcccgttgcagcattggtccacctgttggagttggggacgttgatttgttggatagtgcgagcccacaggagaaacccgcagcagctagcccacggtagattctacaagattagctcgccaccatccatcgcttctccaccacctgctcattttccccccactttagatcttactgtaatcagctcaggagaatcttcggtgtccccggttaacgaatcgggtgttgtatggattattatttcgcattcttgaatggaaaaaatatgtattatagcgtgtg

SEQ ID NO: 14272 - protein, 140 aa, Panicum virgatum
  misc_feature: Ceres CLONE 1774991
  misc_feature (3)..(106): Pfam Name: Thioredoxin Pfam Description: Thioredoxin
  misc_feature: SWISSPROT Homolog: EC 5.3.4.1 Protein disulfide-isomerase
MIDIHSTVEFLDALRDAGDRLVVVEFYGTWCGSCRALFPRLCRTALENPDILFLKVNFNENKPMCKRLNVKVLPFFHLYRGADGLLEAFSCSLAKFQKLKDAIAIHNTARCSIGPPVGVGDVDLLDSASPQEKPAAASPR

SEQ ID NO: 14273 - DNA, 590 bp, Panicum virgatum
  misc_feature: Ceres CLONE 1774998
  misc_feature: Encodes the peptide sequence at SEQ ID NO. 14274
gaatgtacacgatcatcaaacaatcaacaaagcctcccaattatcctttcatcaaatcatcttccttcttccaagatgtcttgcagctggggatcaagctgcaactgcggctccaactgcaagtgcggcaagatgtaccctgaccttgaaaaaaagagaagcagcggcgctcaggccaccatcgtcccctgcgtgcccccggagaagaaggccggccaattcaaggcggcgacgaaatccggcaagaccgcccacgcctgcagctgcggaaactactgatgctgcaacccctgcaaatgctaatttagatggggaacgacaaaacacacctgcaggcatgcatgctagatactacctactactctgcttgtgtgtgacattataaaagaacaagaataatgatgaacctgagccatcatgtctcatgtatcgaataggctccggcctcatcacgcatgcatgcgacgtctgccactctgtgagctatgcgtccgtcctgtgtctgtatgtgttgatcattgcaaagacaccatgaaatgcatacatctttgcttgtgtctcggtactgatcggcccaaaaagatgaaaat

SEQ ID NO: 14274 - protein, 67 aa, Panicum virgatum
  misc_feature: Ceres CLONE 1774998
  misc_feature (1)..(67): Pfam Name: Metallothio_2 Pfam Description: Metallothionein
MSCSWGSSCNCGSNCKCGKMYPDLEKKRSSGAQATIVPCVPPEKKAGQFKAATKSGKTAHACSCGNY

SEQ ID NO: 14275 - DNA, 508 bp, Panicum virgatum
  misc_feature: Ceres CLONE 1775007
  misc_feature: Encodes the peptide sequence at SEQ ID NO. 14276
acaccgccactcctcccaacccctctccttcacctcaaaccctaccccaacggaccaactacatatgaatggggaagggaaccggcagcttcatgaagcaccggagcaagacccgcaccctctgtatccgctgcggccgcaggagcttccacctacataacagcacctgctcctcctgcggttaccccgccccccgcatccgaaaatatagctggagtgtgaaggccatccgacgcaagacgactggaactgggaggatgaggtacctccgacatgtgcctctgcgtttcaagaacatcttcacagaaggtactgaggctacccccaacaaggctgatgctgcttccaactaattctggatggtgtcacctactaccgcacaaactaaaaattggaacctttttggctgagttgtacattctgaactatttagacgtgatgctatggtactattgttttgtcatactttaaattcaattaacacgatcatttgattttgttgctctgt

SEQ ID NO: 14276 - protein, 94 aa, Panicum virgatum
  misc_feature: Ceres CLONE 1775007
  misc_feature (2)..(55): Pfam Name: Ribosomal_L37e Pfam Description: Ribosomal protein L37e
MGKGTGSFMKHRSKTRTLCIRCGRRSFHLHNSTCSSCGYPAPRIRKYSWSVKAIRRKTTGTGRMRYLRHVPLRFKNIFTEGTEATPNKADAASN

SEQ ID NO: 14277 - DNA, 661 bp, Panicum virgatum
  misc_feature: Ceres CLONE 1775016
  misc_feature: Encodes the peptide sequence at SEQ ID NO. 14278
gcagcgcacgcgcttcaaggccttcgtcgtcgtcggcgacggcaacggccacgtcgggctcggggtcaagtgcgccaaggaggtggccaccgccatccgcggcgccatcatcctcgccaagctctcggtcgtgcccgtcaggaggggctactgggggaacaagatcggccagccgcacaccgtgccgtgcaaggtcaccggcaagtgcggctccgtcaccgtgcgcatggtgccggcgcccagggggtccgggatcgtcgccgcgcgcgtgcccaagaaggtgctccagttcgccggcatcgaggacgtgttcacctcctcccgcggttccaccaagacgctcggtaactttgtcaaggccacctttgattgtctgatgaagacctatggcttcctgactccggagttctgggatgagactaagtttgccaagaccccattccaggagttcaccgatctcttggccaagccaacaaagggacttgtgatcgacgcccctgtggagactgtagaagcttaaacctgttggaagttcacaacaaagtttgcttgtagtagaaactggtttcctatctacttctgtgtgggttattattatgtattactactgtctcggatatctcagttttgaattgtgaaaccttaagatatgcacttaaaa

SEQ ID NO: 14278 - protein, 172 aa, Panicum virgatum
  misc_feature: Ceres CLONE 1775016
  misc_feature (65)..(138): Pfam Name: Ribosomal_S5_C Pfam Description: Ribosomal protein S5, C-terminal domain
  misc_feature (1)..(48): Pfam Name: Ribosomal_S5 Pfam Description: Ribosomal protein S5, N-terminal domain
QRTRFKAFVVVGDGNGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWDETKFAKTPFQEFTDLLAKPTKGLVIDAPVETVEA

SEQ ID NO: 14279 - DNA, 570 bp, Panicum virgatum
  misc_feature: Ceres CLONE 1775079
  misc_feature: Encodes the peptide sequence at SEQ ID NO. 14280
cattcacaatcttcagctttgcaataaaatgagtaaccccttagttgtaattgttcaaatactgcagcatgatggtttccttctcagaagggttgctcctgagtgaaaaagttggcttagacccgaatactcttgttgaggttatttcacagggtgctatcagtgctcccatgttctccctgaagggcccatccatggttaaagctgcatatcctactgcctttcctctgaagcatcaacaaaaggatctgaggcttgcgctggccctggcggagtcagtatcccagtccattcctactgttgccgcagctaacgagctgtacaaaactgcgaaatcactcggcctcgctgaccatgacttctcggcggttatcgaagcgctcaaagccaaagtgcagagctcgcagcagcagtagtttgtggagctcagctgccaactgccattgaggcattatttcgtccttgtaagttgtaacagatgacgaagttgaaacctggggaattcttcaagagcgctacacaagatttttttcactgttatacatacattgaacgattttttatatttgt

SEQ ID NO: 14280 - protein, 115 aa, Panicum virgatum
  misc_feature: Ceres CLONE 1775079
  misc_feature: SWISSPROT Homolog: EC 1.1.1.60 2-hydroxy-3-oxopropionate reductase
MMVSFSEGLLLSEKVGLDPNTLVEVISQGAISAPMFSLKGPSMVKAAYPTAFPLKHQQKDLRLALALAESVSQSIPTVAAANELYKTAKSLGLADHDFSAVIEALKAKVQSSQQQ

SEQ ID NO: 14281 - DNA, 793 bp, Panicum virgatum
  misc_feature: Ceres CLONE 1775130
  misc_feature: Encodes the peptide sequence at SEQ ID NO. 14282
aaaacaactcggatagggccgggtatccacccagccaccgtgacgtactgacgtgccgtgccggacggcacgtctccgccgcggcggtttggagttggccttgccgggggcagccgattgattgccttcgccttcccgcaagcccgcaactactcgacttccccacaaaactgaacaagctcccctacccctcctctcctcgcgcctccctcctgcaatctctctccaccagctccacgccgcgctgctaatcctattcctagctcgccggctaagatggacggcagcagcctcaagtccgcgcagctcctggatcagatgcgcctgcacttggccaccgacgccggcaaggagctcaccaagaaggtcggcctcgtctaccagctcaacatcgcccccaagaagctcggcgttgacgaggagatcttcgtggtcgacctcaagaagggcgaggtcaccaaagggccgtaccaggggaagccggatgctaccttctccttcactgacaacgatttccttggaatcgccaccggcaagactaacccgcagattgcgttcatccgaggggcgattaagatcaaggggagcataagcgccgcgcagaagttcacccctgacatcttccccaagccagcgaagctgtagaaggttagaatgcattattttggtgcggatggataataaagtttccaagcttcaaccactatgtacctgataggatgaggggaatacatgaacaaacgattatctgtttttatcaatggaatatggataatgctttggttaatctatc

SEQ ID NO: 14282 - protein, 122 aa, Panicum virgatum; identical to SEQ ID NO: 10305
  misc_feature: Ceres CLONE 1775130
  misc_feature (9)..(117): Pfam Name: SCP2 Pfam Description: SCP-2 sterol transfer family
  misc_feature: SWISSPROT Homolog: EC 2.3.1.176 Propanoyl-CoA C-acyltransferase

SEQ ID NO: 14283 - DNA, 638 bp, Panicum virgatum
  misc_feature: Ceres CLONE 1775135
  misc_feature: Encodes the peptide sequence at SEQ ID NO. 14284
gtcctcccacggcaaattccacacacggtcaagagacatgtccggcgtgtgggtgttcaaggacggcctcgtccgccgcgtggagaaccccggccaggacgacgaagggtcgtcggccggcggcagcggcgggcggcgcaaggtgctggtgcacgtccccagcggcgaggtggtgacgtcgtacgaggtgctggagcggcggctgcgggagctcgggtgggagcgctacgtgaacgacccgtgcctgctgctcttccaccagcgctccaccgtgcacctcatctccgtgccccgggacttcgccaggttcaggctcgtgcacatgtacgacgtcgtcgtcaagacccgcaacgtcttcgaggtgcgcgacgctgctaattagctagctctcgatccccaggccgacagggtcgggctctgctgatagcaaacgtgttcttggcctttatatatatatatatatatatatatatatatctctctatctatctatagaactcgggcgcgcgcgcacacacgcacacgcgcatttgtttttgttttttatactttttctcaggcacagggaaacgatagagagatatagatatcacttttatatatgtgtgtgtgcacgtgcacacgggcactgtgtatat

SEQ ID NO: 14284 - protein, 114 aa, Panicum virgatum
  misc_feature: Ceres CLONE 1775135
  misc_feature: Useful for making plants with modulated flowering time
MSGVWVFKDGLVRRVENPGQDDEGSSAGGSGGRRKVLVHVPSGEVVTSYEVLERRLRELGWERYVNDPCLLLFHQRSTVHLISVPRDFARFRLVHMYDVVVKTRNVFEVRDAAN

SEQ ID NO: 14285 - DNA, 649 bp, Panicum virgatum
  misc_feature: Ceres CLONE 1775167
  misc_feature: Encodes the peptide sequence at SEQ ID NO. 14286
ctggccgccgtcgcgccgttcttgttcttcgcatcggcttcgtcgtagggttagggtttgcgattttccgagatggcggtgcccctgctgacgcagaagattgtgaagaagcgggtcaagcagttcaagagaccccatctcgaccgctacaagtgcctcaagccaagctggcgcaggccaaagggtattgactcccgtgttaggaggaagttcaagggatgcaccttgatgcccaacattggttatggttctgacaagaagaccaggcactaccttcccaacaagttcaagaagtttgtagtccacaatgtctctgatctggagttgcttatgatgcacaacaggacatactgtgctgaaattgcccacaatgtatctacccataagcgcaaggagattgtggagcgtgctgcgcagcttgacattgtggtcacaaacaagcttgccaggcttcgcagccaggaggacgagtagtatgctatgaagattgcagcctgggttaatttgcttgtaggaagcagctctgtttgaatgcataatttcgacgttgcactggtgtatggacaccctgtaattcagtgagctcagcataggacatacagttttgaatgttctgcagcaatatttatacttcaaacctgttctgttc

SEQ ID NO: 14286 - protein, 133 aa, Panicum virgatum
  misc_feature: Ceres CLONE 1775167
  misc_feature (14)..(123): Pfam Name: Ribosomal_L32e Pfam Description: Ribosomal protein L32
MAVPLLTQKIVKKRVKQFKRPHLDRYKCLKPSWRRPKGIDSRVRRKFKGCTLMPNIGYGSDKKTRHYLPNKFKKFVVHNVSDLELLMMHNRTYCAEIAHNVSTHKRKEIVERAAQLDIVVTNKLARLRSQEDE

SEQ ID NO: 14287 - DNA, 996 bp, Panicum virgatum
  misc_feature: Ceres CLONE 1775184
  misc_feature: Encodes the peptide sequence at SEQ ID NO. 14288
aaccagatttgtcagaacgcgagctcctctcctaccctctctctctccctcgcgctccgaaaccctagccgcacgcaagctctcccctcccctcgcctcgcctcgccgcacccgccgcgcaggacgagccgggcgccatggccgcggagaattactggaggtacgccgacgcgcggcagcagcagcaggcgatggtggccgccgcggccgccgcggctgggatggcacccgcggcgacggtcaccgcgtcccagacggtcgggggaccggcggcgggaatgaacccgcaggcggccgccgccgccatggcgcagcaggccgccgcgccgcctctcaagcgcgcgcgccccgacttcggagatgtgtctggaggacaagacatgacaggatattatccacgtgaaactgacagggcaggttaccattcacttagagagaatgaagcgatcggagcttcttatgatcgttacttgcgcaatgggatgccctctgtcggtgccaatgacactagtagggctgctgggatgagtgctgggatcgctgctgggatgggtgctgggatggctgctggaatgggtgctgggatggctggctatggtgttgatgaccgccgtatgatgggtgttgtcggtatggacaacagagggatgggctatggtggcaggcctgagcctcctcttcctccggatgcatcaaacactttgtatattgagggcttacctgcaaactgcacacgccgggaggtttctcatatatttcgcccatttgtaggctttcgcgaagtgcgacttgttaacaaagagtccagacatcctggtggagacccacatgtgttgtgttttgttgattttgacaaccctgctcaagctacaattgctcttgaagcattgcaaggtgatgatacttatatttgtggatatggagcatgtatcagggttgattacttgactaacttttgtgacatgcaatttcccacgtgtgttcttgttaatttcc

SEQ ID NO: 14288 - protein, 286 aa, Panicum virgatum
  misc_feature: Ceres CLONE 1775184
  misc_feature (189)..(267): Pfam Name: RRM_1 Pfam Description: RNA recognition motif. (a.k.a. RRM, RBD, or RNP domain)
MAAENYWRYADARQQQQAMVAAAAAAAGMAPAATVTASQTVGGPAAGMNPQAAAAAMAQQAAAPPLKRARPDFGDVSGGQDMTGYYPRETDRAGYHSLRENEAIGASYDRYLRNGMPSVGANDTSRAAGMSAGIAAGMGAGMAAGMGAGMAGYGVDDRRMMGVVGMDNRGMGYGGRPEPPLPPDASNTLYIEGLPANCTRREVSHIFRPFVGFREVRLVNKESRHPGGDPHVLCFVDFDNPAQATIALEALQGDDTYICGYGACIRVDYLTNFCDMQFPTCVLVNF

SEQ ID NO: 14289 - DNA, 586 bp, Panicum virgatum
  misc_feature: Ceres CLONE 1775280
  misc_feature: Encodes the peptide sequence at SEQ ID NO. 14290
caaagcctcccaattagcctttcatcatatcatctcccttcttccaagatgtctggcagctggcgatcaacctgcaactgcggctcccagtggacgcgcggcaagatgtaccctgaccttgaggagaacagcaccagcagccctaatgccaccatcatcctaggcgtggccccggatcaacaagactggccagtacgaggcgggagccgactacggccagaccgcccaagcctgctagtgcggtaacagctgcagctgcaacccctgcaactgctgatttcgatgggggaacctcagaacacacctgcatgcatgcatgctagctactacctactactctgcttgggtgtgacttgatgatggaacaagagtaacgatgagcctgacccatcgtgtctcatgtatcggcttggctccggcctcatcaagcatacatgcgacgcctgcccctctgtgtgctttgcgtccgacctgtgtctgtatgtgttgatcattgcaaagaaaccatgcatgcatacatctctgcatgagtctctgtaatgatcggtccacagtgatgaatatataaaactggtttgcttcatct

SEQ ID NO: 14290 - protein, 65 aa, Panicum virgatum
  misc_feature: Ceres CLONE 1775280
  misc_feature (1)..(53): Pfam Name: Metallothio_2 Pfam Description: Metallothionein
MSGSWRSTCNCGSQWTRGKMYPDLEENSTSSPNATIILGVAPDQQDWPVRGGSRLRPDRPSLLVR

SEQ ID NO: 14291 - DNA, 756 bp, Panicum virgatum
  misc_feature: Ceres CLONE 1775304
  misc_feature: Encodes the peptide sequence at SEQ ID NO. 14292
atccacctccctcccttaccagaccaccggcgccggcgatggccgcacccctcctccgcggcctcgcgctcccgctgctgctgctcgccgcggccatcgcgctcgcgcccgcgccctcctccgccgccgccgcggcccgggcgtgcacgtacacgctgcgggtgaagacgtcctgcgcgtcgccggcgccgcggtcggccgacgccgtgagcgtcgcgttcggggacgcgtaccgcaacgaggcccacgcgccgcggctccccacgtcgggcgggcgcgcgctggagcggtgcggcaccgacacgttccgcgtgccgggcccctgcggctacggcgtctgctacctctacctccgccgcgccggccgcgacggctgggcgcccgagtgggcgcaggtcgtccagcccggcccgcgcgcgccggccgcggccaccttctacttcggcgacccgctgcccgacggcgtctggtacggccacgaccggtgccccaaggccagggacgctgccgccgccgccgctgacgatgatgagcgccgcccggcggcgaccaccgacggcggcaactcctcggcttcgcctcggggatgaaaccgccgatccaaccgcaaccctgacctgccagggaaccagagcattctcgacatcgtccatggattggtgcatcggggtcgcctagctctgcttctttgtgtgttcgcatcatctcaataaagcaaccattaataaaaataatgtttgccccctgtttgtgcgt

SEQ ID NO: 14292 - protein, 183 aa, Panicum virgatum
  misc_feature: Ceres CLONE 1775304
  misc_feature (17)..(150): Pfam Name: ATS3 Pfam Description: Embryo-specific protein 3, (ATS3)
MAAPLLRGLALPLLLLAAAIALAPAPSSAAAAARACTYTLRVKTSCASPAPRSADAVSVAFGDAYRNEAHAPRLPTSGGRALERCGTDTFRVPGPCGYGVCYLYLRRAGRDGWAPEWAQVVQPGPRAPAAATFYFGDPLPDGVWYGHDRCPKARDAAAAAADDDERRPAATTDGGNSSASPRG

SEQ ID NO: 14293 - DNA, 687 bp, Panicum virgatum
  misc_feature: Ceres CLONE 1775345
  misc_feature: Encodes the peptide sequence at SEQ ID NO. 14294
atcttccagccactccccattgaggcgatcagtgatcgagttcctcttgtgttggtgtccagagaatcgtactgtagctggagagctagcttaggtttcccatatggcttccaggatggcactcctgtgccttcttggcttgctggtaccgtcacctgccattgctgactccggcttctactaccagcttgctcttgtgtggcccggagcgtactgccagcacaccaacgccgggcgctgcaagccgaccaccggcgtgtcgccggcgagggacttctacgtctccggcttcaccatctacaacgccacgaccgacgctcccgagaccggctgcatcaacgccgctcctttcgaccctaacaagattaccggcgtccacggcctgttccagtactggagcaacatcaagtgccccaccaacaactgcaggagctactagaacaacgcctggaaaaagtcctgcgcctgctccggcctcgaggagaaggactacttcgaggcctccctctccttcctcaaccggatcaacccgctggtccgcctcaaggcccagcacatccagcctcacttcgggctgtacggcatgaaggctatcaagaatgtgctcaatgcgggcatcgacgcggcgccggtggtccagtgcagcaagggccccttaggcaagttccagctgttccagctctactc

SEQ ID NO: 14294 - protein, 107 aa, Panicum virgatum
  misc_feature: Ceres CLONE 1775345
  misc_feature: SWISSPROT Homolog: EC 3.1.27.1 Ribonuclease T(2)
MALLCLLGLLVPSPAIADSGFYYQLALVWPGAYCQHTNAGRCKPTTGVSPARDFYVSGFTIYNATTDAPETGCINAAPFDPNKITGVHGLFQYWSNIKCPTNNCRSY

SEQ ID NO: 14295 - DNA, 737 bp, Panicum virgatum
  misc_feature: Ceres CLONE 1775405
  misc_feature: Encodes the peptide sequence at SEQ ID NO. 14296
gttctgaacctcctcacctacctccctcccctccgctccgccggctatatcctcttctcgtcggtagctgtgaatttctttccggatacaggtccggaacaaagaagaattgcctcctcccctcgccgctttctctactcctgctttgcccctttccaccagcaccaccggcagggattctatatatagcctagctagatttttgccttgcagggctgtgtgttactgtcggagttggggctgagccttggacttggagatggcaagcttcaatgaagagaagagagcagctccgcagagggaggaggcaccttcccggagcaagtacggcggcatttcgccgaagaagcccctgatcagcaaggaccacgagcgcgcctacttcgactcggcagattgggtcctcggcaagcaaggcgcgaccagcagcaacggcgcgacggtcccggccgccgagcccctcaagcccaagctgcagcggacggcgtaccaccagctccccccgcgaaggccggcgtgcacgtcggagtagctggcgcggctcctgtctcgtcccgtcggcggcgttgcagctagctcgtgatgcctcacacagagtcgcactatagggagccaggatccgtggagttggggcgaattgggttgtaaatacggggacgcatgctgtcactgctcagcagtgtggagctatctgaaatgaagtgatcggtgcactcggcgtctcgtcttcaatcttc

SEQ ID NO: 14296 - protein, 90 aa, Panicum virgatum
  misc_feature: Ceres CLONE 1775405
  misc_feature (20)..(90): Pfam Name: Lg106 Pfam Description: Lg106-like protein
  misc_feature: Useful for biocontainment applications
MASFNEEKRAAPQREEAPSRSKYGGISPKKPLISKDHERAYFDSADWVLGKQGATSSNGATVPAAEPLKPKLQRTAYHQLPPRRPACTSE

SEQ ID NO: 14297 - DNA, 716 bp, Panicum virgatum
  misc_feature: Ceres CLONE 1775407
  misc_feature: Encodes the peptide sequence at SEQ ID NO. 14298
ctttgtcacccatggatcgttgatgatgctgtggcacctgatagacctattgattctgcttgttttgtcaaggttgaagcatttttcggcaatgaacaagctcaagaagatggcattgagggttattgctgaaagcctgtctgaggaagagattggaggcctcaaggagctgttcaaaatgattgatacagacaatagtggcactataacatttgatgagctgaaagatggcttgaaaagggtaggctcaaaattaacagagactgaaatccaggctctaatggaagcagctgatattgacaacaacggtacaattgactacggtgaattcattgcagctacgttgcacatgaataagctggagagggaggaaaacttggtttcagcattctcattttttgacaaagatggaagtggctttataaccattgatgagctgtcacaagcatgccgtgaatttggtcttgatgatgttcaccttgaggatatgattaaagatattgaccagaacaatgatggacaaattgactacagcgagttcacggcaataatgaggaagggcaatgctggtgcaacaggaaggagaaccatgaggaacagcttgcacttgaatcttggcgagctcttgaaccccagcaaaacctaacttatgcaggaaggccttgccgggtacattcgtctgaagttttggcgcgtcatcgacttgctatcaactg

SEQ ID NO: 14298 - protein, 214 aa, Panicum virgatum
  misc_feature: Ceres CLONE 1775407
  misc_feature (53)..(81): Pfam Name: efhand Pfam Description: EF hand
  misc_feature (159)..(187): Pfam Name: efhand Pfam Description: EF hand
  misc_feature (125)..(153): Pfam Name: efhand Pfam Description: EF hand
  misc_feature (89)..(117): Pfam Name: efhand Pfam Description: EF hand
  misc_feature: SWISSPROT Homolog: EC 2.7.11.1 Non-specific serine/threonine protein kinase
FVTHGSLMMLWHLIDLLILLVLSRLKHFSAMNKLKKMALRVIAESLSEEEIGGLKELFKMIDTDNSGTITFDELKDGLKRVGSKLTETEIQALMEAADIDNNGTIDYGEFIAATLHMNKLEREENLVSAFSFFDKDGSGFITIDELSQACREFGLDDVHLEDMIKDIDQNNDGQIDYSEFTAIMRKGNAGATGRRTMRNSLHLNLGELLNPSKT

SEQ ID NO: 14299 - DNA, 691 bp, Panicum virgatum
  misc_feature: Ceres CLONE 1775408
  misc_feature: Encodes the peptide sequence at SEQ ID NO. 14300
gtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgccgccgccgccaagcccaagaagaccgccgccgggaccaagcgcaaggcgccggagaagaaggtcgtcgcgaagccgaagaagtcccccgcggcgaaggccaaggccaagcccaagacggtcaagtcccccgcctccaagaaggcccggaaggttgccgcatgagatggttccgtaggtcgtagctctgatcgtggtgtgcgtgtccctaggagttgtacaaatgaagtgcgtgccccaagcgtctctgatatccgatgttgtgtttggcaggttcaatctatccaggtcggtgttagtgtaacagatggataggtttcttgggatggagatgtatctcgctctcttatatgatatgaagttgcagttcgccag

SEQ ID NO: 14300 - protein, 134 aa, Panicum virgatum
  misc_feature: Ceres CLONE 1775408
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAAADVEYRCFVGGLAWATDNASLQQAFASYGDVLDSKVITDRETGRSRGFGFVTFSTEQSMLDAIEAMNGKELDGRNITAAAAKPKKTAAGTKRKAPEKKVVAKPKKSPAAKAKAKPKTVKSPASKKARKVAA

SEQ ID NO: 14301 - DNA, 806 bp, Panicum virgatum
  misc_feature: Ceres CLONE 1775428
  misc_feature: Encodes the peptide sequence at SEQ ID NO. 14302
aaaagtcgcaacaaaaagaaaccaggctccgctcgagagagatcgcatctgcctgcctgcccaccttcccttcctccccaccccaccccggcgacgcggccgccccgagaccgagcaaccccaccgagagggagaggagcagaggaacagggagagcaagatgtcgtcggcgttcagcggcgatgagacggcccccttcttcggcttcctcggcgccgccgccgccctcatcttctcatgcatgggtgcggcgtacgggacggcgaagagcggcgtcggcgtggcgtccatgggtgtgatgcggccggagctcgtgatgaagtccatcgtgcccgtggtcatggctggtgtgctcggtatctacggcctcatcatcgccgtcatcatcagtaccgggatcaaccccaaggccaagccctactacctcttcgatgggtacgcccatctctcgtccgggcttgcttgtggcctcgctgggcttgccgctggcatggccattggcatcgttggtgatgctggtgtcagggcaaatgcacaacagccaaagctctttgtgggcatgatcctcattctcattttcgcagaagcgcttgctctctatggtctcatcgtgggcatcatcctctcatcccgtgctggccaatcccgtgcggattaggcgcttgctgctaccattctataactactgctgtgtttattacatgctgttttgagagaaacttgaactcgaggttcttgtctagtttattcatgttaccatgtatcaatgaaacatttgtagctgaaggaaggtggcacttccagtc

SEQ ID NO: 14302 - protein, 165 aa, Panicum virgatum; identical to SEQ ID NO: 10269
  misc_feature: Ceres CLONE 1775428
  misc_feature (93)..(158): Pfam Name: ATP-synt_C Pfam Description: ATP synthase subunit C
  misc_feature (14)..(79): Pfam Name: ATP-synt_C Pfam Description: ATP synthase subunit C
  misc_feature: SWISSPROT Homolog: EC 3.6.3.14 H(+)-transporting two-sector ATPase

SEQ ID NO: 14303 - DNA, 560 bp, Panicum virgatum
  misc_feature: Ceres CLONE 1775438
  misc_feature: Encodes the peptide sequence at SEQ ID NO. 14304
cagaaggggcagcaagaacaggccacagaaagaacaatcccagcaatggcagcaaggtgtgctctttctgccccatccagcgtggttcgccaacccctctacggcaacaagctcgccaagaatctcatcactccatgcctgccgtcgccaagagccgtgagggtgagagtgaatgctgcaaagcttcctccaggggttgaggtgcccagggtgcagccgaagctgagcgagcccttcttggggttcacccagactgccgagatctggaactccagggcctgcatgatgggcctcatcggcaccttcatcgtggagctggtgctgaacaaggggattcttcagataattggggtggaggtggggaagggcctcgaccttcctctttaattgccattggcaaagctgattgcaagccttactctctctctctctctctcttgaaacctaggagtacctattatattgctctaaacattattctgtcgaatatagatactcatgcaattcttttgcgtaaccatatgacagagttttttaagttctcaaagcgatcctcaacc

SEQ ID NO: 14304 - protein, 113 aa, Panicum virgatum
  misc_feature: Ceres CLONE 1775438
  misc_feature: SWISSPROT Homolog: EC 4.99.1.1 Ferrochelatase
MAARCALSAPSSVVRQPLYGNKLAKNLITPCLPSPRAVRVRVNAAKLPPGVEVPRVQPKLSEPFLGFTQTAEIWNSRACMMGLIGTFIVELVLNKGILQIIGVEVGKGLDLPL

SEQ ID NO: 14305 - DNA, 864 bp, Panicum virgatum
  misc_feature: Ceres CLONE 1775460
  misc_feature: Encodes the peptide sequence at SEQ ID NO. 14306
gactcctccaaacccttgcgccggcgcctccacttcgcttcctcacttcatctcctcgcgctcagggtccggcgccgaagggaggcaagatgtacaccgcgaggaagaagatccagaaggagaagggcctcgagccctccgagttcgaggactccgtcgctcaggccttctttgacctggagaatagcaaccaggagctcaagagcgacctcaaggacctctacatcaacaatgctatccagatggacgttgccgggaacaggaaggctgttgtgatccacgtcccataccgcctgcgcaaggccttcaggaagatccacgtcaggcttgtcagggagctggagaagaaattcagtggcaaggatgtagtagttgttgccacaagaaggattgtgaggccgccaaagaagggttcagctgttcagcgccctcgcaccaggactctaactgctgttcatgatggaatcttggaggatgttgtgtacccagccgagatagttgggaagcgtgtcagataccgtttggatggtgccaagatcatcaagatcttcttggacccgaaggagaggaacaacactgaatacaagctggagactttcaccgcagtctaccgcaggctttgtgggaaggacgtggtctttgagtaccctgtagctgaaaacgcataaagctgaagtcgtggatatctccatttcatttctttgaagcaggatgttttggttggggtctccgactagtttgctccctatgtactgcaaaaaccatagttttgatgccaaagttattgcttagatgttcggtacctgggaattggcagtggatgtgaactatgtaagttttgagcatttaaattaaacctttgcc

SEQ ID NO: 14306 - protein, 192 aa, Panicum virgatum
  misc_feature: Ceres CLONE 1775460
  misc_feature (6)..(191): Pfam Name: Ribosomal_S7e Pfam Description: Ribosomal protein S7e
  misc_feature: Useful for making plants with modulated biomass
MYTARKKIQKEKGLEPSEFEDSVAQAFFDLENSNQELKSDLKDLYINNAIQMDVAGNRKAVVIHVPYRLRKAFRKIHVRLVRELEKKFSGKDVVVVATRRIVRPPKKGSAVQRPRTRTLTAVHDGILEDVVYPAEIVGKRVRYRLDGAKIIKIFLDPKERNNTEYKLETFTAVYRRLCGKDVVFEYPVAENA

SEQ ID NO: 14307 - DNA, 812 bp, Panicum virgatum
  misc_feature: Ceres CLONE 1775494
  misc_feature: Encodes the peptide sequence at SEQ ID NO. 14308
cgcagccgccgccgccctcgaactcgaagcccgtcgcctgcgcgtcatccccaccgcgtcgccgacccttgccgccggtctcctacctccgccaccatggggaagacacgtggtatgggagctgggcgcaagctcaagacccaccgcaggaaccagaggtgggctgacaaggcatacaagaagagccacttgggtaatgaatggaagaaaccctttgctggatcatctcatgccaagggcatcgttctggagaagatcggtattgaggccaagcagccgaactctgccatccgtaagtgtgctcgtgttcagctggtgaagaacgggaagaagattgctgcctttgtgccgaatgatggttgccttaactacattgaggagaatgatgaggtgctgattgctggatttggtcgtaagggacatgccgtaggagatattcctggtgtcaggttcaaggttgtgaaggtttctggtgtgtccctgctcgccctcttcaaggagaagaaggagaagccaaggtcatagattgcttttggataggcaagagtggggtagactgtcaatgctctattatcaaacttagttgtgctagcaagaccccgcacagtgccggaagcctacgacactgggtacgctctttagttgtgctagcaagagagatgtatcttctgttaacattgccattgagagttttgtttccactttgaagatattaatgttgcattgttgcttcaagctggggtttcgacccagtctgtcgtgacttgccttcagtttgagaaatctcttgtttttttagcctgcctggcttg

SEQ ID NO: 14308 - protein, 142 aa, Panicum virgatum; identical to SEQ ID NO: 12276
  misc_feature: Ceres CLONE 1775494
  misc_feature (8)..(141): Pfam Name: Ribosomal_S12 Pfam Description: Ribosomal protein S12

SEQ ID NO: 14309 - DNA, 502 bp, Panicum virgatum
  misc_feature: Ceres CLONE 1775504
  misc_feature: Encodes the peptide sequence at SEQ ID NO. 14310
aaaaaaaaatccgcaaacgcaagcttcacgcacagcctctctccccgcagcttctcagccgggcttcacctgcgaacccgcctcgatcgatcagcgttccacgcggagcaggcagatggccgccacgatgaagctccggatcctcgccatcgccgtcgccgccgcgtcgtgcctggtcgcgactgccgccgcggccgagggcccagcgcccgccccgacgtccggcgcgccgtccatggccgcgccggccgttgccgccgcgtccctgaccgcgctcgtcttcgcgctacctcttctaagaagcgccgtggacggcgttgcctgaactgccaaatcgttttcctgctcagagatttcttcttctcggtgttgtctttgctcttgttgggatggatggatgggtatgtaatgaagtgttcatttttttatatgaatcttgtcatctcagtacaaggacatagtaaatagagagagctgcggtttggttcttttttttacacac

SEQ ID NO: 14310 - protein, 69 aa, Panicum virgatum
  misc_feature: Ceres CLONE 1775504
  misc_feature: Useful for making plants with altered cell wall content and/or composition
  misc_feature: Useful for making plants with altered carbohydrate content
MAATMKLRILAIAVAAASCLVATAAAAEGPAPAPTSGAPSMAAPAVAAASLTALVFALPLLRSAVDGVA

SEQ ID NO: 14311 - DNA, 651 bp, Panicum virgatum
  misc_feature: Ceres CLONE 1775535
  misc_feature: Encodes the peptide sequence at SEQ ID NO. 14312
cttggtcactctcaattccgatccgtcgctccgcctcctgctgctgaccacccccggcccatcgaatcgctcaattccatccatggataatcaccggcggcagagcagcaccagcagcagcagcaccaccaccactaataataataagaagacggctgagctggaccctgtgctgcactcgatcgggttcgagatcgaggaggtgtcgccggcgcagctgacgggccgcctccccgtcacggccaggtgctgccagcccttcaaggtgctccacagcggcgtctccgccctcgtcgccgagggcctggccagcatgggcgcccacatggcctcgggctaccgccgcgtcgccggagtcagcctcagcatcaaccacttccgcagcgccgccgtgggggacgtcgtcctcgcccgcgccgccccgatccacgtcggccgctcaacccaggtgtggaaggtgaagctgtggaaggaggagccatcggcgccagggaacaagggtcctcagatctccgagtcgagggtgacgctgctctgcaacctacccgtgccggagagcctcaagaacgccggcgacgcgctcaagaagtacgccgcccccgccaccagcagattgtagatacggagtaataattaattaagcttacacac

SEQ ID NO: 14312 - protein, 178 aa, Panicum virgatum
  misc_feature: Ceres CLONE 1775535
  misc_feature (60)..(137): Pfam Name: 4HBT Pfam Description: Thioesterase superfamily
  misc_feature: Useful for making plants with modulated biomass
MDNHRRQSSTSSSSTTTTNNNKKTAELDPVLHSIGFEIEEVSPAQLTGRLPVTARCCQPFKVLHSGVSALVAEGLASMGAHMASGYRRVAGVSLSINHFRSAAVGDVVLARAAPIHVGRSTQVWKVKLWKEEPSAPGNKGPQISESRVTLLCNLPVPESLKNAGDALKKYAAPATSRL

SEQ ID NO: 14313 - DNA, 522 bp, Panicum virgatum
  misc_feature: Ceres CLONE 1775536
  misc_feature: Encodes the peptide sequence at SEQ ID NO. 14314
aaaacacttgcgccggcgagcgggcggcacgcaatcggcgcggcggtccttctcgcttcagagctcgctccctcaacctaacctcatttcgtccccaagccgaaccccgagaatcggttggggaattcgaattctcgcacctcgccgcgcgcgcacgcgagaccgcggggatggccgcggcggccgtggggaagaggttgctcgacacgggctggctcgccgcgcgctccaccgaggtcgcgctcaccggcgtccagctcaccaccacccagccgccggccgtcgaccccgaacccgccgcgccatggatgagcgccgccgtccccggcaccgtgctggggacgctgctcaagaacaagctgatccccgaccccttctatgggctgaacaaccaggccatcgtcgacatcgccgacgccgggagggagtactacaccttctggttcttcaccacgttccagtgtgccccgtcaggaaatcagcacgtgactttaaatttccaaggaataaactactcagcag

SEQ ID NO: 14314 - protein, 117 aa, Panicum virgatum
  misc_feature: Ceres CLONE 1775536
  misc_feature: SWISSPROT Homolog: EC 3.2.1.152 Mannosylglycoprotein endo-beta-mannosidase
MAAAAVGKRLLDTGWLAARSTEVALTGVQLTTTQPPAVDPEPAAPWMSAAVPGTVLGTLLKNKLIPDPFYGLNNQAIVDIADAGREYYTFWFFTTFQCAPSGNQHVTLNFQGINYSA

SEQ ID NO: 14315 - DNA, 741 bp, Panicum virgatum
  misc_feature: Ceres CLONE 1775555
  misc_feature: Encodes the peptide sequence at SEQ ID NO. 14316
acatttgagctcgtctcggtttctttcttgctctgttccgctgctgctgctgcttcttcttcatcatctccggtgggctgcgcgatggagacggcgttagcgctggcggccgccgtgctcctcttgtcctccacgctcgttgcttcagagttctgcgtgtgccggtccgaccagccgacggaggcgctgcagaaggtgatcgacttctcgtgcggcaacgacgcggactgctcgtccatcctgcagggcggcgggtgctacaaccccaacaacgtcgccgcgcactgctcctgggccgccaacagctactaccagaacaacaaggccaagggcgccacctgcgacttcggcggcgccgccaccatctccaccgccgaccccagtttctccgggtgcactttcccttcgactgccagtgcttccgggacggcgggcaccacgaccgtgggcggcgcgacgccgacgacgggcaccctgagccccggcgtgggcaccgggttcaacggtacggcggtgggcggcggcggcctgggcccggtgggcaccatggacagcgcttcggccggcctgctgctccccggcgccttcttcctcgccgccgccatcctctcgctcctagccctgcactagctccccctagctagctcctccgttctcagtagttcttggtccagtagttgttccttctctgaaccacgtcaagaaaggaagaatgggatgtgaattggttggaggggttcc

SEQ ID NO: 14316 - protein, 181 aa, Panicum virgatum
  misc_feature: Ceres CLONE 1775555
  misc_feature (22)..(106): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered alkaloid content
METALALAAAVLLLSSTLVASEFCVCRSDQPTEALQKVIDFSCGNDADCSSILQGGGCYNPNNVAAHCSWAANSYYQNNKAKGATCDFGGAATISTADPSFSGCTFPSTASASGTAGTTTVGGATPTTGTLSPGVGTGFNGTAVGGGGLGPVGTMDSASAGLLLPGAFFLAAAILSLLALH

SEQ ID NO: 14317 - DNA, 971 bp, Panicum virgatum
  misc_feature: Ceres CLONE 1775593
  misc_feature: Encodes the peptide sequence at SEQ ID NO. 14318
agtgtaccctcaattccacaaaccacagtgtcccgaacttcatcaccgagcaaatggtctctcacaccgccctcccccttctccttcttcctttcctcttcgctgcggctgccgacgacctcgcccctggtccatccccacccggcgagctcaacctgaccagtatccttgaaagtggcgggcagtactcgacgctgctccgcctcctgcaggccaccaagatctccgagcagctgaccagccagctcaagaacacgtacgacggcctgaccttcttcgcgcccaacgacaacgccttcaccaagctcaagaccggtacgctcaacggcctcaccgaccagcagaagatccagctcctgctctaccacgtcctgccccgctactacagcgtcaccaccttccagacggccagcaacccgctgcccaccgaggcgtcgggccccggcggcatgtacagcgtcaacgtgaccacaaccaccacgagccacctggtgaacatgtccacgggcgtcgtcgacgtgcccatcagcagcactctgtctgccaagttcccgctcgccgtctactccgtcgacgacgtgctgctgcccgtgcagctgttcggtacgtctcacaagggcaaggcatcagcgccggcgcccgcgggacaggccggtgcagcggctgggaaggcgagcgcggggaagaagggtggtgtcccgaagagcgacgtggcagcggagccgtcagcggcggaggaggcagaagacagcaacaacgcagcggctggcagagggagtgcggggtggacgaccattgctgcttttgctctcatcatggccattgttaatctggtcggcgcttgagaagtgtatgcttgcttattattgtccttttgtttttctcgtatttcacagtccatttactaagtttagttactatgtcctggttttgtacgtaccattgtgattatgatgatatggttcacttgt

SEQ ID NO: 14318 - protein, 263 aa, Panicum virgatum
  misc_feature: Ceres CLONE 1775593
  misc_feature (44)..(179): Pfam Name: Fasciclin Pfam Description: Fasciclin domain
  misc_feature: Useful for making plants with altered carbohydrate content
MVSHTALPLLLLPFLFAAAADDLAPGPSPPGELNLTSILESGGQYSTLLRLLQATKISEQLTSQLKNTYDGLTFFAPNDNAFTKLKTGTLNGLTDQQKIQLLLYHVLPRYYSVTTFQTASNPLPTEASGPGGMYSVNVTTTTTSHLVNMSTGVVDVPISSTLSAKFPLAVYSVDDVLLPVQLFGTSHKGKASAPAPAGQAGAAAGKASAGKKGGVPKSDVAAEPSAAEEAEDSNNAAAGRGSAGWTTIAAFALIMAIVNLVGA

SEQ ID NO: 14319 - DNA, 716 bp, Panicum virgatum
  misc_feature: Ceres CLONE 1775602
  misc_feature: Encodes the peptide sequence at SEQ ID NO. 14320
atcgaaccaaaagctccgatccgtccttacgtgcttaaccacctacacagctcacactactcaggtcactcgtacacaggcagtgcaagctagcatggcgcacaagctcccagccaccctcgtcgccgccttcgccgtcctccttgccctcgccgcgccgctggtggtcatcgccggcgaccccgacatgctccaggacatctgcgtcgccgactaccattccctcaagggcccgctgaggctgaacgggttcccgtgcaagagggcggagaacgtgacggcgcacgacttctcctccgccttcaacagccagctgccgggcacgcaggccgtcgccgccacgctcttcggcgcctcgccgccggtgcccgacgacgtgctcgccagggcgttccagatcgacgccggcctcgtcgaggccatcagggccaagttcccggcgcccatgtagtaggcgcgcgcatgctggccctgccaatgccatgcaagcacatcgatggtgatttcagtccgagcgatacgattgtgtgctagcgcgctgtaataaagcatgatccgtcaaataattggttgggtttgtttcgtgtgtgtggtcatgcatgccctggcctcaagtcatggacacttcactgttacgttgttgcttttcaatttcagcgtgaaccatttgggtaaggtgtggtatatgcaatggaaatgaatgctctgattgtctc

SEQ ID NO: 14320 - protein, 118 aa, Panicum virgatum
  misc_feature: Ceres CLONE 1775602
  misc_feature: SWISSPROT Homolog: EC 1.2.3.4 Oxalate oxidase
MAHKLPATLVAAFAVLLALAAPLVVIAGDPDMLQDICVADYHSLKGPLRLNGFPCKRAENVTAHDFSSAFNSQLPGTQAVAATLFGASPPVPDDVLARAFQIDAGLVEAIRAKFPAPM

SEQ ID NO: 14321 - DNA, 571 bp, Panicum virgatum
  misc_feature: Ceres CLONE 1775642
  misc_feature: Encodes the peptide sequence at SEQ ID NO. 14322
gccccctcgaagcaatcgactggaattggaaagaagcgagggacggacgagagcagcggcgccgtcgccatgggtctgcaggaggaatttgaggagcacgccgagaaggccaagaccttgcccgactctactacaaatgagaacaagctgatcctctacgggctctacaagcaagcaaccgttggtgatgtcaacacagggcgtcctggcttcttcgacccaaaaggcaaagctaaatgggatgcttggaaggctgttgaagggaagtccaaggaggaagcgatgactgattacatcaccaaggtgaagcagctgctggaggaggctgctgcatccacttcctaggctacgaaaacaccaccatccgtagtgctgcgtacatcaataagtaataaacattgttatctgtcagatggctctcggtctcaattgttggtcgtggtggatgttcagtgtcgtttacggctgtaaaactcttgtgaaaacaaatggatgctgtctcatctaagcactgtatggatcttcatctctgttaactaaagaatttgttgtggattctgaattatgagaa

SEQ ID NO: 14322 - protein, 91 aa, Panicum virgatum
  misc_feature: Ceres CLONE 1775642
  misc_feature (3)..(87): Pfam Name: ACBP Pfam Description: Acyl CoA binding protein
  misc_feature: SWISSPROT Homolog: EC 5.3.3.8 Dodecenoyl-CoA isomerase
MGLQEEFEEHAEKAKTLPDSTTNENKLILYGLYKQATVGDVNTGRPGFFDPKGKAKWDAWKAVEGKSKEEAMTDYITKVKQLLEEAAASTS

SEQ ID NO: 14323 - DNA, 840 bp, Panicum virgatum
  misc_feature: Ceres CLONE 1775669
  misc_feature: Encodes the peptide sequence at SEQ ID NO. 14324
gaccaaacaaccgcagcgagcgaaaccaaactgctctcgtctcggctctccactctccctcccccagcagcccgcaagctaagcaaggcaataagaggcggccatgagcgtggtggtcctggacggctcgacggtgcgcgccttcgtggcggacgaggcggcgttcgcgcgcagcgtggattcgcgcttcgcggcgctggacgccaacggcgacggcgtgctgtcccgcgccgagctccgccgcgcgctcgagtcgttccgcctcctcgacggcgccggcttcgggtccgcccggccggcgccgctccccgccgaggtcgccgcgctctacgacgccgtcttcgagcaattcgacgctgaccacagcggcgccgtcgaccgcgccgagttccgcgacgagatgcgccgcatcatgctcgccgtcgccgaggggctcggctcgcagccgctccaggtcgccgtcgacgacgagggcggcagcttcctgctcgaggccgccgagcacgaggccgccgcgatcgccgccaagctcgacgcggagcgcaaggcggaggccgccgcagctgctgccgacgccgccgagtgacgtgccgcgtggggtggggcggtggctgaccaccttgtgctctgcgctcgctgctgtactgcttctagatgttggtgtactagtactaatacgtgtcagccgttgcgctgctacacgtgtacgtgaacagaaaaccggccggtgccagtgcaccctgcagggaaatgactacgagagttctactatgtaccgcttgtgaaaggaataaaacggcttccaagtctcggatgtaacttggcggcaacttgtccacc

SEQ ID NO: 14324 - protein, 160 aa, Panicum virgatum
  misc_feature: Ceres CLONE 1775669
  misc_feature (24)..(52): Pfam Name: efhand Pfam Description: EF hand
  misc_feature (75)..(103): Pfam Name: efhand Pfam Description: EF hand
MSVVVLDGSTVRAFVADEAAFARSVDSRFAALDANGDGVLSRAELRRALESFRLLDGAGFGSARPAPLPAEVAALYDAVFEQFDADHSGAVDRAEFRDEMRRIMLAVAEGLGSQPLQVAVDDEGGSFLLEAAEHEAAAIAAKLDAERKAEAAAAAADAAE

SEQ ID NO: 14325 - DNA, 907 bp, Panicum virgatum
  misc_feature: Ceres CLONE 1775671
  misc_feature: Encodes the peptide sequence at SEQ ID NO. 14326
ctctcccgtctgcctctgcctccggtatagtatctatccggactcccatcctgtgtcccggccggctgtttctttcattgatccttcatcgatcatcagagatcagatcagtgtgtgcgtaggcttgtagtagaactgacaagcaagttcctccatcgatctctccaccctcgctcctggtacgtgtcatcattcctagctagccatcgtgtatggtgatgacgggggcttttgttcctgtggcggtgatggcggcgcttctggcggtggccgccgtgatgatggaggcggccgcggcggcgacgtacacggttggcgcgccggacgggctgtgggacatgcagaccgactacgcccagtgggtcaagaccaagaccttccaccccggcgacaagatcacgttcacgtactcgccggagctgcacgacgtggtggaggtgacggaggcggggtacgccgcctgctccagcgccaacaacatctccgccttccgcaccggcaacgacgtcgtggcgctcgccgccgttggcacgcgctacttcctctgcggcctcacgggccactgcgacaacggcatgaagatccgcgtcgacgtcgtctcctccgcgcctggtcccgccgccgcggggccggcgtccgccgccgcaccgcccttggcccgccggtgggtgccggcttccgccgggatcgctgccgccacgttgctgctgccgcgcgctgtcgtcgcgcggcggctttggtagctacgtgttagaggcgtcgtcttaatcttgtactactactattactatttttttagtatttgttgttgtgttgtgtggatttgtagttttgtttcagctgctacgtgtatgtatattttgttattatgatttcaaaatagtctatagatatcttcttggggatt

SEQ ID NO: 14326 - protein, 176 aa, Panicum virgatum
  misc_feature: Ceres CLONE 1775671
  misc_feature (41)..(122): Pfam Name: Cu_bind_like Pfam Description: Plastocyanin-like domain
MVMTGAFVPVAVMAALLAVAAVMMEAAAAATYTVGAPDGLWDMQTDYAQWVKTKTFHPGDKITFTYSPELHDVVEVTEAGYAACSSANNISAFRTGNDVVALAAVGTRYFLCGLTGHCDNGMKIRVDVVSSAPGPAAAGPASAAAPPLARRWVPASAGIAAATLLLPRAVVARRLW

SEQ ID NO: 14327 - DNA, 842 bp, Panicum virgatum
  misc_feature: Ceres CLONE 1775748
  misc_feature: Encodes the peptide sequence at SEQ ID NO. 14328
gagtcgataagatcgagctcggggaggttggggcgcaggaaaaaaaaatcatctccaatctccaaccaaactaaccctagcagcagccggcggttaggatttcgagcgagatggcggcggcggcgaggcagcgcgggacggtgaagtggttcaacgacaccaagggcttcggcttcatctcccccgaggacggcagcgaggacctcttcgtccaccagtcgtccatcaagtcggagggcttccgctccctcgtcgagggcgaggaggtcgagttctccgtctcggagggcgacgacggccgcaccaaggccgtcgacgtcaccggccccgacggatccttcgtcaagggcggctccggcggcggcggcgaccgctcctgctacaactgcggccagagcggccacatggcgagggactgcaccgcgtgagatcgggccggatcacgccacgccactacccggtggtgtagcctccccatagatctcgcctaagcctctcactgtgtctcgttcgtcggagcatcgctttagttttgccgatctgggcccgagcgcccgcctccttgctatagaggagcccagccgcctttttttcttctttcgtttcgcttttcatcttggattcggttcgtaggggaactgccgctcaggttatcatcgtgtgcttggtgcttttgctggtcgttggtcgttgtcgtcgtcgtcgttaaggttaagaaggacatcaagaagtgagatggattggttttgtgttgcttgaggagatgacaagatctgcctcctttttttgtggtttgctgctcctgatggaaaagattattattattactattatcctcgatt

SEQ ID NO: 14328 - protein, 105 aa, Panicum virgatum
  misc_feature: Ceres CLONE 1775748
  misc_feature (6)..(73): Pfam Name: CSD Pfam Description: 'Cold-shock' DNA-binding domain
  misc_feature (88)..(105): Pfam Name: zf-CCHC Pfam Description: Zinc knuckle
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 1126 in the 11/479,226 US patent application
  misc_feature: The sequence is a functional homolog of SEQ ID NO 2410 in the 10/374,780 US patent application
  misc_feature: The sequence is a functional homolog of SEQ ID NO 492 in the 10/412,699 US patent application
  misc_feature: The sequence is a functional homolog of SEQ ID NO 552 in the 10/225,066 US patent application
  misc_feature: The sequence is a functional homolog of SEQ ID NO 468 in the 11/479,226 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
MAAAARQRGTVKWFNDTKGFGFISPEDGSEDLFVHQSSIKSEGFRSLVEGEEVEFSVSEGDDGRTKAVDVTGPDGSFVKGGSGGGGDRSCYNCGQSGHMARDCTA

SEQ ID NO: 14329 - DNA, 845 bp, Panicum virgatum
  misc_feature: Ceres CLONE 1775769
  misc_feature: Encodes the peptide sequence at SEQ ID NO. 14330
ggcatcgtcgtcatttcttacactgctaaactactctattgctagctagctctagccggggaacgaacactggtcttcgccatggagtgcacctcaagaaccgggaggcggctctcgtgctgcctcctccttgtcggcgtcgtcctgctggcctcctccccgggctcggcggccgcgcctcgccggctgctgcagacctgcctagggcaggacttcgacgtgccgcacgcgcacctccgcgccaagaacgacgtgcggccgctcaagtacacgcaggagctctccgaccgggcggcggcgtgggccgcccagttcaaggacaactgcgcggccgccgcgccggcgccgggcatcaacgttttcctgggcaacgcgggcaccacctggttgcccagcgacgccgtcgccgcgtgggccgaggaggagcagcacttcgactacggctccaacacctgcgccgacggcaagggctgcggccgctacacgcagatggtgtggcggggaagcaaggagttcggctgcgccaccgtcgactgcgcctccagggagacgctcatggcgtgccactacgagccgcagggcaacatcatgggccagaagcccttctgatcccatgcgatccctcgccggcagccggcggcggagcaccgggaaccatggtgccacactatcgctcctaatcatgctttgagctgtttttcatttcctcttatacctagctaattatttgttgagagttcagcaagatgatatgtgccatgagagtgacgagcttataagtttgtcctcgtttgttttgttcatggcatgatctcatgagaaccaaacctgtctcctcgtatctc

SEQ ID NO: 14330 - protein, 175 aa, Panicum virgatum
  misc_feature: Ceres CLONE 1775769
  misc_feature (45)..(163): Pfam Name: SCP Pfam Description: SCP-like extracellular protein
MECTSRTGRRLSCCLLLVGVVLLASSPGSAAAPRRLLQTCLGQDFDVPHAHLRAKNDVRPLKYTQELSDRAAAWAAQFKDNCAAAAPAPGINVFLGNAGTTWLPSDAVAAWAEEEQHFDYGSNTCADGKGCGRYTQMVWRGSKEFGCATVDCASRETLMACHYEPQGNIMGQKPF

SEQ ID NO: 14331 - DNA, 1041 bp, Panicum virgatum
  misc_feature: Ceres CLONE 1775786
  misc_feature: Encodes the peptide sequence at SEQ ID NO. 14332
gctcttttctagaaacgcgagtcgtttcccactcggtccttctccgcctcgcatccgagatctggatctcgggggcgtcacccgcctccacctacctaccgccggccgccggctccagctcccgcgctgccggccgccgccgccgccgccggtcgtctcctccctgccgcgcccatcctccctctcctccatgagcgcgcggcgcaggcaggcccgccaggaagccagtctctgctcccggccgctagtcctctccgcctgctgcgccctccggctgtgaccgccgccgccagctctctcctccctgctgcgcccgccctgcctctcctccatcgagcaagcaagtgcaagcaggccgcccttgtcctccatcgcaggcaccaggaagcgcggccctcgccagcaagctccgccctcctccctccatcgaatcactggtggtgagtagaaatggcggcgagatcagcagcactctgcgtcgtcgcgctggtcgtggccgccatggtgctactggcaccgacgcaggcgagcttcatctacaccgaggaggacctcgcgtcggatgattccatgtgggcgctgtacgagcgctgggccgcgcaccacgaggtggcgtgtgacaagaccacgcgcttccccatcttcaagaagaacgcgcgcgagctcctcgacaagcagcgcaacaagggaaagtccttcgccgccctcaacatcttcggcgatactacctacgatgaggtcatcactttttggacgggggaaagggagatcgatgaacaaaattactttgttgattgcgaccgggttaggccagagttgttacatttggttaaaggctgttagtatctttgattgtggagccgtgttggccaggttgtgagccgtgcctgttggaggtcgccttgctttatagtgtgtgagctgtgcctgttggagatcgaggaaccaaattcctttgttgattaagctgttttgtatcttgcttcaactttcattttagtaataaaatcctgtaggggcctcggcccttccagttcattc

SEQ ID NO: 14332 - protein, 130 aa, Panicum virgatum
  misc_feature: Ceres CLONE 1775786
  misc_feature: SWISSPROT Homolog: EC 3.4.22.50 V-cath endopeptidase
MAARSAALCVVALVVAAMVLLAPTQASFIYTEEDLASDDSMWALYERWAAHHEVACDKTTRFPIFKKNARELLDKQRNKGKSFAALNIFGDTTYDEVITFWTGEREIDEQNYFVDCDRVRPELLHLVKGC

SEQ ID NO: 14333 - DNA, 1097 bp, Panicum virgatum
  misc_feature: Ceres CLONE 1775788
  misc_feature: Encodes the peptide sequence at SEQ ID NO. 14334
acagtcacagtactgctctgcgctgctcaggtcagaacacgcagaggcgcggcaacagagaggtaagctcgtgccgagcaagaagacacgaaggagctgaaaggagaacgagttcgagagggagccggccgggcaacaatggctctgctcccgctcttcctctcgctcctcctcgtgtcctgcgcggcgcagtcgccggcctcgtcgccgtccgcgtccaaggctcttccggtcagcgcctcggcgccacaggcctccatcgcgccaccgaccacggcagcctcggcgccgcaggcctccgtcgcgccaccgacaacggcaggctcggcgccgcagttctcgatcgcgccaccgacaaaggcagcctccgcgccgcgggcctctgccgcaccaccgaccacggccgcctcgccgcagctggctgccacgtcacctcccgttgcctctccgccactactagccgccgccgcgcctcctgtctctgcgacccctccagccaccttacctccgctcgcatcgccacccgcggccacgccgcctaccgtggccgcgccagcacccgcgatgccggctccagtggcctccccgcccctggcaatgccaccggcggcgcttcctccgtccaccctccctccagcaatggcgccgacgcctcttctcgctgccccgataatgccgcccaccgccacgcccgtcacggctcccgctccagcccccgtgtcgccggctccgagcgtcgccccgacaccgtcgcccacagaggccccgaccccgtcgccggctctggcgccggagctggcgcccgcgctagcaccttcgctggcgccgctcagctcggtgtcggtgagcccgtcgctggcgccgggtcccgcgctcgctacggaggacgagtcggcggcgccgagcgcgcgcaccgttggcggcgccgcgctggcggccttggcggccgccgggctcgtggtcttgttctaagtagagctgcgtttaccgtcgcttccgtactgctcgtcgcacgatctcgttctcttgttcgcgttttatggttgcatgtatgattcttgctgtaaaacacattgataatttatttctatttacgc

SEQ ID NO: 14334 - protein, 277 aa, Panicum virgatum
  misc_feature: Ceres CLONE 1775788
  misc_feature: Useful for making plants with altered cell wall content and/or composition
MALLPLFLSLLLVSCAAQSPASSPSASKALPVSASAPQASIAPPTTAASAPQASVAPPTTAGSAPQFSIAPPTKAASAPRASAAPPTTAASPQLAATSPPVASPPLLAAAAPPVSATPPATLPPLASPPAATPPTVAAPAPAMPAPVASPPLAMPPAALPPSTLPPAMAPTPLLAAPIMPPTATPVTAPAPAPVSPAPSVAPTPSPTEAPTPSPALAPELAPALAPSLAPLSSVSVSPSLAPGPALATEDESAAPSARTVGGAALAALAAAGLVVLF

SEQ ID NO: 14335 - DNA, 571 bp, Panicum virgatum
  misc_feature: Ceres CLONE 1775796
  misc_feature: Encodes the peptide sequence at SEQ ID NO. 14336
aacacctcgtacagttcatcaagtaaagccacatcagatcacacacaatctagctgcagaaatggcgtcgacggtggcgagcctctctaccccggcggcggcctttgcggccacagacgtagtcccgaggaggaagatcgccggccgcgtctggttccccgtggcgcgccgcgtcggcttcgcggtgaggtcgagcgggccggggacgccgccggggatctcggacaaggtgtcagagagcatcaagaaggcggaggagacgtgcgcggacgagaaggtctccggagagtgcgcggcggcgtgggacgaggtggaggagctcagcgccgcggcgagccacgcccgggacaagctcaaggagaacagcgacccgttggagaactactgcaaggagaaccccgagaccgacgagtgccgcatctacgacaactagaccatgcctgtatccagtggcggagccaggggggctggcagagatctggctactgatgctaatgaaatcaatcttgatgagatcaaggatcgggcgcgctaggctctatcctgcatctcataaccattcataatggac

SEQ ID NO: 14336 - protein, 123 aa, Panicum virgatum
  misc_feature: Ceres CLONE 1775796
  misc_feature (53)..(123): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)
MASTVASLSTPAAAFAATDVVPRRKIAGRVWFPVARRVGFAVRSSGPGTPPGISDKVSESIKKAEETCADEKVSGECAAAWDEVEELSAAASHARDKLKENSDPLENYCKENPETDECRIYDN

SEQ ID NO: 14337 - DNA, 453 bp, Panicum virgatum
  misc_feature: Ceres CLONE 1775796-R
gcccctgccagcccccctggctccgccactggatacaggcatggtctagttgtcgtagatgcggcactcgtcggtctcggggttctccttgcagtagttctccaacgggtcgctgttctccttgagcttgtcccgggcgtggctcgccgcggcgctgagctcctccacctcgtcccacgccgccgcgcactctccggagaccttctcgtccgcgcacgtctcctccgccttcttgatgctctctgacaccttgtccgagatccccggcggcgtccccggcccgctcgacctcaccgcgaagccgacgcggcgcgccacggggaaccagacgcggccggcgatcttcctcctcgggactacgtcccccccccccccccgccaagcttggtgtaagtgtactataatacatatataatgatgattgtataagtataaaattaaagaatacactac

SEQ ID NO: 14338 - DNA, 884 bp, Panicum virgatum
  misc_feature: Ceres CLONE 1775814
  misc_feature: Encodes the peptide sequence at SEQ ID NO. 14339
agtcgccactcgcccacctctccagccatccgctcgcttccgccatggcggccttcccctccgcctccccgtcgccggcgatctccgcctcgacctggcgcatggcgtccctccgggcggcccttcccacgctccgcccttccccggcgggcaggctccggtcgtccttctcgcccgcggcggcggtcggctgcctcgggtcattctccggcctcgcgcccgtctcgaatcttctatcccttggtgccgagaactcaagctttgagcatcggttgttcagtgttgatgctcgtggaaggatagttgcaatgcgacacgggagacgtgttccaaaacttaacaggcctccagatcagaggaaagcacttctgcgtggtcttaccacacagctgctgaagcatggaaggataaagactacaaagccgagggcaaaggcaatgaggaagtatgttgagaagatgatcacgttggcaaaggatggatctcttcacaagaggagacaggctctggcattcatatatgagaagcatatcgtccatgcattgtttgctgaggttgcagacaggtatggagacagagagggtggttacacaaagatcatcccaacatttccaagacggagagacaatgcacctatggcgtacattgaacttgtctaggatcttccatcagatgcagtgatttcatgggcgatgtgcaggttgtgtgctcatgtctgcaaattgccctttgggggcctctttttttcttctgaagttcttttgtaacaaagtgtagatcatgtgtgaaattttgagctgtcaaatgttgccctgtaaactcaaattgacaaaacactatgctatattttggaaagagttgctggcatcgtatcgtgtcttctc

SEQ ID NO: 14339 - protein, 204 aa, Panicum virgatum
  misc_feature: Ceres CLONE 1775814
  misc_feature (108)..(204): Pfam Name: Ribosomal_L17 Pfam Description: Ribosomal protein L17
MAAFPSASPSPAISASTWRMASLRAALPTLRPSPAGRLRSSFSPAAAVGCLGSFSGLAPVSNLLSLGAENSSFEHRLFSVDARGRIVAMRHGRRVPKLNRPPDQRKALLRGLTTQLLKHGRIKTTKPRAKAMRKYVEKMITLAKDGSLHKRRQALAFIYEKHIVHALFAEVADRYGDREGGYTKIIPTFPRRRDNAPMAYIELV

SEQ ID NO: 14340 - DNA, 741 bp, Panicum virgatum
  misc_feature: Ceres CLONE 1775817
  misc_feature: Encodes the peptide sequence at SEQ ID NO. 14341
attccagcgccaatcgcaattcagggctgtcacttgtggcgacggccgactgcaggcgactgcgagccgccgccctcgcggagctcctcggccgccgggagcaggaagcgacgactgcgccccggtcagctagattagacgatatggttacccctccaccagctagggctcctgcaatcaccaagtttctgaagccctatattctaaagatgaatttcacaaataattttgtcagtgctcaggtcatccacaccccatcggccacagtcacatgctctgcaagttctcaggagaaactcctgaggccaagcatggagtcaacgcgggatgttgctgcggcagcaaagattggaaagctgctcggtgagcgcttgctgtttaagggtatccctgcagtatctgtctccatgtcaagagaccagaagtaccatggcaaggtcaaggccatgatagactctcttagagatgctggtgtgaaattgctgtgaggaaaactgattgttgccaagctataactgccatgtgacagtgttttgaatctgagatttcagtttcgttgttccaaactgttcttgataatgctactgctatgaagttgaactgtctcaggcagcataatgcaacacggacagcaaaattactttgtgttgggtttttttggtgtcgcctcgcctatgtgtacaaaaccaaaggtgtattaacctgcttaatacaacactcataacgtgtattttgttctcg

SEQ ID NO: 14341 - protein, 114 aa, Panicum virgatum
  misc_feature: Ceres CLONE 1775817
  misc_feature (4)..(113): Pfam Name: Ribosomal_L18p Pfam Description: Ribosomal L18p/L5e family
MVTPPPARAPAITKFLKPYILKMNFTNNFVSAQVIHTPSATVTCSASSQEKLLRPSMESTRDVAAAAKIGKLLGERLLFKGIPAVSVSMSRDQKYHGKVKAMIDSLRDAGVKLL

SEQ ID NO: 14342 - DNA, 806 bp, Panicum virgatum
  misc_feature: Ceres CLONE 1775825
  misc_feature: Encodes the peptide sequence at SEQ ID NO. 14343
accactcctcgatccccacttcactcgccgacgaccaggcggccccgttccgggccgtcggcggcagccggagagtgaggccgagcaaccaattgtaccttcgccagcaggcgcagtggacccggacatggccgggcagcctccacagggcccggaggacgacttcctcgaccagttcttctccatggccggcggctcctactccgccgcggccgcggggggcggccgcgccgcgggggaccagcccttctccctcgctctcagcctagacgcggcggcggccgaggcttccgggagcgggaagcacgcagagggcggcaaggcggatcgggaggtcgtgcagctccccgggcttttcccgccggtgttcggcggtggtatgcagccgccccaactccgccccagcccgcctacccaggtgttgcgcaattggttgctgatatccctctttcagttaagggggaagcaagtgatagtgggagcaaacagcagatttgggaaaagtggtcaacggatggcacggaaagacagattgcaaagctgatggaagaagacattggggcagcgatgcaatttctccagtccaaagcactctgcatgatgccagtctcgctagccatggcaatttatgacacacaacattctcaggatggccaaccagtgaagccagaacccaacactccttcctagtacagtagcagcaaccatagcatgcatccttacaactactagcaggcaccaatctatcaaagtgtaagataaactgctggttttcgattcactaacaaggaggcaagaaaagacct

SEQ ID NO: 14343 - protein, 48 aa, Panicum virgatum
  misc_feature: Ceres CLONE 1775825
  misc_feature: The sequence is a functional homolog of SEQ ID NO 1106 in the 10/225,066 US patent application
  misc_feature: The sequence is a functional homolog of SEQ ID NO 220 in the 10/225,068 US patent application
  misc_feature: The sequence is a functional homolog of SEQ ID NO 2368 in the 10/374,780 US patent application
  misc_feature: The sequence is a functional homolog of SEQ ID NO 390 in the 10/412,699 US patent application
  misc_feature: The sequence is a functional homolog of SEQ ID NO 909 in the 11/479,226 US patent application
  misc_feature: The sequence is a functional homolog of SEQ ID NO 1211 in the 11/479,226 US patent application
  misc_feature: The sequence is a functional homolog of SEQ ID NO 546 in the 10/412,699 US patent application
  misc_feature: The sequence is a functional homolog of SEQ ID NO 1488 in the 11/479,226 US patent application
  misc_feature: The sequence is a functional homolog of SEQ ID NO 712 in the 10/412,699 US patent application
  misc_feature: The sequence is a functional homolog of SEQ ID NO 901 in the 11/479,226 US patent application
MEEDIGAAMQFLQSKALCMMPVSLAMAIYDTQHSQDGQPVKPEPNTPS

SEQ ID NO: 14344 - DNA, 838 bp, Panicum virgatum
  misc_feature: Ceres CLONE 1775830
  misc_feature: Encodes the peptide sequence at SEQ ID NO. 14345
gattcaagcctacgtccttgcatcttcatcaagctactataatactcatatctgagatgaatcccttgctttgccttatgaatcttcacgtcctgttcttctttgtcttaaacattccatcatttgttaacagcaagcaccaatttgtctactccggcttcactggtgctaacctcaccctcgatggtatggcctctatcacaccaaatggtctacttcaactgaccaatggcaccctccggctcaaaggccatgcgttccacccaactccattccacttccgcaagaagcccaatgggacagtgcaatcgttttctgtcacatacgtctttgccatctactgcatccaatgtgccatctgtggtcatggcattgcgttcctcattgctgcaagaaacaacttctcggatgcattgcaggcataaaggatcactcaccggcgcagtggatcctaagctgatgaggcatgcctgctactaaagttaggattgctgtgttcacacccgtttatcaatgcaaggccaaacatgaggcaagtcatgcactatctcagtggcaacatgccactaccagtgcagctaacgccagtagatatgagcttcaacatgctttccttgatgcagaacaaacttccactccggcgaccctgacagactcattatttggggcaagtacatattacctgacatcttaggagctaggttaaatgcatgtatttctaattttataaatgttacttctttattatatatgaacagacatttgtactgagtcggtggtgaacattatctgactgtaaatataagcaaattataatcagagattcttgttgccgcac

SEQ ID NO: 14345 - protein, 122 aa, Panicum virgatum
  misc_feature: Ceres CLONE 1775830
  misc_feature (26)..(122): Pfam Name: Lectin_legB Pfam Description: Legume lectin domain
MNPLLCLMNLHVLFFFVLNIPSFVNSKHQFVYSGFTGANLTLDGMASITPNGLLQLTNGTLRLKGHAFHPTPFHFRKKPNGTVQSFSVTYVFAIYCIQCAICGHGIAFLIAARNNFSDALQA

SEQ ID NO: 14346 - DNA, 947 bp, Panicum virgatum
  misc_feature: Ceres CLONE 1775843
  misc_feature: Encodes the peptide sequence at SEQ ID NO. 14347
aagaacactccggcggctccccaccgacagcgctcgatcgagctaagcttggtcgcccggccgcgtgcaaaagatctatccatggcgcggctcccgcgactgcccgccgcggcggccttcgccgtggccgtcctcctctcggccgccgcgctgccggcggcgcgggccgcgtcgccggcggcggacgacgcgcccgagtaccggaaccacaccgtgggcggcgccgacggctggttcttcgacgccaggaccaatgccacctccggaaactactccggttgggccaacggcgagacgttctacctcggtgactacctcatattcaagacgaacgacaactcgtcggtggtgcacaccaccaatgccaccacctacgacctctgcgacccctccgacgacctgtctccggccacctacatctacagcggcggcggcctcgaggagaacaacaccatcccggtccctctcgtcgaggagggcgccaactacttcttctccgacgccgacggcggcgcgcagtgccagcaggggatgcgcttcgagatcaaggtcgagcacggccagggcctgccgccgtcgctgaagaacccgcccccggcgcccaaggagcgcgtcctcgcgccgcccccggccgggacggccttctcgggcacaggcggggtcgagcctggggacggcgccggggataacggcggcgcgggcaggagcggcgcgtacagagcggcggcggccggcggccggttcttaggggcggctgtcgctgtggcgctggcggctctggttgctgcctgatcgagtggacttggtggggtcgcgatgtcagagataggagttctgccattggttgtttgaatttctgtatttaattttatttatttgaccttactattttggtgggcgatatattgtcactgttttactagttttatttatttttctccttttgc

SEQ ID NO: 14347 - protein, 236 aa, Panicum virgatum
  misc_feature: Ceres CLONE 1775843
  misc_feature (51)..(151): Pfam Name: Cu_bind_like Pfam Description: Plastocyanin-like domain
MARLPRLPAAAAFAVAVLLSAAALPAARAASPAADDAPEYRNHTVGGADGWFFDARTNATSGNYSGWANGETFYLGDYLIFKTNDNSSVVHTTNATTYDLCDPSDDLSPATYIYSGGGLEENNTIPVPLVEEGANYFFSDADGGAQCQQGMRFEIKVEHGQGLPPSLKNPPPAPKERVLAPPPAGTAFSGTGGVEPGDGAGDNGGAGRSGAYRAAAAGGRFLGAAVAVALAALVAA

SEQ ID NO: 14348 - DNA, 805 bp, Panicum virgatum
  misc_feature: Ceres CLONE 1775847
  misc_feature: Encodes the peptide sequence at SEQ ID NO. 14349
gtttcctcctcgccgcaccggggggcaatccgcaagccattctctcctcctcgattcccctcgtcgcgggatcgccggatctcccttgcacaccgcggccggagaagaggaggagaggggcagcctcattcatcggatcggcgtgcctgtgctgtctgtggtttcgattttccttttcccccccttatttttccaggttgataagatttgggggcgatcgccatgggattcgggatggggaataacggggcgagctcgtcgtcgtcgcggctggaccccgccccgctcctgccgcaccatggcagcgcgggcggcgagatcggcctgtcgtcgcagcccaagacgtttgccaacgtcttcatcgcggtggtcggcgccggcgtgctggggctgccgtacaccttctcgcacaccgggtgggcggcggggtcgctgctgctcttcgtcgtcgccgcgctcaccttctactgcatgatgctgctcgtcgcgtgccgccgccgcctcgccgacgagcacccgaagatcgcttcgttcggggacctgggggacgccgtgttcggcgcgcacgggcggtccgccgtggacgtgatgctggtgctcagccaagtgagcttctgcatcgggtacctcatcttcatctccaacaccatggcgcacccagggttcaacttttcggtcgaatttcgccgaaatttcggtgttttttttcgttttcgctagttacctcggtcgaatttcgccgaaatttcggtgtttttttcgttttcgctagttaccgggaggagaaatttcggtatttttcgtc

SEQ ID NO: 14349 - protein, 165 aa, Panicum virgatum
  misc_feature: Ceres CLONE 1775847
  misc_feature: Useful for making plants with modulated nitrogen use efficiency
MGFGMGNNGASSSSSRLDPAPLLPHHGSAGGEIGLSSQPKTFANVFIAVVGAGVLGLPYTFSHTGWAAGSLLLFVVAALTFYCMMLLVACRRRLADEHPKIASFGDLGDAVFGAHGRSAVDVMLVLSQVSFCIGYLIFISNTMAHPGFNFSVEFRRNFGVFFRFR

SEQ ID NO: 14350 - DNA, 569 bp, Panicum virgatum
  misc_feature: Ceres CLONE 1775861
  misc_feature: Encodes the peptide sequence at SEQ ID NO. 14351
tggcggcttccaccgccaggacggggaaggatgtcaacccgcactacttcctgaaggcctactccgcccacctcgggcactccggcaaaatggagctacctgagtgggttgaccttgtgaatactgcgaggctccaggacctccctccttatgaccctgactggcactaccccatggctgcctcaattgcaaggaatatctacctcgtgcatggcgtgggggtgggtggattccataagatttatggtggccgccagaggaacggctcccgcccaccacacttctgcaacagcggcgctgccatttcacgcgacatcctgcaacagatgaagaatatggctctccttgatgttgaccccaagggtgggcggctcatcacctcccagggtaggcgtgatcttgaccaattagctggaatagttgctgttgacgcatgatcctctcaccgctctgttttgatgatgtccatgttagatggctaagatggctacgctgtatttgcgattttgaactagcacttgccctgccctgctggctcagagaatttatgatgttctgcatctagttat

SEQ ID NO: 14351 - protein, 144 aa, Panicum virgatum
  misc_feature: Ceres CLONE 1775861
  misc_feature (6)..(144): Pfam Name: Ribosomal_S19e Pfam Description: Ribosomal protein S19e
AASTARTGKDVNPHYFLKAYSAHLGHSGKMELPEWVDLVNTARLQDLPPYDPDWHYPMAASIARNIYLVHGVGVGGFHKIYGGRQRNGSRPPHFCNSGAAISRDILQQMKNMALLDVDPKGGRLITSQGRRDLDQLAGIVAVDA

SEQ ID NO: 14352 - DNA, 1445 bp, Panicum virgatum
  misc_feature: Ceres CLONE 1775864
  misc_feature: Encodes the peptide sequence at SEQ ID NO. 14353
gattttctcaagtctacttcctcctcctcgtcgtcttctccccacggtgagagcgagagacaaacgcgcaggaggagagtgtggaagcagcagctgagcgcggccatggcgggcggcgccggcgcgcgggacccgctcgtcgcctccgagatccacggcttcctcaccttcgcagacttgaactttgacaagctgctggctgaggccggaacacgctggttccggccgaatgagatctatgcagtgctggcgaaccatgccaggttcaaggtccatgcacagcccatcgacaagcccgcgagtggtactgttgttctgtatgatcgtaaagttgtccgaaacttccgtaaagatggccataattggaagaaaaagaaggatggcaagactgtccaagaagcccatgaaaaattaaagattggtaatgaagaaaaggttcatgtgtattatgctcgaggagaggaagatccaaatttctttcgtagatgctactggctgcttgacaaagagttggagcgcatagttcttgtgcattatcgtcaaacatctgaggaaaatgccataccaccaccacatatagaagctgaagttgcagaagtgcctccaatcaatattattcattatacctctcctctaacatcaacagattctgcctctgctcgtactgagctatcttcttgtgcagctgctgcaccagaagaaattaactcacatggtggcagagcgatttcttgtgaaacagatgatcatgattctagcctcgaatcattctgggtagatctattggagtcatctatgaagaatgatacttctgtccgtggtggatctttgacacccaatcagcagactaattatgggatgagggattctggaaataatatcttgaataccaatgccacaagtaatgctatcttttcttcaccagataatgtagtttcagaagcttatgctgccaatcctagcctcaatcaagtatcagagagttactatggagctctgaaacatcaagtgaaccaatctccatcccttttaacgtcagatctggattctcaatcaaagcctcttgcaaattctattatgaagactccagtggatggtaacatgcctagtgatgtgcctactaggcagaacagtcttggactgtggaagtacttggatgatgatattagttgtttaatgaataatccaagctcagccgtacccatcactcgatcagtgattgacgaaatgccatttcacatcattgagatctcctcagaatgggcttattgtacagacgatacaaaggttttttttttcttttcctttcatcccatactgagttttcatgcttgcttgtttttgccccctcttcagttgctcagttcgcatggaaatgttctacttcaccttcatatgttatgaaccattcaaatgatcacttaatgtaacaactagtatcatgt

SEQ ID NO: 14353 - protein, 432 aa, Panicum virgatum
  misc_feature: Ceres CLONE 1775864
  misc_feature (30)..(148): Pfam Name: CG-1 Pfam Description: CG-1 domain
MAGGAGARDPLVASEIHGFLTFADLNFDKLLAEAGTRWFRPNEIYAVLANHARFKVHAQPIDKPASGTVVLYDRKVVRNFRKDGHNWKKKKDGKTVQEAHEKLKIGNEEKVHVYYARGEEDPNFFRRCYWLLDKELERIVLVHYRQTSEENAIPPPHIEAEVAEVPPINIIHYTSPLTSTDSASARTELSSCAAAAPEEINSHGGRAISCETDDHDSSLESFWVDLLESSMKNDTSVRGGSLTPNQQTNYGMRDSGNNILNTNATSNAIFSSPDNVVSEAYAANPSLNQVSESYYGALKHQVNQSPSLLTSDLDSQSKPLANSIMKTPVDGNMPSDVPTRQNSLGLWKYLDDDISCLMNNPSSAVPITRSVIDEMPFHIIEISSEWAYCTDDTKVFFFFSFHPILSFHACLFLPPLQLLSSHGNVLLHLHML

SEQ ID NO: 14354 - DNA, 764 bp, Panicum virgatum
  misc_feature: Ceres CLONE 1775938
  misc_feature: Encodes the peptide sequence at SEQ ID NO. 14355
ttgagttcccttcccgaacacaaacaagctcctccgcccgcaccccgccgccgccgtctctccaaaacccaagcaaaccctagatccgccgcctccgtttcccgacccaagctccggcgagacccacacccctccgccagcgaagatgccgaacctcgagtgccggatgtacgagccgcggttccccgaggtggacgcggccgtgatgattcaggtgaagcacatcgccgacatgggcgcgtacgtctccctgctcgagtacaacaacatcgagggcatgatcctcttctccgagctctcccgtcgccgcatccgctccatctcctccctcatcaaggtcggccgacaggagcccgccatcgtgctccgtgtcgaccgcgacaaggggtacatcgaccagtttaattccttggtggcgcaaaatgaagaggttgatggtgatgatgacagtgaagaggaggaagacacaggaatgggtgacgtcgaccttacaaataccggagtcacagcttattaaggcccctctggaccctggttggtttggatgagatttgctgtatagcaccagctaagacctgaaacgtcctgtttggaagcagtttctttttgtttaggtttttggtggctgaaccccagtgaattcacttaaacttgttacctgccgtgttcatgtttttttgggttcagctggtgtcgggaaaacttttacttggctcgagcagcacataattaccattgggagtgaaacaaggttcgttagttgc

SEQ ID NO: 14355 - protein, 123 aa, Panicum virgatum
  misc_feature: Ceres CLONE 1775938
  misc_feature (13)..(88): Pfam Name: S1 Pfam Description: S1 RNA binding domain
MPNLECRMYEPRFPEVDAAVMIQVKHIADMGAYVSLLEYNNIEGMILFSELSRRRIRSISSLIKVGRQEPAIVLRVDRDKGYIDQFNSLVAQNEEVDGDDDSEEEEDTGMGDVDLTNTGVTAY

SEQ ID NO: 14356 - DNA, 651 bp, Panicum virgatum
  misc_feature: Ceres CLONE 1775941
  misc_feature: Encodes the peptide sequence at SEQ ID NO. 14357
acgatttgcagcggctgcgggcgaggaggaagactcccgatctcgccggagtcggcggagcgcacgctcccctttccttcggcgtcgccgtcgtcgagcggccgcacgtgtagccgccgggaccgctcgctagccggtggcgctcggcgaccgacgcggtaggggcccgggggggacagccagcgcgcgggagaagagatcgatggggggagcggggcacggcgtgcatttcttggacgcgtgcttcctctgccggaggccgctcgccggcaaccgcgacatcttcatgtacagaggggacacggcgttctgcagcgacgagtgccggagcgcgcagatggcggcggacgaggcggcggagaggaaggagagggccagcgccaaggcggtggcgcatggggccctgcccgccagggaagcggaaggcccgcaggagcgcagcggcaaggtccgggctgggtccatcctggccctgtaaccagaaacttctctcgaatctaagcacggcattttcttttcttttttgccccccttcctttccattccatgtaggagtatttctctacctttacgaaacgcaccaccggagggtcgccaccttcatgtacacggacgggtttgtgttttttgatgatgaaaaccccttgggac

SEQ ID NO: 14357 - protein, 91 aa, Panicum virgatum
  misc_feature: Ceres CLONE 1775941
  misc_feature: Useful for making plants with modulated biomass
  misc_feature: Useful for making plants with modulated nitrogen use efficiency
MGGAGHGVHFLDACFLCRRPLAGNRDIFMYRGDTAFCSDECRSAQMAADEAAERKERASAKAVAHGALPAREAEGPQERSGKVRAGSILAL

SEQ ID NO: 14358 - DNA, 820 bp, Panicum virgatum
  misc_feature: Ceres CLONE 1775945
  misc_feature: Encodes the peptide sequence at SEQ ID NO. 14359
agagcaacacctcgcctcgccctcgcccgcagccatggccgcgcccccgccgccgccgggttgcgcgaggttcccgccggtgcaccgctacgacgcctccgcgcgcccgcgccgcaccgccgccgcggacctcgacggcacgctgctggcctcctcctccgccttcccctactacttcctcgtcgcgctcgaggccggctcctacctgcgcgccctcgcgctcctgctcgccgcgccgctcctgctgctcctctacaccgcagtctccgaggccgccgccatcgcgctgctcgtcctcgtcaccttcgcggggctgcgcgtccgcgacgtcgaggccgtcgcccgcggcgtcctgcccaggcactacgccgccggggtgcgcgccgacacctgggccgtcttccgcggctgcgacgcccgccgggtcgtcgtcaccgcctcgcccgccgtcatggtgggggagttcgtgcgcgagttcctcggcgccgaggtcgcggggaccgagctcgagacctgcgccgggggaaccaggttcacggggcggatcaaggccgtcctcgtcggggagaggaagagggaggtcgtccagaggctcttcgccggcggcgacatgcccgacgtcgggctcggcgaccgcgagagcgaccacgacttcatggccatctgcaaggtaggagggacactaatcatccgtccaactaccaacaaatggattgattcaactttgttgtcgaattaactatgttgactagtgcttctgagtagtaattgttactctttctttggttggctcaagcaacaaatataattattaattgct

SEQ ID NO: 14359 - protein, 234 aa, Panicum virgatum
  misc_feature: Ceres CLONE 1775945
  misc_feature: SWISSPROT Homolog: EC 2.3.1.15 Glycerol-3-phosphate O-acyltransferase
MAAPPPPPGCARFPPVHRYDASARPRRTAAADLDGTLLASSSAFPYYFLVALEAGSYLRALALLLAAPLLLLLYTAVSEAAAIALLVLVTFAGLRVRDVEAVARGVLPRHYAAGVRADTWAVFRGCDARRVVVTASPAVMVGEFVREFLGAEVAGTELETCAGGTRFTGRIKAVLVGERKREVVQRLFAGGDMPDVGLGDRESDHDFMAICKVGGTLIIRPTTNKWIDSTLLSN

SEQ ID NO: 14360 - DNA, 921 bp, Panicum virgatum
  misc_feature: Ceres CLONE 1775953
  misc_feature: Encodes the peptide sequence at SEQ ID NO. 14361
aaccctagccgccgcgccgccgccgcttctcctcctcgcttgaaggagcttgtgaagggtccatcagactgagaagatggttcttaagactgaactttgccgttttagtggccagaagatatatccagggaagggtattaggttcattcgtgctgattcccaggttttcctttttgctaactcaaaatgcaagcgttacttccacaaccgcctgaagcctgcgaagcttacctggacagctatgtacaggaagcagcacaagaaggacattcatgctgaagctgtgaaaaagaggcgtcggaccaccaagaagccatactcacgctcaattgttggtgccactttggaagttattcaaaagaagagaagtgagaagcctgaagttcgtgatgctgctagggaggctgctctacggtatgttttccatctttctacagagctattccttacaattttattactccaagaattttgtattagtaaggctggtattgcatattggtccttcaccacatcgttttaatccttgtgaaaagctattttgcttcaacatccctcttttaatggtcctgcatggtatttatttggtgtgtaaatttgtagtgagataaaggagcgcattaagaagaccaaggatgagaagaaggccaagaaagcggaggtggcgaaatctcagaagacacaaaccaagggtgcagcaccgaaggttcctaagggccccaagattggtggtggcggtgggaagcgctgaatgcccattgcatcatagagatatagttctgtcaactagccttctctcccatcctatcttagacattggtcaaattagtctgctgtcttgagttttcacctttctgatgagattggtgtcctgaatgttttggattgtttcttgagttgatttaaattggcacttatgtc
